United States Patent 10,407,724 (METHODS AND COMPOSITIONS FOR SCREENING AND TREATING DEVELOPMENTAL DISORDERS) - sequence listing, part 86

SEQ ID NO: 2542 - DNA, 23729 bp, Homo sapiens
agagaaagagagagagacatacagagagagaaagagagagatggggagagagctgcctggcatggtgggataaataagtgggtgacgcctttgttttcattgtgtttactacgatggccctcctctccctcttgagcacttgagatacatcactacgagagaactcaagttaaaacaatgctcctcggatacacagctgtcctcagaaaccaccttcaggataaactctgtaaatattgttgtcagaatggtaaagtgttcagataattaaagttgtcctctgactcccaggtctagtctagaaaagaagattaaaatgaaagcaccattgacccacccgcgaggcaaagagcagatgccccaaagagcttgtgtaagtaaagaggaaagaaaggctttcgaagacaaggcactacccaagggcgagaagtcaatcttgatgttgccgtggaaacgcggacttgtgaagagctttcaagaacaattctgtctccaaggaggtaaatcgtcctcctgggaatgcgttgaaaccattatccacccacaggactgggctaaaagtaaacttcagggtagcttggatgagcagcataggttgctaatgagcgtcgatttaatggtctgagttgtttatacatcaaaaagaagttaccaagggtctacctgtctgctgtttagatacactggaaaccagttaaaacttaattcctaagaagctgtttcccactgtgttcaaatttaaatgcttcaagagtaatgcttctgggcacaaaatggaaaaagtggggaaaatccaacggcatcaaaatccccacgccaccacccatgctgcaagcactgtaagctgtgatagtatctgtctgctaaaggtgctaaagagaaagcttgaggaactgagacctggcagggacccctcttaggggcaaaccaggaaactctctccacccccgaccaagcatggaaatcaagagaaatcttgagttccttccaggaaggaaactccaggcacttcgctggctgggagaagttaatgagcaacttgatgaagaagaaagtcacagtagcttaaaataacaaccaaggaaattagagtcagggatgttcgcttccctagagcaactaataaagaaaatgtggcacgtagacaccatggaatactatgcagccataaaaaaggatgagttcatgtcctttgcagggacatggatgaagctggaaaccatcattctcaggaaactatcacaggaacagaaaaccaaacactgcatgttttcactcataagggggagttgaacaatgagaacacatggacacagggaggggaacatcacacacaggggtctttcggggactgggggactaggggagggagagcattaggacaaatacctaatgtagatgatggatggcagcaaactaccatggcacgtgtatacctagtaacaaacctgcatattctgcacatgtaccccagaagttaaagtataattaaaaaaaataaaagaaactcacacctctaccctatggaatcctctggcatgaagacctcagacgtgggagagctagggactgaactctgatccctgttccttgttttaaatttcttcctgagggtcctggaggaggtcctgcccatgggccagatccaatgtgcttttactgctgaccgcaagtcttagacaaagctccacttccttaaccaattgcaagtccaaaagtctttgaatccaccttgttcctgtaagcaaccccaccctcgggcccagcttcaagatatatatttttttttttttgagatggagtttcgctcttgttgcccaggctggagtgcagtggcatgatcttggctcgctgcaacctctgcctcccaggttcaagcgattctcttgcctcagcctcccaagtagctggaattacaggcacttgccaccacacctgggtaattttttgtatttttagtcaagacggggtttcaccatgttggccaggctggtcttgaactactagtagacctcaggtgatctgcctgcctcagcctacaaatgtgctgggattacaggcatgagccaccgtacctggcccaagatatccctttttaggccaaaccaacgtatagcttccatgtattgatttatgattttttttttacttattatttttgagatgtagtctcgctctgtcgcccaggctggagtgcagtggtgccatctcggctcactgcaacctccgcctcccaggttcaagcgattctcctgcctcagcctcccaaatagctgggactacaggcaagcgccaccatgcccagctaatttttgtatttttagtagagacagggtttcaccatgttggccaggatggtctcgatctcatgacctcgtgatctgcccacctcggcctcccaaagtgctagaattacaggcatgagccacgacgcccagccgtgatttataattgttgatgaaaagagtcaaactctgtaaaatatttgaagagatttattctgagcgaaatatgagtgaccacggcccgtgacacagccctcaggagatcccgagaacatgtaccccaggtggtcggggtgcagcttgattttatatattttaggaaggcatgagacatcaatcaaatacatttcagaaatacattggtttggttcagaaaggtgggacaactcaacctgggggctgccaggctataggtaagtttaaatattttctggttgacaactggttgagtttatctgaagacctggaatcaacagaaaggaaatgtccaggtggagataaaggattgtgggaaccaagttttattttgcacaggaagctctcagatagcagacttcagagagaacaggttgtaaaatgtttcttatcagacctaaaagggggcctggctctcagttgattatgtcccagatctgggaaggaacaaaggaacaaagggagggacggaaggaaggagggaaggagggaaggaagagagggagggaaggagggaaggaagggagggagggaaggaagggagggaaggagggaatgaaggagggaatgagggagggaaggagggaatgagggagggaaggagggaggcagggagggaaggagggagggagggaaaggagggagggagggaaagaagggagagagggaaaggaatggagggaaggaaggaagggaaagaagggagggaaggaaggaaggggagaagggaggaaggaaggggagaagggaggaaggaaggggagaaggaaggaaggaaggaagggaggtaaaggaggtaagggagggagggaggaaaggctattctctatagaatgtggatttttcccacaagagacttctcagggcaatttcaaggtatggcaaggaaatatattttggggttaaatacattgtttttccttgtctcattatgttatgccagagtcacattggaaagtaagttacgatatatagggttaaataaaacccatctaatgagaactcatggtttgtaaagaatgactccctagaccctttagataggaatttgggcaagataaaaaaatcagaacttcgtcctcatgattttgcctggagcagcttctgtcctgaaatttacccgacttgaaacactatggctcggaagtcattgaaaagattgggtcttaggccaggtgcggtggctcacgcctgcaatctcagcaccttgggatgccaaagcgagggaatcacctgaggtcgggagttaagagaccagcctgaccaacatggagaaatgctgtctctactaaaagtacaaaactagccaggcgtggtggcgcatgcctgtaatcccagccactcagcaggctgaggcaggagaattgcctgaacccgggaggtggaggttgcggtgagctgagatcacgccatagcactccagcctgggcagcaagagtgaaactccgtttcaataaaaaaaaaaaaaacgttaggtcttaagcgtgagctgcctgagtctcctggcttggtgctgtccaaataaacactatcctttctcttgctgcaaagcctcattgtggaggtttgacctaagtgcaccaggcaagtggacaccagtccagtttggcaacaaaacaggcatcagtaacgtggggtacagggtgagaaaggcctacatcagcagctttttatgagatgaaaagatttcctatcaggagaacataaacagacttagactaaggtgttggacttctgttcgtctgaggatcctgtttcttgctgcctggtgagaaggtagtgaggtcatttgggtatacatagcagcattaacagcttgaacctagcgaatatagatgcccatctgtctgcagaagttgcctccctctgccctcaaatgagctgcttaaggagccatccatcttagctagctctgctgcgtaacaaaacgccccaaacgtagtagtttaaaaaacaacacccctttatgatctcacagttctgtaagtcagaagattgggtttagattaacaggatgtctccatttagagtctcacaaggctggaattaaggtgtcagacaaagctgagatgacatctgtagcttaggatgctcttccaggcatgctgaattgggaggcaaaattcagcttcttgtggttgtgagattgagtcacattttctctcttttctttgagacagagtctcactctgttgcctaggctggagtgcagtttcgcgatctcagctcactgcaacctccgcctcccaagatcaagtgattctcttgcctcagcctccccagtagctgggattacaggtgcctgccaccacacccagctaatttttgtctttttagtagagacgggttttctccttgttggaaagagtggtctcaaactcctgatctcaggtgatccaccggccttggcctccaaaagtgctgggataacaggcgtgagccaccgcgcccggccaagtctcattttcattttggctgtcagacaatggtggctctctgcttgctgtgacaccctcagcaacttgtcatatgggagtctgcttcttcaaaaccagcaaaaagggccggctgcggtggctcacgcctgtaattccagcactgtgataggctgaggtggggaagatcacctgagctcaggagttcgagaccagcctggccaaaagggtgaaaccctgtctctacgaaaaatacaaaaattagccaggcatggtagtgggcgcctgtaatcccagctacttgggaggctggggcaggagaatcgcttgaacctgggaggtggaggttgcagtgagccgagattgcaccactgcactccagcctgggtgatagagcaagactctgcctcaaaaacaacaacaataataacaacaaaaaccaggaaaaggatctctgagaccatctcaagtttatttgaagaagaagaattactcattcatctcaccctctttgaggcaggtccagcacagatgatctctcctttgattaaacccacgtatgcctagtgttccattattggaatgctaagcatgtggagttatttatatcctactgctcaaggtcatcgccaagatctgatggcaaaaattcaaaaacttgcaacttcaggcataaatggattaactcaaagttttgaatcaaagaagatgagtgaggcaagcctccattagtttagaggttaattttgccacggttgagaatgtgccccagtccaggaaaaacagacgccagtcaccataggacctgtgctccgtgctttttcttttctttttgagacggagtctccctctgtcgcccaggctggagtgcaatggcgccatctcggctcactgcacccttcgcctcccgggttcaagtgattctcctgcctcagcttcctgagtagctgggattacaagtgcacgtcaccacgcccggctaatttttgtatttttactagagatgggctttcaccacgtttgtcaggctggtctcaaactcctgacctcaggtgatccacccgcctcggcttcccaaagtgctgggattacaggcgtgagccaccgcgcctggctttttttttttttgagacagagtcttgctgtgtggcccaggctagagtgcagtggcgcagtctcagctcactgcagcctccacctcccgggctcagatgattcttctgcctcactgtcccaagtagctgggattacaggcatgcaacgccacgccctgctattttttttatttttcagtacagacggggttttgccatgttggcaggctggtcttgaactcctgacctcaggtgatccacctgcctcggcctcccaaagtgctgggattacaggcgtgagccactgcgtgcggccctgtgctttttccaaggatggttttgagggctttggtatagaaagggaaaaaagcaggcaggagggaaagaggaaagaaaaaaaaaagaaggagagtagataaaagaggcaaatgattacattcttgtgagtctttgattggcactctctgaatacacattttacatggcaaagtgcgggtagaggaacagtcaatcacgcgttcatttcatgcacagtaaatccacttttgcataagacaaagtcaacatacagaagaggaagatgtcaaacatgcatttgtctcagggtgggcggagagatcatttctagtcttatctttgtcccacacttgtgaagacaagttgttaatttacattgtcagggagaaattcaacagaactctgttttaggggaaagattttggagcccacaagaaatttccttatgagcaatttgtgagagcatctccgctggggagggatgtgcagaaatgaagaggctacaacaagtgtctgaagatagtcctgaaggccaggtgcagtggctcatgcctgtaataccagagctttgggaggctgaggcaggaggattgcttgagcctagcagttcgagaccagcctgggcaacatggtgaaacctcgtgtctaccaaaaatacagaaaaaaaaaaaaaaaaaagcagctgggtgtggtgatggtggtgcatgcctgtagtcccagctacttgggaggctgaggtgggaggatcacttgagctgagaaggtcaaggctgtgccactgcactccagcctgggcaacacagtgacaacccaatctcaaaaaaaaaaaaagatacccttccagccagatgaatgcacatgaccactggcatgagaggaggtcggcattaagatacaggtcctaaggaccttgttgataaaacaggttgtggtaaagaagctggccaaaccccatgcaaaccaagatggcgacgagactgacctctggtcttcctcactgttcattatacgctaactctaatgcattcgctgctaaaagacacttccatcagcctcatggcagtttacagatgtcatggcaatgtcaggaagttaccctatagggtctaaaaaggggaggaaccctcagttcccagaaccgcccaccggcttcccagaaaactcacgaataatctttcccttgtttcgcacagaatcaagaaataaccataaaaatcaccaactggcagccctcggtgctgctctgccaatggagtggccactctttattcctttactttcttaatcaacttgctttcactttactctatggactcaccccaaattctttcttgcacaagatccaagaaccctctcttggggtcaggatcaagacccctttccagtaaacaacgcctcatgttttctataataatttcattactttgtgtgcccactgacaatggtaatggtctaacccggggttggtcaactgcagccctctagcaaaatccagccccttgcctatttttgtgcaccttgtaaaccaaaaaactatttccacatcttttaaacagtgggttaaaaaaaatcaaaagaaggataacacagttgactgttggacaacatacatctgaactgagcagattcacccatttggactttcacccgagatgactcctcctccctcttcgtcccccctcctccccccctcccttctcctcctcccctccccctcctctccctactcctgcagagtgcagtgactcacgcctataatcccagcagtttgggaggccgaggcgggtagatcacgaggtcaggagttgaagaccagcctggccaatatggtgaaaccccgtctctactaaaaatacaaaaattagccaggtgtggtggcgtgtgcctgtaatcccagttacttgggaggctgaggcagaagaagtgcttgaacccaggagacggaggttgcagtgagccgagatcgtgccactgcactccagcctcggtgacagagtgagactccatctcaaaaaaaaaaaaaaaaaagagaacgaagacctttatgatgatctacttccatttagtaagtagtaaaatattttctcttctcttccttagcattttttttctagctgactttataatatacataacatacaaactatgtactaatcgactctatgttatgaataaagcttccggtcaagagtacactaccagtatttaacttttgggggagtcagaacctatacatagattttcaactgcatagaggtcagtacccctaacccccgtgttgttcaagggtcagctgtatatacatattttttcgaggtggagtttccctcttgttgcccaggctggagtgcgatggcgtgatctcagctcactgcaatctccacctcccgaattcaagcgattctcctgcctcagcgtcatgagtagctgggattacaggcacgcaccaccattcccagctaattttttgtatttttagtagagacgggtttcaccatgttggtcaggctggtcttgaactcccgacctcaggtgatccacccgcctcggcctcccaaagtgctgggatgacagttgtgagccactgtgcccggccgggtcaactgtattttgtgccacgtgataaatatatacatttacatctcagtgtccctcaagattcttagaacacagaacttgcccattcatttacatattgcgctgttgtggtagcgatcatatgacccaaagagcttcacatatttccctatgtggacttttcttttcttttttttttttttgagatgggatcttgctctgtcacccaggctggactgcagtggggtgatctcagctcactgcaacctccacctcccaggttcaagagattctcctccctaatcctcctgagtagctgggattacagacacgcaccactacacctggctaactttttgtatttttagtggaggcggggtttcgccatgttggccaggttggtctccaactcctgacctcaagtgatctgcccaccttggcttcccaaagtgctgggattgcaggcatgagccaccgtgcctggccctgcaagtctgttttgattggatttgtttgactttaaacccattcggaagagttttcctagaattgctacactcggagacatgaggcaatgcttactctgacttttgacgttttcaagtgtacagttgaaagtcaacaacatgggtgaatgtggcaacccctccttacacaatcagagacagtcactgccaagccgcttcgtggattgtcattagcttccaatgagaaacaggtgcacaatcaaggtctaaagataaagagggttaagtgcaagacagcagccatgacgtgtcggtccacgtacagcctgtctgcctgagggctcagtgatccaaaaagacactgcaggtcagcacttcagagtgttcgcaacatccggggttacttaaccctgtggcttgacaagcagcagagatttgcaaacaatgatagcttctgtgccacttcagccgaacactggctctgaaaacagcctcagtatctgacaagctctcattcctgggcttgtggcgtggctgtccattgagagagcctaagtatatcttcatgccgaggggatgggagcatttatataaataaatgtttgcactgattacagcactgctgccaaagagcttgatgggcgatgatgatccgatttcgccatggcagcttatgtttacagaacccggctccattgcagacaggacatcgaatgtgtaacgcagtatttaaatgtccactgacatttacagctcgtgtcagcccaagagggaagaggcgttggtgtcccagtctgccaaggagggctcctgctatggaatgaatggtgtcaccccgaatctcatgtgtggaaaccctaatgccaaaggggatggtatttggagacggagcctttgggagatgatgatgtttacatcaggtcgtgaaggtgggatccttatgttgggattcgtgcccttgtaagaagagacaccagggcacacatgctccctcgtgctccacccccctctctctctgccctgcgagaccatctgtaaaccaagaagaggaacctctcaagtacccaaccatggtgccacctggatgtaaacatttctgcctccagtactatagagaaataaatttctgttatttatgccaccccatctatggtccagttaacccttaaacaacacaggtttgaattgcacgggtccacttctacgggcattttcttctacctctgccaccccggagccagcaagaccaatccctcctgtccgctctcatcttaggctactcaaggtgaagacgataaggatgaagaccttcatgacgatccactcccacttcagaaatagtaaatatattttctcttctctatgatttttaaaaatttagtttggtgtccttttttgtttttaattatctttccataagtgattggggtactggtggtatttggttacctaagttctttagtggtgatctgtgagattttggtacacccatcacccgaacagtatatactgcaccctatttgtagtgtttatccctcacccccctcccactcttcccccccaagaccccaaattccattttatcattcttatgcctttgtgtcctcatagcttagctcccacgtaacactgagaacatacgatgttggtttttcatccctgagttacttcacttagaataaaagttccttatcaggcgtggtggctcaagcctgtaatctccacactttgggacgccaaggcgggtaggtcacctaaggtcaggagttcaagaccagcctgaccaacgtggtgaaaccctgtctctactaaaaatacaaaaattagctgggcgtggtggcgtgcacctttagtgccagctactcgggaggctgaggcaggagaatcacttgaacgtgggaggcgtaggctgtactgagcagagatcacaccactgaactccagcctgactccagggcaacagagtgaaactccatctcaaaaaaaaaaaaaaaagaatgaaagttccttatgatttttgattctcaaagttccttataaggcgattctcctgcctcagcctcctgagtagctgggattacaggcgtgcgccaccacgcccggctaaaaaaaaacaaacagcattttcttttctctagcatactttaataatacagtatacaatacataaaacatacaaaatatatgttaatcgactttatggtattgataaggcttctgctcaacaataggatattcataagttttgggtgagtcaaaagttatctttggattttcaactgtgccagggacgtgtgtgacgcccctaactcccacattgttcaagggtcaactctagttttttgttgttgttgttgttgtttttgagatggaatcttgctctgtcgcccaggctggagtgcaatggtgtgatcttggctccctgcaatctccgcctcccaggttcaagcgattctcctgcctcagcctcctgagtatctgggattacaggcgccacacccagctaatttttgtatcaaggtcaactgtattttcttgcaacagccagagctgactaagacagtcttgaagctcaaagaggtacaagaacctacccaaagttatccaaccaacaagcacctggaaggcagaataaagactcaggtagccaagcgccatagccacaccatggtagagctattctgccttgtagagatgcattgaatctgtcacagggtgaatacatctccaaatgcatttgaaaactcctacgggatgctacagaaacacgtgagggaagagtgggtgtggacatactctccatctgttacactcagagtactccaactacaggagtgagatgcctcaagacaggccaaggcagaaacaagcatcactatgaaccccagaatagatatgttttttggccagacacggtggtacacgcctgtaatcccagcactttaagaggcccaggtgagaagactgctggaggccaggagtttaagaccagcctgagcaacagaggaagatcccatctctacaaaatatttaaaatatatacatagctgggaatgatgatgcgtacctacagccccagctactttagacactgtggtgggaagatcactcgagcccgggaggctgaagctgtcgtgagccacagtcacaccactgcactccagcctgggtgacagagtgagatccggtctcgaaaaaatcatcattatcgtcacagtaatgagaggaattttaggtgataggtggttactaatttcaaaaataggggcttccggtttctcctctaatgatacaggggttaagaagaaatgacttaagcagatagtaaaaattagctgggtgtggtggtgcacacctgtcatcccagctacttgggaggctgagatgtgaggatcacctgagcctcggaagttgaagttgcagtgagccatgatcacaccactgcactccagcctgggtaacagatggagaccctgtctggaaaaaaaaaaaaaaaaagattttgcacaaagttttacgatgactctgctttgtaattaaaagtaatttctgctttgttggtgatttctcacacatttatctggtagaccagatacctgcatgtgatagggtaagaaggacccatttccctccaaggagaacagcattgcaagggggttgaggacgcatgcatgtggaatccaaacattgaatgcactgagacggcgctgcatgaagcctgtctgtgagtttatgatgaagctgcacagagctccgtaggcggctctcactcctctctctcagcctttggcttcagtttaattgcatacacacccttcagagctgctcggggcccccacttcttcagccttctggcatttttctaagaaacactaaacctctttccaacgttgcccttggattttgtgtgcacgtcttccagcccttgagctgcttgacctgtgcttgcaagggttccataacactggataggacagaagctccgcccagccccaggtgaaagctctgtgctcttcagggaccatgtcctattcacactgtctccctcacatctaatacagtcatgatactcggcaatatagtactccacccaacaggcaactcagagtctgccagtgatacaggagttaagaagaaatcacttaggcagacagtaagggtatgggagtcctcggcaaggcttttttcttttctttttttttttttttttgagatggagtcccgctctgtcgcccaggctggagtgtagtggcgtgatgttcgctcattgcaacctccgcctcccgggttcaagcaattcgcctgcctcagcctcctaagtagctggcattataggtacgcaccaccaagcccggctaatttttgttttgttttttttttttttagtagagacgcggtttcactggtcaggctcgtctcgaacccctgacctaatgatccacccgcctcagcctccaaaagtgctgggatgacaggtgtgagccactgcgcccggcagcttttctctttaacgaaaagcagccccaagtcattttctaacaatgaacagcctgtcaagtcgagctgcagacatacacaagccagctgggagcttgtacgggtgaatgtcgggaggacctagggactagacacgttcaagatggcggctccatcttcccgggaggaactaacgactagacacgttcaagatggcggctccatcttccgggcaggaactagggactagacacgttcaagatggcggctccatcttcccggcaggaactagggactagacacgttcaagatggcggttccatcttcccggcaggaactagggactagacacattcaaaacggcggctccatcttcccagcaggaactagagactagacacgttcaagacagtggctccatcttccctcctctttgtcagccacatgtaaagtaagaaaaacaggaccgagagccccgaccaactacaaagcccatttgcataaccgattagggtgggcaaccagcctttcctgtgggctatgtaaatgtcatgcttgatggaaccaatctctcggagagccccgaccaactacaaagcccatttgcataaacgattagggtgggcaaccagcctttcctgtgggctatgtaaatgccatgcttgatggaaccaatctctgagctctatgtaaatgagacaccgcctcctcaaactggactataaaatccatcacatttggtgccagctggtcctttccgctcggagacccctttctctatagagaaaaccatttctctttctcttctcctgattaaacttccactcctaaactcctcgtgtgtgtctttgtcctaaattttcctgatgcccaatgacgaaccccagggtatataccccagacaacgtagccacttcactaacatgtagagagcttgcgcattttaattcctatcctcacaataggcaaagagcagaacatactgaaaatcagcaactctgcgatccatcagaaaatagagatcacaagacgaaatgctgcctgaagactggacagacaggtggcaagtggaattgtgcttgtctaggagttcctgctggagccagcacctgatggacacatttgcagggtaattattaaacagctgcaggctgacagtggacaagcctaagtaagttaaaaactcctggccaggcatggtggctcgcacctgtaatcccagcactttgggaggccaaggcgggcagatcacctgaggtcaggagttcgagaccagcctggccaacatagtgaaaccccgtctctactaaaaatacaaaaattagccgggcgtggtggcaggcacctgtaatcccagctactcgggaggctgaggcaggagaattgcttgaccctgggaggtggaggttgtagtgagcccagatcgcaccactgcactccagcctgagtgacagagcgagactctgtctcaaaaaacaacaacaacagaaaaacttctgggggcccatcttagaggggaccttgtactttcacaaattttacctccgggagctccaccaggttcccagggtgaagatcaaagaaatatccagttgtgtgttattgggggaaagtaaccactttgcaatattcctagggagacagtagcattttgaagtatgcccaaagcaatccgtgtcctctctgccctcaaaggaaattactttagcgcagtcaaagtgaactgggggaagggaaatcttctatttcagtttttcttttttttttttttctttccaggcagattttcactcttgttgcccaagctggagtataatggcgcaatctcggctcactgaaacctccacctccagggttcaagcgattctcctgcctcagcctcctgagtagctgggatgacaggtgcctgccaccatgcccggctaatttttcgtatttttagtagagatggggtttcgccatgttggccaggctggtctcgcactcctgacctcaggtgatccacccgcctcagcctcccaaggtgctgggattacaggcgtgagccaccgtgcccgaccagatttcagtttctattagctttcaacaacacttttcgtgcatgagtgacgctggcggccatgtactcagccattccatcaaggttccaagcagcaaagctgcaaaatggatctgactccttcagtgaagaagagtctccctgaatgcattggaaacactcatgagatgctactgaagcaagtaagggaagcctgactgtggacatgctctctgtctcttaggctcacagtactccaaccacagaaacgagatgcctcaagggaggcagaggcagaaagaagccatcactataaacccaagaataaagccagcagagctacagtgatggcctgtgtgctgcaggtgagcatcaccttgttgtaaggccacaggctttcctggccaccctgctcagttggcctcgtggtgggagtcactagactcaagatagacccagccagaccatctggttagagctacccaaggaaaagccattgtcagcacaaagtcactggagtcttagaatgcacagctgtgatgggctgattccttctcccaaatccctatgttaaagccctaacgcccaggacctcagaatgtcaccatatttggagatagtctttaaagaggtgattaaggtaaaacaaagtcaccagggaggcccctaatccgagaagactgggatgcttataagaagaggagatgaggccgggtgtggtggctcacgcctgtaatcccagtactttgggaggctgaggtgggtggatcacgaggtcaggtgatcgagaccatcctggctaacacggtgaaactccatctctactaaaaatagaaaaaattagctaggcatggtggcacgcacctgtagttccagctacttgggaggctgaggcaggaaaatcgcttgaacctgggaggtggagcttgcagtgagccgagatcccgccactgcactccagcctgggcgacagagcgagactccgtctcaaaaaaaaaaagaggaggagatgaggacacagacacacagagtgacgaccctgcgaggacacagtgagaagatggcatctacaagcctacaagagaggcctcaggaggaaccagccctgcctacaccttgatcttggacttacagcctccaggattgtgggagaataaacgtctgttgtttacaagccacccagtctatggtattctgtgatagcagcctgaaatggactaagacacctcataagaaaaggagatgaggacacagacacacacattgggacaaccctgtgaggacacagggagaagatggcgtctccaagcccaggagagaggcctcaggaggaaccagccctgcccatacctggatctcagacttccagcctccaggactgtgagagaatcaatgtctgttgtttataagtcacccagtctatggtattctgtgatagcagcctgagatggactaagacacctcataagaggagatgaggacacagacacacacagaggggcgaccctatgaggacacagggagaagacggtgtctacaagcccagcagagaggcctcaggaagaaccagccctgcccacactttgatctcacagacttccagccttcagaactgtgggaaaataaaagtctgctgtttaagcggcccagcctgtagtattttgtcatggcagccctaggtgactaatacaacaggtgtttcatcctgttcctttcctcaggtggtgttgcagagtaccccagcatctttaggtggtggtagaagagactccagcatctgccataacccccggaagagtgttctgtatgttacactgtggggaggttttcctcaaagcattagagtgatctgaacaatgggaatctttgcacagaggaggatgagttctactcggggatggtacctactaagagagacatgttgtcttctcttcaattgccctttaatgaagaaataaaaattatttaattattcggtgaagaaataaaaagagtattgcattctttcaacagagattctgcacttgtactcccaggtatttatgaaacctcatgttgatgcctggtgcataggccaggcagtggggctctacctaagtaatgcctggtggttggccatgggtagctggagcaccaatagcatactctaatagtccatgacatcggtctactcaagggccatggctcaaatagaaggctttgtttggaggaattcaaaagaggttctactgagaaggaacctatgaatcagtgctgctacaatacttttggattgtgcggttcaaacgccatattggttttcttccagctctccagctccagcagcactgaggcagatctgagtttctcgaagctgggcccatcaccaacaagacagtgatggtgaaagcaatgatagaagaggtcgaatttagagtaaggatcaggatggacaggtgggtacatctatgcaaccctaacctttctgaaactactaggcatagatattttcctgaagactagtctcagcctgcatggatggtccctcatggctactgtctcatttgaaaagtgaacctatgaaaagaggaaaacactatgacatccaccactgtttggtcacaccaattcttgacattaactctctcgaaggacattagtatgaccttcaaatcctagcccgcaggaaagcttcactttagttgtttgtttcctgggtgtcccttcctacaacccacgaagcaaatgccacacaccctccttacatgcataaaacagtgctgataatggatgaaacacacaagtatcagctcatgcctgcactttcagagaaaacactcttgcttagaccatgggtatgtcaagctgccaaggatacaaaaggtaaaacaatccaagggcaacagatggttcatgacaaagaactaagagggcagcactgcgattccaaaaatttggatatggacgtcaatgagagtgaatgagagagaagcagagagacggcgggggggggggggggggggggagggagggagagagagagagagagagagacagagagaaaggaaggaggaggaggagaaaggaaggaggaggaggtgaaagaggaggaggagaagcaggaggagggggaagaggaggtgaaggagaagggaaaaaaaaagtagaaggggccaggtgcggtgtctcatgcctgtaatcctagcactttgggaggctgaggcaggtggatcacgaggtcaggagactgagatcatcctggccaacatggtgaaaccccatctctactaaaaatacaaaaattagctgggcagggtggtgcatgcctgtaatcccagctactcaggaggctgaggcagaagaatcgcttgaaccggggaggcagaggttgcagtgagctgagatcgcgccacggcactccagcctggcaacagagtgagactccgtgaaagaaaaaaaaaaagaaaagaaaagggaagggaagggaggggaggggagggaaggggaggggaagagaggggaagggaaggaaagggagaaggagaaggaggaggagagaaagggaaggagaagaaacgaaagaagatgaaggagaagaaggagaaggaggaggagaagtaggaggagatgaggggcaggagaaggaggggaaggaagaagtaggaggggaagaggagggaagagaagaggaaagaagacagggagagagaataagagaatgagaaagagagaatgaaggagagaataaatgaaagaagagagagatgagaaaacctacttgtgaaagaggcctcagtagaagaaaagagaatgagcaaagagcctggtccaggccactctaaatgtctctcaaatgttaaagactgatgaaggaggagcaggaagacttatcacacgtccaaggagacaatgttgagcgacccgcaaacttagcagaagggagaacaggctctggagatgtccagtaatggggtagagcccagactcccacacttggtagttgtacccttcaacctggagaggcctcagttttctcatcagtgaaatgggcccaagaatagtatctatctcaagaaaccattttctctgctccttcatgagaagaaactcctcttccattccagttttatcatgagattacaggagttcagccccatcttcaacctgcacctttacttctgctattttcaccatagcagaagtgacttcctccactgaagtcttgaaccccctcaatgtcattcatgaatattggaattcactttttcccgatttctgttaatgtggatatcttaacttcctgccatgaatcaccaaggttctaaatggcattcagaatgaggaatcctttcaggaaggttttttggttttttttttttttttttttttttttttgagacggagttttgctcttgttgcccaggctggagtgccatagcgcgatcttggctcactgcaacctccacctcccaggttcaagcgattctcctgcctcagcctgccgagtagctgggattacaggtgcccgccaccatgcccagctaatttttttgtagttttagtagagatggggtttcaccatgttggtcagactggtctcaaactcctgacctcaggtgatccacctgccttggcctctcaaagtgctgggattacaggcgtgagccaccacgcccggccctgactcgaattttgaaaaaagttctactctgggtaaaaccctatcaaacagcatcgcttgatacagaaaaatctttcatgacagaaagggtcaactgatgtgacaaacatcactgttgtctattttaagaaattgccaaagcaccctctaccctcagcaaccaccaccctgatcagtccacagccagcaacattgaggcaagactctccaccagcaataaggttttgactcgcgaaatgttcagataattgttagtattgtttaccaataaagtatgcttaaattaaaaaatatatatcgttggaatggtgtatggatacaccacaaaacagtcttagcataatgctcaccattcactaagtgctcaataacgacattattaactttgccaattcctctgtttattgctcagaaggatgatgcatttgtcaggagaagcaaagaaaaagattcttgaaaagatcatggtgacattgctgaaaggtcggggagaaaacacaaacagactgaatgggtcctgtgaagctcaagggtgtgggtagctcgtaagaaaggctatgagcagagattacgctggagaaatatgccaggaagggaagggaagggatggtcagaagctagttagtgtgtgcagtgatattttcacaatgcttttgaaatcagcgtgttaattggctaaatgagccactggctggatgacagtatgtgagcattagctgctctatgtcagctgggattctaggaaaacagattgtgccaaacatttggatatccagaggaggcacaacaactgtgcattagaaataggacttatgtttcccacccaactacctctctctggggcctgacctgccgtctaaaaacagtccaccccaatgcagcctccagtcactctgccaggtattgacccagagtcttgattctatgcaacaaataagatctttgcattttaacccattgagttttagtaagaatcttcgacaagaagatttcttccagagaaccaaagcaggagttgcaagattgcaaagggcacactgaggtcttaaatatccatctgatttggccaggaatgtgatcgatcaaaaactcaggaattttcctggtcatcgttgtctaacgtgtattcagaatgtactctgcggtgagtaccattttacgaaaagactcactggccaagactatgggcgtgaggtaactaacaatcagggggcttggtttcattttgttgaaaaaaagttcaacaaagacatccacaaagaaataggtgatgggcctttgcctactcatttctttgctcgttttgctatttacccattcccctgttttcttgccctgtaaaatggacacaatactcaagcttcccattggtgtcaatgtttacattcacgatgggtaaaaaaaggtatttcatgatttgaaaagtgtgatgcattttattcttttttataactttaacaccttttaattttttgaacgtttttgagtcatcataacacatagcttaaaacacatacacacgtggtgcagctgtacaaacatgtatttttttaaacttgtatgttagattcgggaggagtccatgtgcaggtttgttgcacaggcaaattacgtgacatgggagtttggtgtacagattattttgtcacccacataatcagcacaatatctgatatgcagtagagacagagtgccactctgccgcccaggcttgagtgcaatggtgcgatcccggctcactgcaacctccgcctcatgggttcaagtgattcttgtgcctcagcctcccgagtagctgggattacagatgcctgctactctgcctggctaatttttgtatttttagtagagacagggtttcaccatcttggccaggctggtctcgaactcctgacctcgtgatctgcccacctcggcctcccaaagtgctgggattacaggtgtgagccactgcgcccggccaataggcagctttttaatcctccctctcctcccacccttcaccctcaagcagaccccaatgtctgttgttcctttctttgaggccacctttactcaatgttgaacttccaattataagtgagaacatgcgatatttgcttttatgttcttgtattagtttgctaaggacaatgatctccagctccatccatgttcctgcaaaaaataataagatcttgttcttttttacagctgcacagtattccacgacgtacatgtaccacattttctttacccagtctaccactgatgggtatctagcttaattcccatgtctttgctattgcaaataatgctgcaatgaacattcatgtgcaaaagtgtctttacggtagaataattggtatttctttaggtatgtacccaggaatggttgctgggttgaatggtaattctgttgttttaactcaaaagtatgctttttttttttgagacacagtcttactctgtcacccaggctggagtgcaatggcatgatcttggctcactgcaacctccacctcctaggttcaagtgattctccctgccttagcctcccaagtagctggaattctaggcacctgccaccatgcctggctaatattggtatttttagtagagacggagtttcaccatgttcgctagactggtctcgaactcctgacctcaggtgattcgcgtgccctggctgggattacaggcgtgagtcaccggacccagccgcctattttctttctttaagagataaggtcttggtctctcagccaggctggagtgcagtgatttgagcacatctcactgcagcctcaaactcctgggctcaagtgatcctcccgcctcaacctccccagtagctgggaccacatgtacacaccaccatgcccagctatttttgaaaaatttttgtagaaatggcatcttgctgtgttgcccaagctgctctcaaagtcctgagctcaaaataatcctccatcttctgaaagcattgcgattatgggtgtgaagtttctttgactttaatattttaacttaatttataacagtatttttgaataagggactctatccatcactatttaattctataattgtatatatttgcaggcccctccaagcctttgtgaaccctgaatatctgagatggtgtcagttaatttagaaagttaagtccgggcgtggtggctcacgcctgtaatcccagcactttgggaggtcgaggcgggcg

SEQ ID NO: 2543 - DNA, 6180 bp, Homo sapiens
ggaggaaaaaagaaccaactcacgcatcctccaggggtgaagactgggcattaaaataaatgcccgtatggagggaaaatatccatcttgggactcatgggaaaaacaggcaaacacaaaaaacaggaaagtaatattccataaaaaagaaatgaagagcatcagttgaaatgaagatttatgtggggcgaggcagaaggacctgagaccactaatccttcactatctcaattatagcaagaaataggttggaaggaaaacacaaatatacagcctataaaagatacccacagaggagtaattcaggtggaacataaaagagatttaaaggtaaatagaaacgaaaagaaagtcagagtcaaaatattatcaggccgggcacaatggctcgcacctggaatccctgcattttgcgaagccgaggacgacggattgcttgagctcaggagtttgagactagcctgagcaacatagtgagagcctgtttctacaaaaaatacaaaaattagctatgcgttgtggcgcatgcctgtagtcccagctactcgggaggctgaggtgggacgatgtcttcagcctgggacgcaaaggttgcagtgaaccaagatggtgccactgcactcctgcctgggtgacaagagcgagaccccatctaaaaaaaaaaaaaaaaaaaaaaaaaaaaaaaaaagactatcattacttttaatggcaaaaacagcaattacttttgcaccaacctaatatattcatatcagataaaaaataataaattcagagcacaaaaatattaaacgtttaacaaaagggttaatgcggtaacataataagaagggtgccggaaacgagtaggagatataacatcacatcctagagaagcccggacaatagtagacagagggaagatcaaaatcaagaatgaggagactcagctgggtatggtggctcaccctgtaatcccagtactttgggaggttgaggtgggcagatcatctaaagtcgggagtttgagaccacccaggccaacatggtaaaaccccatctctactaaaaatacaaaatgtagccaggtgtggtggcaggtatatgtagttccagctactcgggaggctaaggcaggagaatcacttgaacccaggaggtggagtttgcagtgagccgagattgcgccattgcactccaccctgggcaacaagtgcgagactccgtctcaaaaaaaaaaaaaaaaatacaataattagccgggtctggtggtgtgcacctgtaatcccagcactttgggaggccgaggcaggcagatcaactgaagtcgggagttcgagaccaggcaggccaacatggtgaaacactgtcatactaaaaatacaaaatacagctgggtgtggtggtgggcacctgtaatcccagctactcacgaggctgaggcaggagaattgcttcaacccaggaggcagaggttgcagtgagccgtgatcgtgccactgcactccagcctgggtgacaaagcaagactctgtctcaaaaaaagaaaaaaaatgaatgtggagaatcatgtcaggggtgcagagggcaggcttgtggaagcgtgtagaatgtagaagaaaaagatgatgacatgaagtgattggagaaaagaacatgaaagagaaggaaaccagttgagaggcaacatccaatgttggtatctctgaagacaagaactgggagaaagagacacagaaacatagttgatccttcacaggtttggactgtacaggtcagttatatgtggattttcttctgcctctgccacccctgagaaagccagaccaacctccctcttcctccttctcctcctcagcctcctccatgtgaagatgatgaggatgaagacctcggggatgatccctttccatttgatgaatagtaaatgtagtttctctttctcatgattctcttggtaacgttttcttttctctagcttactttagtctaagcataaagtatgcaatacatagaacatagaaaatatgaatgagtgaatcacctgtttatgttattggcaagggttcctgtaaacagtaggctattaataattaagtttttggagaatcaaaaggtgcacatgggccaggcgtaggggctcacatctgtaatcccagcactttgggaggccaaagtgggtggatcacctgaggtcacaagttcaagaccagcctgaccaagatggtaaaaccccgtctctactgaaaatacaaaaattagccaggcatggtggcgtgcgcctgtaatgccagctactcaggaggctgaggcaggagaatcgcttgaacccaggaggcggagattgcagtgagctaagatcacaccattgcactctggcctgggcagtaacagtgaaactctgtctcgaaaaagaaaaaaaaagttacacatggatttttgactgtgtgaggggttggtgtccctaacccccatgtttttcaagggtcaattgtaaatggaaaggtttcgtgcaaagaaaaaaaaaatccctgagataaaaacccagatctgccattataagatgtatagtaagccatacgatttatttttaaatgcccatatgtccatcaacctcatcctgatgaaaccgtggagctttaaagatcaagagaaaatcctaaaagcatcaagggaggaacaaaaaggacatctgccaatggaaaagcaaatcaggtggaaagagctcttcgtcaatgtgagatttcagtaaggaataaagaaagagctacagagtcctgaatgacaaaggatctgaacaaataaccctagacccgatatgggaaaacgagatttgtctcaaacactttgggactcaggaaattaaaaaaaaaaaaaaaaaaaagaatcattgcttgtttctctaaaactgtgcccagacacacacacacactacagcaagctaagatttccaggcaaatcactaagccattcatagggaaagacaggcactgtgtgtcagatcaaggattcacctacataacggtggttatgaaatggaaaatagagaaacacatgtacatcactggggtgtggctaccatagtcaaaacagggtaactcttgagaaaaacatcctctctacaaaacgcttattttaaaaaactaattagagattgggacaaaaagaatcctcaaaacagcaatcagaatcaagtgatagcatgtggtggatggctagggttatgctactttgtcttcaaaaggcagaacctgttgttctaatttaatttctgaagttactcagttgagaaacggagttagctaacacttggtttaaagttacgaaagtttcaaagagcttctgcacagcccaggaaactatcaacagcgtgaacagacaacctacagaatgagagaaagtatctgccaactatgcatctgataaaggtttaatatccagaatttataaggaacttaaacaaatttacaaaacaaaacaaaaataaaaacaaaaaaaatcccattgaaagcacaccctttgccacgtcaggcaaaggacatgaacagacacttttcaaaagaagatacacatgcagctggccgggcgcggtggctcacacctgtcatcccagcactttgggaggccgaggcgggtggatcacaaggtcaggagatcaagaccatcctggctaacacggtgaaaccctgcctctactaagaatacaaaaaaaattagccaggcatggtggcggggttgagggcttgatatgtgggaggcatattactaaacaatttgattaccttgtttaacctttacaacattcttttgaggtagatcttactattcttcccatttcatagacgaggaaaatgaggcttagagaagttaactaaattgcacaatattccttagttagtaaatggcgaatttaaatccagtttggaaagacagatgtgctttgcttatgcataccttgatttctgaaaaagtgcatgtaactaaagtcaaaaaccaaagctacttgcgaggctgaggcaggagaatggcgtgaacccggggagcagaggttgcagtgagccgagatcgcgccaccgcactccagcctgggcgacagagtgagactctgtctcggaaaaaaaaaaaaaaaagacatacatccagccgacaagcctatgcaaaaacattcaacatcactgctcattagagacacgcaaatcaaaaccagaatgagataccatctcacaccagtcataaaggctattactaaaacatcaaaaaacaacagatgctggcaaggtggcagacaaaaaggaacacctaaacactgttggcgggagtgtaaattagttccaacattgtgtaagacagtgtggccattcctcaaagacctaaaaacagaaatatcattccactcagcaatcccatgcctgggtatatacccaaaggaacatcaatcattctgtcataaagacacatgcacgtgtatgttcgtggcagcacctttcacaatagcaaagacatgggatcaatctgaatgcccatcagtggtagacagaataaagaaaatatggtacataggccaggtgcggtggctcacgcctgtaattccagcactttgggaggccaaggcgggtggatcgcgaggtcaggagttcgagaccagtctggccaacacatggtgaaaccccgtctctactaaaaatacaaaaaaattagctgggcgtgggggcgtgcacctgtaatcccagctacttgggaggctgaggcagaggaattttcaagggtgcagtgagctgaggcagaggaattttcaagggtactgcactccagcagcctgggtgacacagcgagactccatatcaaaaaaaaagaaagaaagaaaaagaaaatatggtacatagacaccatggaatactatgcagccataaataagaacaagatcatgtcctttgcagaaacatggatggagctggaggcgattatcctcagcaaactatgtaggaacagcaaaaccaaattactacatgttctcacttataagtgagagctaaatgatgagaacatatggacacagagaggggaatagcattcattgaggcctatcagaaggtgggaggagggacaggatcaggaaaataactaatgggtactgggcttaatacctgggtgatgaaataatcatacaacaaacccccatgacacgagtttacctatgtaacaaacctgcacctgtatccctgaacttaaaaatggtttttaaaaattatggaagtttgaactataagaatcaaaatttccagaaggttggggtgatgaggcatgaagcttccctgagtgcaaaagaactcaccattgccacccacggcaaaaagaaaagtgacatagaagcaaaaaaaaagatacaaagcatagtaacatttattcaacatctcattaaacatttcgcaagagtgaaggatagactatgcaagagggttataatggggccaggcgtggtggctcacgcctgtaatcccagcactttgggaggccaaggtgggcggatcacgagggcaggagttcaagaccagcctgaccaacatggtgaaaccctgtctctactaaaaatacaaaaatgagccaggtgtggtggtgcgtgcctgtaatcccagctacttgggaggctgaggcaggagaatcgcttgaacccgggaggcggagattgcagtgagccaagatcgcgccactgcactccagcctgggcaacagagtgagactctgtttcaacaacaacaacaaaaaaatacacatcacccaccatttcttgggtatcaacatccacctctggaatgactgaagggttattaatctaggatggtaatggagccaggttatcgccaagtttggtaagaacatccttgcctttgtcactcactgctctcttggtggagttggtaccgagacacggcccgatgtgggcagatgcttagacagggaacatggcttcctcttcctggaatggcaagaacttcgaattctgccccctctctgccaacgttagatatgtcacggttgaatgactaaacaccaaatacatatccggagcgagaaatggcatgatgctttcagaggaaggatggagctggaatttggggaatgaggaaatggcttttccctctttgtgtgtttagtgatgataagagcaatcagttctgacagctcctactggctgctacctac

SEQ ID NO: 2544 - DNA, 25275 bp, Homo sapiens
cacctctggaatgactgaagggttattaatctaggatggtaatggagccaggttatcgccaagtttggtaagaacatccttgcctttgtcactcactgctctcttggtggagttggtaccgagacacggcccgatgtgggcagatgcttagacagggaacatggcttcctcttcctggaatggcaagaacttcgaattctgccccctctctgccaacgttagatatgtcacggttgaatgactaaacaccaaatacatatccggagcgagaaatggcatgatgctttcagaggaaggatggagctggaatttggggaatgaggaaatggcttttccctctttgtgtgtttagtgatgataagagcaatcagttctgacagctcctactggctgctacctactggctggctggagcgttggctttggttagagaaaatggaacatttcaagaggagacactttccatacacattatcataaaagtttgtttgtgagatggagttttcactctgtcgccaggctggagtgcagtggtgcgatctcggctcactgcaacctccacctcccgggttcaagcgattctcctgcctcagcctcctgagtagctgggactacaggcgcccaccaccacacccaatttttgtatttttagtagagatgggatttcaccatgttggtcaggctagtctcaaactcctgacttcgtgatacacctgcctcagcctcccaaagtgccaggattacaggtgtgagctaccgcacccagctcaataaaagtttttaaaatgttatcagtaatgctataatgatcatcataacttatggtaggtacaaactatagaatccacaactgcttaccaaggtcttataaagacctaaatctgtggtttattgaggttctttgaaacccctcaattttcttcttggtattaatgattgaatttttaatggtggggcagaatctgcccaagtattagagggacaaagaaggatacagagagctggagttccatcagttcagcctggttaatgtgtcgtttctgagcacacagcaagccctaccctgtttatgtggtaaggtctcactcctatacagaacatggcatgattcaaattctaaaaagaagatgtctggataagcacttttgattgactgtctgattagaggtacttttaatggaataggcagaaaatgcaaatatctaatgaacatgctggagaggttcaccatcggcaagcatttcattttcttttcttcaaaaattaattacagagtgtggctgcgtttctgtggattcagtgtttctaattctttcttcaattagtcctttaattttcttcccaaggagacacatggatatacaacacgtaacacagtgacattttcttgtcactgaaagaaatttcaaagttcattttcaaattcaaagaaaaggaaggctggagtggattggaaaagaggctacaggctaagaacttttaagagccctagagagagtggggtgctggtgtcactgttatttcattgattttccttgtccacagccattttcaagactcatatttcagggccttagatggtttgtctcatatcactgctgtctgtagcaacaaccactctgtagaaggctcccagggaaagacccataaggtctaccttgtttttgtttgtttgtttttgaaacacagagtctcactctgttgaccaggttggaatgcagtggtgtgatcttggctcactgcaacctccgcctcccgggttcaagcaattcttctgcctcagcctcccaagtagctgggattacaggcgcccaccaccatatgccactaatttttgtatttttagtagagatggggtttcaccatgttggccagactggcctcgaaatcctgacctcgtgatccgcccaccacagcctcccaaagtgctaggattgccggcataagccaccatgcctggccaggtctgccttataagtgatatgagcataggtggaggagttgaacactggagaaggatggatcaataactccacccaaccacaggtgctcccatttctgggtgtctaatcccaacccttgagatcatgccgccattttatcaccgttctatggtatcatgccgccattttatcaccgttctatggtatcatgccgccattttatcaccgttctatggtatcatgcctccattttatcaccgttctatggtatcatgccgccattttatcaccgttctatgatatcatgccgccattttatcaccgttctatggtatcatgccaccattttatcaccgttctatggtatcatgccattttatcaccgttctatggtatcatgccgccattttatcaccgttctatgatatcatgccgccattttatcaccgttctatggtatcatgccgccattttatcaccgttctatggtatcatgccattttatcaccgttctatggtatcatgccgccattttatcaccgttctatggtatcatgccgccattttatcaccgttctatggtatcatgccgccattttatcaccgttctatggtatcatgccgccattttatcaccgttctatggtatcatgccattttatcacctttctatggtatcatgctgccattttatcaccgttctatggtatcatgccattttatcaccgttctatggtatcatgcctccattttatcactgttctatatcatgcctccattttatcactgttctatggtgtcatgccgccattttatcactgttctatggtatcatgccgccattttatcactgttctatggtaacatgcctccattttatcactgttctatggtatcatgccgccattttatcaccgttctatggtatcatgcctccattttatcaccgttctatgatatcatgccgccattttatcactgttctatggtatcatgctgccatttcatcactgttctatggtatcatgcctccattttatcactgttctatggtatcatgccgccattttatcaccgttctatggtatcatgctgccattttatcaccgttctatggtatcatgcctccattttatcaccgttctatggtatcatgcttccattttatcaccgttctatgatatcatgctgccattttatcaccgttctatggtatcatgctgccatttcatcactgttctacgaataataacacatcagcatcgaaggagatgagggaacatgcatgatggagctgtgggagaagaatccccgccacaaaaccggcccaggatcctgggcacagagatatttccacactcaacacacagggactgaggtgaaaggagacggctgggtgggatggaggagataagggaggagacccctgatccacacagcacagccatgtttggaggggaatcataatgctacgtaggatgtctaagctctcctcaagatgcgaggctgggagtccctttccagagcctcagagagcatactggtcttaggtccaggttactgccattgaatggtagtaggcacatccccacagaactgggctggcatctgtagggatctacatcagtggttttccattggaggcctttttgtttccccctcccccaggaacatatagaaatgtctggaggtatttttggttgttataactgcggtggggggtatagtgggtacatccatgtcaagtgggtggagcccagggatcctgctcaacacgctacagtccacagcatggcctcaccacagagaatcatccagctccagatggacatactgccaaggttgacaaagcctgccttagcatgacagattgtatgcatatgtgatccatttgtctgtgtgcctatcatccaactcacttcctatcatctatcacctaccatttatctatcaactatttatagaatatctatcgacctatttaccacctatcacctacttatctaccgtctatcatttatctatttaccatttacaatcaagcatctacttatctatctaccatcatttatctatttaccatttatcatctatcatctacttatctaccatcatttatctatttaccatttattatctatcaagtacatatttatctatcatttatctatctttgatcattatatagcatctgtttactctctatctactgtctatcatctacctatcatctattgaccatcgatcatttatctacctgtcatctattacctatcattgatcacaatctatcattgaccattactatctatctagctattatctatctagctattttctgtctaactaatatctatctatgtatccatcatctatctatatcacagtggttttcaactgagcaaaatttcgcctcctcagggacaactggcatatctatctatctatctatctgtctgtcatttcctcatttatgaaattggggtaataacaatgcctgcctcaaaaattgacaaatgagatctcattaaactaaagagcttctgcacagcaaaagaaactatcatcagagcaaacaggtaacctacagaatgggagaaaatttttgcaatctattcatctgacaaaggtctaatgtccagaatctacaaggaacttaaataaattctcctgcctcagcctccctggtagctgtgactacaggcagccaccaccacgcctggctgatttttgtatttttagtagaggcagggtttcaccatgttggccaggctggtctcgaactcctgaccacaaatgatccacccatctcggcctcccaaagtgctgggattacaggtgtgagccaccgtgcctggccaggttttggcctttttgatgccactttgctttgacctttacttctttctcctgtatgcctagagagttcatcctaagagcttgtcctcatatcacctcccagaatatgcaaacttacaatctctttacttcttaaaattttaccttggggctaccaagctctgaagatggaagtgagatttcctcaaaatacacagaaatgggtaaatcctcacatgctttcacaggtatgcagtctttaacctgaggtagctcagggatacctatggctcccaggatactccaccatagcaaagggtgactgcctttggtgagccttgggtggatactagagctctgtgaacaccggggcctgtcgggaggtggggggcaaggggagggagagcattaggacaaatacctaatgcatgctgggcttaaaacctagatgacgggttgataggtgtagcaaaccaccatggcacatgtatacatatgaactagttctaggaacagttcactgaacactagcgttctatgaaccccctctccctgcctgaaatgaatgctgtcttcacatgacatcctaccctctgcccaatgtctttcccgaatgggaatctcttcaccacacggccaatttatcacaaacccttctctaaacccttacaataggcaggaaactgctcatacccctacgacggctgatggcagaggataaaatattaattctaagaaaataggccgggtgtggtggcacacacctttaatcccagcactttgggaggccgaggcaggtggatcatctgaggtcaggaatttgagaccagcctggccaacctagtaaaaccccatctctactaaaaatacaaaactagccaggagtggttgggcatggctgtaatcccagctactcgggaggctgacacagaagaattacttgaacccagaggtggaggctacggtgagccgagaccacgccactgcactccagcctgggcaacaagagcgaaactcagtctcaaaaaaaaaaagaaaagaaaagaaaaagaaaatagttcaggtaattcttggaaattgtatttttataccctctaatatttaaatgaccatcaatatacaaccagggtagggggttaataaataaaggatagcattctttgctgcatcctgggcttatttttctcattctttttctgtgacactgtctcattccatcagccaggctgaagagcagtggagcagtcacagctcactgcagcctccacctcctgggctcaagcaatcctcctgcctcagcatcttgagagggagaccagaagcatatgccatcatacccggataattttttttttttttcctgtagagacgagatcttgctatgttgcccaggctagtctcaaattcctgggctcaagtgatgctcccgccttggcctcccaaaagtgctgggattacaggcaggagccaccatggatcattcgtgtgtacaatattctcactcctttgcaccggaataaaacccagccccctggaaagctgactctgagactttgtgaggatgtgtatgtgcggtttctcatctgaatgcagccatttcacgaacaccagccattccccaggcttcagttaagccattccccatcaggaagatatagggccccctttcaagaggaaccacaatggctaaaactacaatcttcacagcacacatggcttcagcaaatacagagagatgctagccgggcgcagtggctcacacctataatcccagcactttgggaggctgaggtgggcggatcacaaagtcaggagttcaagaccagcctgaccaacatggtgaaatcccgtctctactaaaaatacaaaaattagccacgcgtggtggtaggtgcctgtaatcccagcaactcaggaggctgaggcaagagaatcgcttgaacctgggaggcagaggatgcagtgagccaagcttgtgccactgcactccagcctgggagatagagcaagactgtctcaaaaaaaaaaagaaaaaagaaaaaaaaaaaagaacgatgctacattctcagaaaattagttttacattgaagcttcatttgggaattgaaaataagaacagggaaatacatttttcttttctagagaaaataaacaaggacaaagatgcatggaaaataatattttaaatgtctcctattgacctaagttataaagtcattttttatgtaataacaaaataattggagaggcgtacccaagagcacaatagtctctgaaatgtcttatttcatgtacactcaggcacacaaagacacatacataatttataactaatttagcaaaacattatgatttgatacaactggatggtgggtacacaaatgctgttcaaattattctctgcgtctttcaaatgtgtgaaatgttttataatgaaacatttttagaaggcacattgaagttcaaacaactgctaaacaatgaaaaagataaatggttgtattcaaatgcttacgggtatttactcattaagaatattttgaggccaggcacggaggctcacacctgtaatcccagcactttgggaggccgaggagggtggatcacttgaggtcaggagttcaagaccagcctggccaacatgtcaaaaccccatctctactaaaaatacaaaaattagccgggcgtggtgccgtgtgcctgtaatcccagctactcaggaggctgaggcaggagaatcacttgaacctgggaggcagaggttgcagtgagccaagattgtggcactgaactccagcctgggcaacagaataagactctgtctcaaaaaaaaaaaaaagaaaaaaggtctcctattgacccatgttataaagtcattttttatgtaataacaaaataattggagaggggtacccaagtcacatacgtaatttataactaatttggcaaaacattacgatttgatacaactggatggtgggtacacaaatgctgttcaaattattctctgcgtctttcaaatgtgtgaaatgttttataatgaaacatttttatgaggcacattgaagttcaaacaattgctaaacaacaaaaaacataaatggttgtattcaaatgcttacgggtatttactcattaagaatattttgaggccaggcgcggaagctcacgcctgtaatcccagcagtttgggaggccaaggagggcggatcacttgaggtcaggagttcaagaccagcctggccaacatgtcaaaaccccgtctctactaaaaatacaaaaattagccaggcatggtgacaggtgcctgtaatcccagctactcaggaggctgaggcaggagaatcacttgaacctgggaggcggaggttgcagtgagccaagattgtgccactgaactccagcctgggcaacagaacaagactctgtctcaaaaaaataaataacccgggaggtggagcttgcagtgagccgagatcgcaccactgcactccagcctgggcgaaagagcaagactccatctcaaataaataaataaaagtaaataagtaaataaaaaagaatattttgaaactacacattgccttctgtgtaaattaaaagccaatgaaagcctcctgattttcagggtgtctcatttctaccctatagaagcaaacctaccacacccttcactgaggagccttcgtgaccctaccaagggggaaagagcttgtcttttcaatgagtttaagagctttgcttctgcggttgaaacttccccccagccagcatttcatgttgagagacagtggctaagctgatgtggaaataacacaagaaatcttgtctgaagatgggtgataccaacatcagaactggagacagcaggtactgtgattcaggcgaaactctcaccactaattggtggagagaagaaaagaaaatgagcaaatgaactctgattttgaagaacttcattgaatcaggcttatcttgatgtcttgtgagtcaacaagatgcagctggactagatgtgtgtgtggagtattcgtgaggggctaagggactctcctatgtgtttagtttttgtttttttttgtttgtttttctttttggagacagagtctcgccctgtcacccaggctggagtgcagtggcacgatctcagctcactgcaacctccatctcccaggttcaaacgattcccctgcctcagcctcctaagtagctgggactacaggctcacaccaccaaaattagccggggctaattttttctatttttagtagagacggggtttcaccatgttggccaggctggtctcgaacacctgacctcaagtaatccacccacttcggcctccccaagtgctgggattacaggcctaagccacagcacccagccccagctattttttgtattttagtagagacgggtttcaccatgttggtcaggctggtctcaaactcctgacatcaagtgatctgcccgccttagccttccaaagtgctgggattacaggcatgagcccctgtgcccggcccggactcccctactgaaatgtgcatgacagagaccccaaggctgtcttttccagcaggagctccgggttcatgactgaggatagatgcttcccaacctgctcctcactctccaaagagcttgcaagtgggcacagatgaaccaagctcaccttcctgacaatgacacctgcagatggcacaccatgagttttgtctacaaatgcaccattcccccagtttgaggagtcccagttcgtctttttttttgaaacagagtctcactctgtctcccaggctggagtgcagtggcgcaatctcggctcactgcaacctccgcctcctgggttcaagcgattctcctgcctcagcctccccagtagctgggattacaggcacccgccaccatgcccggctaatttttgtagttttagtagagatggggtttcaccatgttggtcaggctggtctcaaagtcctgacctcaggtgatccacccgcctcggcatcccaaagtgctgggatgacagtctgagccaccgcgcccagctgagggctttgtattttacggagacacaatcagtccatcattccacacaactgtgctgttgggaatctgtgaaggttaagaattccccactgcctttgtcttccagaaaatggttttactgaaaaaaaaaaaaaaaaaattcccttcctcattactcacagatgcttccaagtcagcctaggacaaggctggccacatcctccaaattcacattctttatttgccccttcagggatggactgaattcctcgtcttccttgacctgaacaaaattcccatctaacgtgatcacattttggttgggtttctctcctcctatcaggccccgggatgttgggccagcctcacctggagcaaacgtcagaggatcaagcaacgcttccttaggacctgctcaaaattagctatgcagccacagggtttggcagcttttatccatgactgaaccccacatcgaacgaccccaatcacggttgttccgagcatcacgtgcctgtccctagaaaagaaaatggtatgctgcctgcgctccaagaggctcccagatgtcactgctcgggtgtgcttcatggtgctataggcagcgtccaccagtggttgcattagtccctcctcctcttgttacaatagttcctcccctattaccataatccctccccgccattaccatagtcccccctcctccattaccgtagtccctccttccgttaccatagaccctcctccgttaccacagtcccttctcccgttaccgtagtccctccccattaccatagtccctcctccattaccatagacccttctacttctgttaccatagtccctcctccattaccatagaccctcctcccgttactatagtccctccttccgttaccatagtccctcctcccattactatagaccctccgttaccacagtccccccttctcacattaccatagtccctccttctgttaccacagaccctcctttcgttactatagtccctcctcgttaccatagaccctcctcctcccgttaccgtagaccctccccgttaccacagcccctcctccgttaccatagtccgtccttctgttaccatagtccctccttccattaccatagtacctcctcccattagcagagtccctccttctgttaccagtccttcctcctcccgttaccatagtccacactcctccccttaccatagtccctcctcctcccattatcaccgcccctcctcctcccattatcacagcccctcctcctcccattatcacagcccctcctcctcccattacagtagtccctcctcctcttattgcaaaagctcccatctgtgggaatgatcttttcaaatgaaactgttgctacctgtgtatctggtgtctctgtcaccatcatgggacatccctgaaaggtgtacctcactgctgcagagtagcactctctgcaggaaagtccatatcttccctgccccagacaactgtgctgtccacagctggacactgggcgcttgccagacagttagtgcaatgaggcactgagtttttcttttcccttaattatcacttatttaattttcgcgcatcacacgtgacccctgacccctgttctgggcaccatcgtcggagaaattttcttgaggctcgggtttcttctttctttgctacaaactcccagggctacttactaaggtgaagaaaacacactgttatgtaatccattatacagtcaacgtatccttaccagaaccagaaaaattcacaattttaatggtgaatcgggttgggaaatccatgcttctagttttgaggcgaaatacatgactgataaaacccttttgtattatacaagggaaccggagtggatggagttttgctatagatctcccagacgcgccccacagctccatgattgacagcgtgagtgtgtctatcacacgaaccgctgggggaaggcaggcagttgtgtcaaattggaaccgaatcacaaatgaaacataaattccaggatcccgttgagtataaaaacccaggacccaacaagggcaaacgtaagcagcgaagccccagagaccccctagagcatccagcatgttggggttttaggtttgaaagggagaggttggtatttcttttcttttccttctttgtttttttttttttgagacggagttttcctcttgttgcccaggctggagtgcaatggcgcaacctcggctcactgcaacctccgcctcccgggttcaagcgatgctcctgcctcagcctcccgagtagctgggattacaggcacccgccaccctgcccggctaattttttgtatttttagtagagagacggggtttcatcatgttggcgaggctggtctcgaacccctaacctcaggtgatccgccggtctcggcctcccaaagtgctgggattacaggcgtcagccaccgcgcctggctgggggttggtatttcttgtggctcataaaccgcggctctactttgcatctgtattagttcattctcacgctgctgatagacatacccgagacggggtaatttataaagaaaaagagctttaatggactcacagttccacggggttggggaggcctcacaatcacgacggaagacgaaaaccatatcttccacggcggcaggcaaaatggctcctgtaggggaacttccatttataaaacatcagatctcgtgagaacacactcactaccacgagaacagtatgcgggtcaccgcgcccatgattcaatttcctccacctggccccacccttcacaggtgggaatcattacaattccaggtgccatgtgggtggggacacagccatcccatcgttacagagattgttgcaagtttgccagaatcctcacactcttttcagaggagacctttcaaaagaaacatcatctagggaagctatgctgtgttctgaggcgaggctggaatttcaaaaccagcttttccactaaaacacctgctccatttcctctggggcctccattctccccacgccagaattagggggtctctagtcccccagctctaatgctttccaagcaggataaccctctacatcccatggaaaccacggctgctgcaaggaagagctgagggactgcagtgccgctgaaccgagtcaccctggagttataaattatcaggttggagaaaaggggaaggggttgttgtatctggagctgaagttttcagggctgagctgccaacgtgtgatacttcaagggcccctgcgtacctgacgcggtgtggacagttcgcacccacatagagtttgcaagccaacaggaaacctaggcaggcttcctggaggaggcatcatccggccaggaaatagaggtgagatgttgacagcaggagatggtgagaaaggaacccaggaggagggttatccaaaatagggcacacaggtgagagagtgggggaagaggaagccacaggaaggaagaaaaaaggtcaatgatattgtgacgtaaagtaagttcctgtagcatcttagcatagcaagtttgagaaacagtcgtgcatggaatgaggacaaaaaaagacctctgcacctgcacacctgccctctactcacctgtccagcccaggcaatggcctaccaccctcatgtgattagtattgttctaaagaaatggagtctcactatgttgcccagtctgatctcaaactcctgggctcatatgatccttctgtctcagcctctggaattgctgggactacacaggcatgccaccgtgcctggctgatttggattcttgacagaagagttggctctgaaataccaacatgtggttctgtttaaaaacaaaggcttctcaaaacagaccacagtgaggccaggctcagggctgtaatcccagcactttgggaggccgtggtgggaagattccttgagctcaggagttcaagaccacccagggcaacatagtgagaccccatccaaaaaataaaaatagctgggtgagcagccgggcacagtgactcacgcctgtaatcccagcactttgggaggccgaggcaggcaaatcacctgaggtcgggagttcgaggccagcctgaccaacatggagaaaccccatctctactaaaaatacaaaaattagccaggcatagtggtacatgcctgtaatcccagctacttgggaggctaaggcaggagaattgctggaacccgggaggcggaggttgcagtgagccgagatcacgccattgcactctagcccgggtgacaacagcgagactccatctcaaaaaaaccaaaaaacaaaaaacgaaaaacaaagtcttctcgaaacagaccacagcaaggccaggttcagtcctgtaatcccagcactttgggaggccgtggtggaaggatcccttgagccctggagttcaagaccacccagggcaagatagtgagaccctgtctctataaaaaataaaaatagctgggtgttggtggcatgtatgtgtagtctcagctacataggaggctgaggtgggaggatcgcttgagtccaagaggtagaggctgcagtgagccagatagcaccactacactccagcctgggcaacagagcaagaacctgcctctaaaacagaaacataaataaacaaaaatgaaaataaactatcctgcattcttcagacaacactgtgactacaggacaagcggtcacgctgtcatggaaggatggagcccatctcaaagggaatttctggagtgcagaaagcaaccacatcaggtgggaatacgccctcccagtcagcaggtgcgttctcaaatctccagcgggtaattagtgcacatcacacaatgaatgagcttccgataagtgaaagtatggtatgcacaccgcggctgtgaaatgcggttcgttcttggatatcatgggcagcattgaaaacttaaacctttttcttcttgtggaaaaggctggggcttgtcatcactgtctcctcccttcccctcgcagtttatatttagctgggcacacgccgtgtggatgcccgttttcttcctcctaggggagaatcctcagctacagggttgttttggtttccttgtgtgtttgtttcttgatttattctctcttgagtcagcaagagaacggctcgatgggatggttggttggttggtcggttggttggttggttggctggttggttggtttttgagacagagtctcactctgtcgccaagctggagggcagtagtgcgatctcggctcactgcaacgtccgcctcctaggttcaagtgattctcctgcctcagcctcctcagtagctacgactacaggcgtgcacccccacgcctggctaatttttgtatttttagtagagacggggtttcaccatgttggccaagctggtctcgatctcctgacctcgtgatccacctgcctcggcctcccaaagtgctgggatgacaggctggagccactgcacccggccggctcagtgggttttaggagcatcccagcattccccggacacaaaatgtgcctctctgtgatttttactaactcgcctggagtcaccaatgttgttgccatattttgaccaaaacagtaataaaaggggcaattttcctaggggctcttgttctggtagaagaacaacttcccgctgcctgcattgcaggtgcctctgactcaggaggaaacgcagaatttggcgaacacgtgaagtcttttttcgctaaatctaaattctacagggtggctggggccaattgcagtacggatctgaggcattgtagatggcaagagtgcatgtgtgcgtgtgtgtatgtgtctgagtgtgcatgtatgtctacacttgccataaacgaaagcacaaaagggaaatgtcagaaagaaaccagcaaaggaagccagcatcattcacaatgctggtgtctgttacccacagaggatgacatcgtcattcaggtggccatgaagaaaggctttgaatgacactcccagaacaagagcctggagatctaacatccactctgattctgcccctagccttgggtgacgtgggtttaactgtgacctcaccaagatgtgtccacccagaacctaggaatgaaagctcacttggatatcagatctttgcatacaattaggttgcactagagtagtgtcattgcatacaactaggttgtcattgcatacaattaggttgcattagagtagtgtacgctgttaactgaataactggtgtccttataagaaaaggaacattggaggccgggtatagtggctcacgcctgtcatcccagcactttgggaggctgaggcaggcagatcttgaggtcaggagactgagaccatcctgcccaacatggtgaaaccctgtctctactaaaaatacaaaaattagccgggcacggtggtgcacacctgtagtcccagctactcaggaggctaaggcaggagaatcacttgaacccgggaggcagaagttgcagtgagccgagatcacaccactgcactccagcctgggtgacaagagcaaaaactctatctcaaaaaaaaaaaaggagaagaggaacactgtggcatagagacacagagatggccacgacaaaggcagatactgtattgatgcttctacaccagccgtccccagcctttctggcacagagactagtttcatggaacacaatttttccacacacacacaaaaactgtcttcatagaaagacagtcactgtgagtgcagggggaaggatctggggatgatttgagcgtatgacatttattgtgcactttatttctatgatgatacgttaaatgaagtaattctacaatacaactcattgccatgtagactcagtgggagccccaaacttgttttcctgcaactagatggtcccatccggggggtgatgggagacagtggcagatcatcaggcattagattctcataagaagcatgcaacccagatccctggtctgcccacttcccaatagggttctcaatcttctgataatctaatgccactgctgatctgacaggaggtgacctcaggcggtaatgcgtgcagtgggaagtggctgtgaacacacatgaagctttgctcagtaccagtccacagccagggggttggagtcctctgttctacaggacaagaaacaaccaggattgctagctagcgaaggaagccagaagagatagcggaggatcctcctccagagcctccgcaaggggcacagccctgccttaatactccagaatgaaatgcatttcataattgcagtgtgcacacaatactttttttttttttttgagacagagtcttgctctgtcgccaggctggagtgcagtggcatgatctcagctcactgcaacctccgcctcccgggttcaagtgattctcctgcctcagcctcctgagtagctgggactacaggtgcgtgccaccacacccggctaattttttgtatgtttagtagagatggagtttcaccatgttggccaggatggcctcgatctcttgacctcgtgatccgcctgcctcggcctcccaaagtgctgggataacaggcatgagccactgcgcccggccgtgtgcacacaatacttcaacttactgaacgcttattctttgtgtctggtgcaatagtgacctgctggagatttgcaaatatacttagtgactggaaggttgtatttccacccggatgtgttggctttctgctccaggaatgtcctttgacacgggctctgcccttggatgaccaggtggtcagcctgccttggctgtggacttctggtgttcagagctgtcagagatttgacttctgtggctttcagccagctggtttgtagaattgtgtcgcagcagctccaggaaactaaaatattgagcctcccctatgacagtggacccttgaacaccacgggcttgaattgaatgggtgtccccttatatgtggattttcttctgcctctgccacccgagacacccccttctcttcctcctcctcctcaacgtcaagatgacgaggatgaagacatttatcatgagccacttccacctgataaacagtaaagatattttctcatccttacgattttcttaaggaaaatcacagcttactttattgtaagaatataatatagaatatttactatatttttctctaggttacttcattgtaagaatatagtatataatacatactatatttttttctcttgattaattttttttttgagacagagttgtgctcttgtcacccaggctggagtgcagtggtgcgatctcggctcactgcaacctccacctcccaggttcaagtgattctcctacctcagccccccgagtagctgggattgcaggtgcgcaccaccacgcctggctacttttttgtatttttagtacagacggggtagccccatgatggtcaggctggtcacgaactcccaacctcaggtgattcgcctgcctcaacctcccaaagtgttaggattacaggcgtgagccaccgcgcccggcctttggcttactttattgtaagaatattactatattatttgtgtctggtgcaataatgacctgcctcatgatctgtcactgtctcccattacccctagatgggaccgtctagttgcaggaaaggcttccagccaacagcaagctattagttaagttttgggggagtgaagagttacacaaggtcttcacgtgcccctaaccctcacgtggcttcagagtcccctgtaaatgaatgtgtggcaagcaaagaaagaagaacatgaagaaaagagggagaggaataccctaccactacacaagaccatatatcaccaacaccattaattcttccttctacatgataagccggcaaagtccctgtccttgataactgtgccaatgacgtctgattcccagtagatggatgatgactaattagtcctacatggcaaacaaacgaagggttaattaatctgagcctgcctgagttatctgtgaatgaggatagcccagtcacttgacaatcattttaaacaggtcaacggatgatcaatcacgactgaaattcccccgtaaaagacgtgtccactcaactggaatttatttctaggaagaaaatgagcgacctgtgggctggcagtggaggttttttttttttttttttttttttaatgatgctgctgtttcttaaaatgggctttgagttttttgtgttattctatccaggagagctcatgaaggaccctgtcagtgtggggggcatccaaaacacattaaggccagattcctagagaaagctgttttgccgaaacaaaaatgatgtctggtggcatcacaggctttctttaatccacttgggctcagtcgtaatggcaaagctaatgaacacagagggatatttgcaggataaaagcaattagaacaattatgagggtaattaactggcccaacacactcgtcaacacatctagcaggaccgccagaatctgagactccaaaacccaaggtttttcttttctgttgattccaaaatcctggatggatttcctgctaaaagattgcattggccgggcccattcgctcacacctgtaatcccagcacttcgggaggccgaggcgggcaaaccatgaggtcaggagtccaagaccagcctggccaacatggtgaaaccctgtctctactaaaaatacagagcttagctgtgcatggtggcacgtccccataatcccagctactcgggaggctgaggcaggagaattgcttgaaccgggacccaggaggcggaggttgcagtgagctgagatcatgccactgcactccagcctgggctacagagcaagactccgtctcaaaaaaaaaaaaaaaaaaaaaaaaaagactgcattgcaggatgagatgtcttaaaaaaaaaaaagtagctgtaatctctcatggaactatacaaccttagaaacatatgataaggaagcaggatgttgaaggaatacagggaaagatggtctctacaggtcctactgagtctagcagggatggttcaggagagatgtatagatatgatgtatgagtttactattgctgctgttatggtttggctctgtgtccccatccaaatctcacgttgaattgtaattcccagcgttgagggagggacctggtgggaggtgattggatcatggtggcggatttcccccttgctgttctcatgatagtgagtgagttctcacgaggtctgacagtttagaagtgtgtggcattccccccttgctctctcttcatccatcaccaccgagcattcatgctgcacacgtaaactcaaagactcaaggtcgccatgtgctatggtttcaatgtctgtgtcctctcgaaatccccattttttggttattgttttgttttgtttttgcttttgcttttttgttttgttttgttttttgagacggagtctcacacagtcgccaggctggagtgcagtggtgtgatctcggctcactgcaacctccgcctccgaggttcaagcgattctcctgcctcagcttcctgagtagcttgggattacaggtgtgcaccaccacacccggctaatttttgtatttttagtagagacagggtttcaccatgttggccaggctggcctcgaactcctgacctcaggtgatccgcctgcctcagcctcctaaagtgctgggattacaggcgtgagccaccacacccggccccagatccctgtcttgagacataacctacaaggtgatagtgttaagaggtggagccctttaagacgtgatgaggtcatgagggtggggcctcaggaatgagatgagtgtccttctaaaagggaccccagagagctccctcgacccttctgccacgtgatgacaagagtgagaaggcaccgtctgtgaaccaggaagcaggtcctcaccagacactgaacgtggcatgctttgatcttggacttctagcctccagaagtgtgagcctgaccaacagggagaaaccccgtctatactaaaaatacaaaattagctgggcatggtggcgcatgcctgtaatcccagctactcaggaggctgaggcaggagaatcgcttgaacccagagggcagaggttgtggtgagccgagatcacaccattgcactccagcctgggcaacaagagggaaactctgcctcaaaaaaataaaaatgaaaaaaataaagaggcaaaagagccagaagcaaaatgtgcatccgcctatttcccctgagggcacgtacgttccctaagagcgacaggtagagtgactaaaagcacctttgttccaacagtggcaggctgtagcatccccgttctcaggaagccacaaccaaaaaaaaaaaaaaaaaaaaaaagccagcaacacacatgaggtgagaaggattttcctgaaaacttccagcctgacaggtgcatgattattttaaaagcagagcctagatgtgcaaatctgcaggaggggtaacatgaaactaaaacatggcattgtttgcaagctacatggcttcgtaggagagtctgctgtatggggggccatggcttgcatggctgacagcatcacttctcctgcatagtgcaaaacatggacaagaagatgcctgaagaggtcctgtgggcctgcctagactcatctggcttaattacaatattcagaaatgcaacacctactctctggagaagtattccattccctctttctgggctcccacaagcacagtctttgcttggctgagccaagggagctgacagcagaatccctgagtcttcggatattagggctgttgttagctatggaaggagggcagagttgagggtgtcagacttggccaacctacccaccagaaggaggacatgcaagccacagagacttgggaggaaggacacagaacagtccacagatagtcaagtagagcaagattgtttcaggaaaaggggttggttctttcacagaatccatgaacagcaatcattaccattttcataatcatcactatcaccaccatcaccaacatcatagccaccaccatcatcattaccatcatcaccatcaccaccatcatcactaccatcatcaccatcatcatcatcaccatcaccatcatcatcatcaccatcaccatcatcatcaccatcatcaccatcaccatcatcaccaccatcatcaccatcatcaccatcaccatcatcaccaccatcatcaccatcatcatcaccatcaccatcatcaccatcatcaccatcaccatcatcaccaccatcatcaccatcatcatcgccatcatcatcactatcatcatcatcatcatcaccatcaccatcatcaccatcatcatcaccatcaccgtcatcaccaccatcatcaccatcatcatcgccatcatcattatcaccatcatcatcactatcatcatcatcatcaccaccatcaccatcatcaccatcattagcagcagcagcagcatgaccatcatcaccatcattatcatttctatcatcaccatcaccatcatcaccatcatcagcagcatcatcaccatcaccaacatcattatcatttctattaccaccactatcaccatcatcatcatcaccaccatcaccatcatcagcagcagcagcatcaccaccatcaccatcatcattatttctatcaccaccaccattgtcatcaccatcatgaccatcatcatcactgaccatcatcatcatcacatgaccatgaccatcactatcaccatcctcatcaccatcatcattatcatttctatcaccccatcatcatcaccatcagcatcagcatcatcaacaccaatattttcatcatcactatcatcaccatcataaacaccatcatcaccatcaccatcatcattatcacatcagcagcagcagcataatcattatcatcaccatcatcaccatcgtcatgatcatcaccatcatcatcatcatcaccatcatcacagtcattactatatcaccatcaccataattatcaccatcatcaccattaccactgtcatcatcattgccatcatcactaccaccatcatcacaaccatcatcaccatcagaatcaccattatcatcaacatcatcattgtggcagctgtcattcatgagatcccacaatgcacaaaatattttcctgtattttattcctttggccagtactttttatatcccagtgatgttccatggaccatcatggggctggggaaatcagtgacacaattaaacaaccaacgatacaatgtgtgaggttggcgatagaagggattaagtgtcccaagggagcagggagttgtaaggcacctggcttcaggacaactgctttacagcatgctataaaagctgagaagactagcatgaaagggacttggatggtcaggaggcagaggaggggaagaattctcaagaaccaggaaccacatgtgcacagctacagcaaacaggtggaggcatgaagggcattctgcccatatgggtttaagcaggttaagacaacagtgtgactcagcaggatctctctgactgcagtgtagacagttcagggagggaaacctggaagccgagagactagccaggaagcagagttatgaagcaggtaagggataggtgtgacctgctgtagggagtgataccgaaaatgacggagtgtttttgataagcatgtaggtggtctacagagctctcagttgccaccagggagaggaatgccaaggtggagaaaagcatctcagacactctaggatcgactgtaggcagctgagaggatggtagtccactgacttacacagagagaaggaaaatgtcaaatacattcctgcacttgctgtggaagcagggaggtgtaggaggcaggagtttggaaacaaatatattggtgagaactagcagagcagagttttggagaacacggacgtggttgcaagacctaaggaaaggtgtgtagtgtgagatgctacgaggaaacgctgaggaaaggcagcataaaagaaacagtcaagaaagaagccacacaggagggtaggtcttggagaaagcaaacccagagggtggaacctcatgagaggatggaattgaatctttcaagacagctgttaaaggacactttttaagagtgtttatcataattttgctcactcagataagtggatgattatttaattcctcactccagctggactataaattccacacaggcaagaagcaagcttatttggttgtatttaaaattgaacaatgggatcacgtggacacaggaaggggaacatcacactctgcggactgttgtggggtggggggaggggggggatggcattgggagatatacctaatgctggatgaccagttggtgggtgcagcacaccggcatggcacatgtatacgtatgtaactaacctgcacaatgtgcacatgtaccctaaaacttaaagtataataataaaaaataaataaatttaaaaaaaaaaagaaaaaaaaatatatatatatacatttgctgcgcacctgtagtcccagctgctcgggaggctgaggcaggagaatcgcttgagcctggaaggcggaggttgtagtgagccaagattgtgccactgcactccagcctggcgacagagtgagactccatctcaaatatatatgtgtgtgtgtgtgtgtgtgtgtgtgtatgtgtatatatatgtgtgtgtgtgtatacatacatacacacatccaacaagtaccatcattaccatcaccatcatcaccatcatcatcatttagggaaaggaacacaaatgtgacactggaaattcacatttgaatttggaaattcatccatgaatcagccagagggctatggtggtggctagtgatggtcatggttgctttaaaagatgcatgctttattgtggtttatgagagaaccaccaagaatggaaagaatgtagcacacagaccgtaattctcattccatagccacagcaggcatcactaattgatgactattccttgctgcaggatcattcttatctcagggtgctggcagccagaaccaatcaatcagccttaggagggaaaatccacttgccatccattcaatttgtgattcgggtgtagagcatctcctgcattccggctgctgttatgagattaattccttcagaggtttactaattaatggatgttgaattatcccaaatgcttccctgttacctaatgagaagcatcctttggtctacaggtggatgagttgcaactaagtcaggagtaattttttttttaacctggaagtctattcagtggataagattaaactagattttctttatttaggttggtaagtagaaccagccgatgatgcttctttgaaaagtgttcatttgggagtaaaacggtttactcagacacaggttggtggctctggtcactttgaagagtacagccagtagatttttggata

SEQ ID NO: 2545 - DNA, 23475 bp, Homo sapiens
attacaggcgcccaccaccatatgccactaatttttgtatttttagtagagatggggtttcaccatgttggccagactggcctcgaaatcctgacctcgtgatccgcccaccacagcctcccaaagtgctaggattgccggcataagccaccatgcctggccaggtctgccttataagtgatatgagcataggtggaggagttgaacactggagaaggatggatcaataactccacccaaccacaggtgctcccatttctgggtgtctaatcccaacccttgagatcatgccgccattttatcaccgttctatggtatcatgccgccattttatcaccgttctatggtatcatgccgccattttatcaccgttctatggtatcatgcctccattttatcaccgttctatggtatcatgccgccattttatcaccgttctatgatatcatgccgccattttatcaccgttctatggtatcatgccaccattttatcaccgttctatggtatcatgccattttatcaccgttctatggtatcatgccgccattttatcaccgttctatgatatcatgccgccattttatcaccgttctatggtatcatgccgccattttatcaccgttctatggtatcatgccattttatcaccgttctatggtatcatgccgccattttatcaccgttctatggtatcatgccgccattttatcaccgttctatggtatcatgccgccattttatcaccgttctatggtatcatgccgccattttatcaccgttctatggtatcatgccattttatcacctttctatggtatcatgctgccattttatcaccgttctatggtatcatgccattttatcaccgttctatggtatcatgcctccattttatcactgttctatatcatgcctccattttatcactgttctatggtgtcatgccgccattttatcactgttctatggtatcatgccgccattttatcactgttctatggtaacatgcctccattttatcactgttctatggtatcatgccgccattttatcaccgttctatggtatcatgcctccattttatcaccgttctatgatatcatgccgccattttatcactgttctatggtatcatgctgccatttcatcactgttctatggtatcatgcctccattttatcactgttctatggtatcatgccgccattttatcaccgttctatggtatcatgctgccattttatcaccgttctatggtatcatgcctccattttatcaccgttctatggtatcatgcttccattttatcaccgttctatgatatcatgctgccattttatcaccgttctatggtatcatgctgccatttcatcactgttctacgaataataacacatcagcatcgaaggagatgagggaacatgcatgatggagctgtgggagaagaatccccgccacaaaaccggcccaggatcctgggcacagagatatttccacactcaacacacagggactgaggtgaaaggagacggctgggtgggatggaggagataagggaggagacccctgatccacacagcacagccatgtttggaggggaatcataatgctacgtaggatgtctaagctctcctcaagatgcgaggctgggagtccctttccagagcctcagagagcatactggtcttaggtccaggttactgccattgaatggtagtaggcacatccccacagaactgggctggcatctgtagggatctacatcagtggttttccattggaggcctttttgtttccccctcccccaggaacatatagaaatgtctggaggtatttttggttgttataactgcggtggggggtatagtgggtacatccatgtcaagtgggtggagcccagggatcctgctcaacacgctacagtccacagcatggcctcaccacagagaatcatccagctccagatggacatactgccaaggttgacaaagcctgccttagcatgacagattgtatgcatatgtgatccatttgtctgtgtgcctatcatccaactcacttcctatcatctatcacctaccatttatctatcaactatttatagaatatctatcgacctatttaccacctatcacctacttatctaccgtctatcatttatctatttaccatttacaatcaagcatctacttatctatctaccatcatttatctatttaccatttatcatctatcatctacttatctaccatcatttatctatttaccatttattatctatcaagtacatatttatctatcatttatctatctttgatcattatatagcatctgtttactctctatctactgtctatcatctacctatcatctattgaccatcgatcatttatctacctgtcatctattacctatcattgatcacaatctatcattgaccattactatctatctagctattatctatctagctattttctgtctaactaatatctatctatgtatccatcatctatctatatcacagtggttttcaactgagcaaaatttcgcctcctcagggacaactggcatatctatctatctatctatctgtctgtcatttcctcatttatgaaattggggtaataacaatgcctgcctcaaaaattgacaaatgagatctcattaaactaaagagcttctgcacagcaaaagaaactatcatcagagcaaacaggtaacctacagaatgggagaaaatttttgcaatctattcatctgacaaaggtctaatgtccagaatctacaaggaacttaaataaattctcctgcctcagcctccctggtagctgtgactacaggcagccaccaccacgcctggctgatttttgtatttttagtagaggcagggtttcaccatgttggccaggctggtctcgaactcctgaccacaaatgatccacccatctcggcctcccaaagtgctgggattacaggtgtgagccaccgtgcctggccaggttttggcctttttgatgccactttgctttgacctttacttctttctcctgtatgcctagagagttcatcctaagagcttgtcctcatatcacctcccagaatatgcaaacttacaatctctttacttcttaaaattttaccttggggctaccaagctctgaagatggaagtgagatttcctcaaaatacacagaaatgggtaaatcctcacatgctttcacaggtatgcagtctttaacctgaggtagctcagggatacctatggctcccaggatactccaccatagcaaagggtgactgcctttggtgagccttgggtggatactagagctctgtgaacaccggggcctgtcgggaggtggggggcaaggggagggagagcattaggacaaatacctaatgcatgctgggcttaaaacctagatgacgggttgataggtgtagcaaaccaccatggcacatgtatacatatgaactagttctaggaacagttcactgaacactagcgttctatgaaccccctctccctgcctgaaatgaatgctgtcttcacatgacatcctaccctctgcccaatgtctttcccgaatgggaatctcttcaccacacggccaatttatcacaaacccttctctaaacccttacaataggcaggaaactgctcatacccctacgacggctgatggcagaggataaaatattaattctaagaaaataggccgggtgtggtggcacacacctttaatcccagcactttgggaggccgaggcaggtggatcatctgaggtcaggaatttgagaccagcctggccaacctagtaaaaccccatctctactaaaaatacaaaactagccaggagtggttgggcatggctgtaatcccagctactcgggaggctgacacagaagaattacttgaacccagaggtggaggctacggtgagccgagaccacgccactgcactccagcctgggcaacaagagcgaaactcagtctcaaaaaaaaaaagaaaagaaaagaaaaagaaaatagttcaggtaattcttggaaattgtatttttataccctctaatatttaaatgaccatcaatatacaaccagggtagggggttaataaataaaggatagcattctttgctgcatcctgggcttatttttctcattctttttctgtgacactgtctcattccatcagccaggctgaagagcagtggagcagtcacagctcactgcagcctccacctcctgggctcaagcaatcctcctgcctcagcatcttgagagggagaccagaagcatatgccatcatacccggataattttttttttttttcctgtagagacgagatcttgctatgttgcccaggctagtctcaaattcctgggctcaagtgatgctcccgccttggcctcccaaaagtgctgggattacaggcaggagccaccatggatcattcgtgtgtacaatattctcactcctttgcaccggaataaaacccagccccctggaaagctgactctgagactttgtgaggatgtgtatgtgcggtttctcatctgaatgcagccatttcacgaacaccagccattccccaggcttcagttaagccattccccatcaggaagatatagggccccctttcaagaggaaccacaatggctaaaactacaatcttcacagcacacatggcttcagcaaatacagagagatgctagccgggcgcagtggctcacacctataatcccagcactttgggaggctgaggtgggcggatcacaaagtcaggagttcaagaccagcctgaccaacatggtgaaatcccgtctctactaaaaatacaaaaattagccacgcgtggtggtaggtgcctgtaatcccagcaactcaggaggctgaggcaagagaatcgcttgaacctgggaggcagaggatgcagtgagccaagcttgtgccactgcactccagcctgggagatagagcaagactgtctcaaaaaaaaaaagaaaaaagaaaaaaaaaaaagaacgatgctacattctcagaaaattagttttacattgaagcttcatttgggaattgaaaataagaacagggaaatacatttttcttttctagagaaaataaacaaggacaaagatgcatggaaaataatattttaaatgtctcctattgacctaagttataaagtcattttttatgtaataacaaaataattggagaggcgtacccaagagcacaatagtctctgaaatgtcttatttcatgtacactcaggcacacaaagacacatacataatttataactaatttagcaaaacattatgatttgatacaactggatggtgggtacacaaatgctgttcaaattattctctgcgtctttcaaatgtgtgaaatgttttataatgaaacatttttagaaggcacattgaagttcaaacaactgctaaacaatgaaaaagataaatggttgtattcaaatgcttacgggtatttactcattaagaatattttgaggccaggcacggaggctcacacctgtaatcccagcactttgggaggccgaggagggtggatcacttgaggtcaggagttcaagaccagcctggccaacatgtcaaaaccccatctctactaaaaatacaaaaattagccgggcgtggtgccgtgtgcctgtaatcccagctactcaggaggctgaggcaggagaatcacttgaacctgggaggcagaggttgcagtgagccaagattgtggcactgaactccagcctgggcaacagaataagactctgtctcaaaaaaaaaaaaaagaaaaaaggtctcctattgacccatgttataaagtcattttttatgtaataacaaaataattggagaggggtacccaagtcacatacgtaatttataactaatttggcaaaacattacgatttgatacaactggatggtgggtacacaaatgctgttcaaattattctctgcgtctttcaaatgtgtgaaatgttttataatgaaacatttttatgaggcacattgaagttcaaacaattgctaaacaacaaaaaacataaatggttgtattcaaatgcttacgggtatttactcattaagaatattttgaggccaggcgcggaagctcacgcctgtaatcccagcagtttgggaggccaaggagggcggatcacttgaggtcaggagttcaagaccagcctggccaacatgtcaaaaccccgtctctactaaaaatacaaaaattagccaggcatggtgacaggtgcctgtaatcccagctactcaggaggctgaggcaggagaatcacttgaacctgggaggcggaggttgcagtgagccaagattgtgccactgaactccagcctgggcaacagaacaagactctgtctcaaaaaaataaataacccgggaggtggagcttgcagtgagccgagatcgcaccactgcactccagcctgggcgaaagagcaagactccatctcaaataaataaataaaagtaaataagtaaataaaaaagaatattttgaaactacacattgccttctgtgtaaattaaaagccaatgaaagcctcctgattttcagggtgtctcatttctaccctatagaagcaaacctaccacacccttcactgaggagccttcgtgaccctaccaagggggaaagagcttgtcttttcaatgagtttaagagctttgcttctgcggttgaaacttccccccagccagcatttcatgttgagagacagtggctaagctgatgtggaaataacacaagaaatcttgtctgaagatgggtgataccaacatcagaactggagacagcaggtactgtgattcaggcgaaactctcaccactaattggtggagagaagaaaagaaaatgagcaaatgaactctgattttgaagaacttcattgaatcaggcttatcttgatgtcttgtgagtcaacaagatgcagctggactagatgtgtgtgtggagtattcgtgaggggctaagggactctcctatgtgtttagtttttgtttttttttgtttgtttttctttttggagacagagtctcgccctgtcacccaggctggagtgcagtggcacgatctcagctcactgcaacctccatctcccaggttcaaacgattcccctgcctcagcctcctaagtagctgggactacaggctcacaccaccaaaattagccggggctaattttttctatttttagtagagacggggtttcaccatgttggccaggctggtctcgaacacctgacctcaagtaatccacccacttcggcctccccaagtgctgggattacaggcctaagccacagcacccagccccagctattttttgtattttagtagagacgggtttcaccatgttggtcaggctggtctcaaactcctgacatcaagtgatctgcccgccttagccttccaaagtgctgggattacaggcatgagcccctgtgcccggcccggactcccctactgaaatgtgcatgacagagaccccaaggctgtcttttccagcaggagctccgggttcatgactgaggatagatgcttcccaacctgctcctcactctccaaagagcttgcaagtgggcacagatgaaccaagctcaccttcctgacaatgacacctgcagatggcacaccatgagttttgtctacaaatgcaccattcccccagtttgaggagtcccagttcgtctttttttttgaaacagagtctcactctgtctcccaggctggagtgcagtggcgcaatctcggctcactgcaacctccgcctcctgggttcaagcgattctcctgcctcagcctccccagtagctgggattacaggcacccgccaccatgcccggctaatttttgtagttttagtagagatggggtttcaccatgttggtcaggctggtctcaaagtcctgacctcaggtgatccacccgcctcggcatcccaaagtgctgggatgacagtctgagccaccgcgcccagctgagggctttgtattttacggagacacaatcagtccatcattccacacaactgtgctgttgggaatctgtgaaggttaagaattccccactgcctttgtcttccagaaaatggttttactgaaaaaaaaaaaaaaaaaattcccttcctcattactcacagatgcttccaagtcagcctaggacaaggctggccacatcctccaaattcacattctttatttgccccttcagggatggactgaattcctcgtcttccttgacctgaacaaaattcccatctaacgtgatcacattttggttgggtttctctcctcctatcaggccccgggatgttgggccagcctcacctggagcaaacgtcagaggatcaagcaacgcttccttaggacctgctcaaaattagctatgcagccacagggtttggcagcttttatccatgactgaaccccacatcgaacgaccccaatcacggttgttccgagcatcacgtgcctgtccctagaaaagaaaatggtatgctgcctgcgctccaagaggctcccagatgtcactgctcgggtgtgcttcatggtgctataggcagcgtccaccagtggttgcattagtccctcctcctcttgttacaatagttcctcccctattaccataatccctccccgccattaccatagtcccccctcctccattaccgtagtccctccttccgttaccatagaccctcctccgttaccacagtcccttctcccgttaccgtagtccctccccattaccatagtccctcctccattaccatagacccttctacttctgttaccatagtccctcctccattaccatagaccctcctcccgttactatagtccctccttccgttaccatagtccctcctcccattactatagaccctccgttaccacagtccccccttctcacattaccatagtccctccttctgttaccacagaccctcctttcgttactatagtccctcctcgttaccatagaccctcctcctcccgttaccgtagaccctccccgttaccacagcccctcctccgttaccatagtccgtccttctgttaccatagtccctccttccattaccatagtacctcctcccattagcagagtccctccttctgttaccagtccttcctcctcccgttaccatagtccacactcctccccttaccatagtccctcctcctcccattatcaccgcccctcctcctcccattatcacagcccctcctcctcccattatcacagcccctcctcctcccattacagtagtccctcctcctcttattgcaaaagctcccatctgtgggaatgatcttttcaaatgaaactgttgctacctgtgtatctggtgtctctgtcaccatcatgggacatccctgaaaggtgtacctcactgctgcagagtagcactctctgcaggaaagtccatatcttccctgccccagacaactgtgctgtccacagctggacactgggcgcttgccagacagttagtgcaatgaggcactgagtttttcttttcccttaattatcacttatttaattttcgcgcatcacacgtgacccctgacccctgttctgggcaccatcgtcggagaaattttcttgaggctcgggtttcttctttctttgctacaaactcccagggctacttactaaggtgaagaaaacacactgttatgtaatccattatacagtcaacgtatccttaccagaaccagaaaaattcacaattttaatggtgaatcgggttgggaaatccatgcttctagttttgaggcgaaatacatgactgataaaacccttttgtattatacaagggaaccggagtggatggagttttgctatagatctcccagacgcgccccacagctccatgattgacagcgtgagtgtgtctatcacacgaaccgctgggggaaggcaggcagttgtgtcaaattggaaccgaatcacaaatgaaacataaattccaggatcccgttgagtataaaaacccaggacccaacaagggcaaacgtaagcagcgaagccccagagaccccctagagcatccagcatgttggggttttaggtttgaaagggagaggttggtatttcttttcttttccttctttgtttttttttttttgagacggagttttcctcttgttgcccaggctggagtgcaatggcgcaacctcggctcactgcaacctccgcctcccgggttcaagcgatgctcctgcctcagcctcccgagtagctgggattacaggcacccgccaccctgcccggctaattttttgtatttttagtagagagacggggtttcatcatgttggcgaggctggtctcgaacccctaacctcaggtgatccgccggtctcggcctcccaaagtgctgggattacaggcgtcagccaccgcgcctggctgggggttggtatttcttgtggctcataaaccgcggctctactttgcatctgtattagttcattctcacgctgctgatagacatacccgagacggggtaatttataaagaaaaagagctttaatggactcacagttccacggggttggggaggcctcacaatcacgacggaagacgaaaaccatatcttccacggcggcaggcaaaatggctcctgtaggggaacttccatttataaaacatcagatctcgtgagaacacactcactaccacgagaacagtatgcgggtcaccgcgcccatgattcaatttcctccacctggccccacccttcacaggtgggaatcattacaattccaggtgccatgtgggtggggacacagccatcccatcgttacagagattgttgcaagtttgccagaatcctcacactcttttcagaggagacctttcaaaagaaacatcatctagggaagctatgctgtgttctgaggcgaggctggaatttcaaaaccagcttttccactaaaacacctgctccatttcctctggggcctccattctccccacgccagaattagggggtctctagtcccccagctctaatgctttccaagcaggataaccctctacatcccatggaaaccacggctgctgcaaggaagagctgagggactgcagtgccgctgaaccgagtcaccctggagttataaattatcaggttggagaaaaggggaaggggttgttgtatctggagctgaagttttcagggctgagctgccaacgtgtgatacttcaagggcccctgcgtacctgacgcggtgtggacagttcgcacccacatagagtttgcaagccaacaggaaacctaggcaggcttcctggaggaggcatcatccggccaggaaatagaggtgagatgttgacagcaggagatggtgagaaaggaacccaggaggagggttatccaaaatagggcacacaggtgagagagtgggggaagaggaagccacaggaaggaagaaaaaaggtcaatgatattgtgacgtaaagtaagttcctgtagcatcttagcatagcaagtttgagaaacagtcgtgcatggaatgaggacaaaaaaagacctctgcacctgcacacctgccctctactcacctgtccagcccaggcaatggcctaccaccctcatgtgattagtattgttctaaagaaatggagtctcactatgttgcccagtctgatctcaaactcctgggctcatatgatccttctgtctcagcctctggaattgctgggactacacaggcatgccaccgtgcctggctgatttggattcttgacagaagagttggctctgaaataccaacatgtggttctgtttaaaaacaaaggcttctcaaaacagaccacagtgaggccaggctcagggctgtaatcccagcactttgggaggccgtggtgggaagattccttgagctcaggagttcaagaccacccagggcaacatagtgagaccccatccaaaaaataaaaatagctgggtgagcagccgggcacagtgactcacgcctgtaatcccagcactttgggaggccgaggcaggcaaatcacctgaggtcgggagttcgaggccagcctgaccaacatggagaaaccccatctctactaaaaatacaaaaattagccaggcatagtggtacatgcctgtaatcccagctacttgggaggctaaggcaggagaattgctggaacccgggaggcggaggttgcagtgagccgagatcacgccattgcactctagcccgggtgacaacagcgagactccatctcaaaaaaaccaaaaaacaaaaaacgaaaaacaaagtcttctcgaaacagaccacagcaaggccaggttcagtcctgtaatcccagcactttgggaggccgtggtggaaggatcccttgagccctggagttcaagaccacccagggcaagatagtgagaccctgtctctataaaaaataaaaatagctgggtgttggtggcatgtatgtgtagtctcagctacataggaggctgaggtgggaggatcgcttgagtccaagaggtagaggctgcagtgagccagatagcaccactacactccagcctgggcaacagagcaagaacctgcctctaaaacagaaacataaataaacaaaaatgaaaataaactatcctgcattcttcagacaacactgtgactacaggacaagcggtcacgctgtcatggaaggatggagcccatctcaaagggaatttctggagtgcagaaagcaaccacatcaggtgggaatacgccctcccagtcagcaggtgcgttctcaaatctccagcgggtaattagtgcacatcacacaatgaatgagcttccgataagtgaaagtatggtatgcacaccgcggctgtgaaatgcggttcgttcttggatatcatgggcagcattgaaaacttaaacctttttcttcttgtggaaaaggctggggcttgtcatcactgtctcctcccttcccctcgcagtttatatttagctgggcacacgccgtgtggatgcccgttttcttcctcctaggggagaatcctcagctacagggttgttttggtttccttgtgtgtttgtttcttgatttattctctcttgagtcagcaagagaacggctcgatgggatggttggttggttggtcggttggttggttggttggctggttggttggtttttgagacagagtctcactctgtcgccaagctggagggcagtagtgcgatctcggctcactgcaacgtccgcctcctaggttcaagtgattctcctgcctcagcctcctcagtagctacgactacaggcgtgcacccccacgcctggctaatttttgtatttttagtagagacggggtttcaccatgttggccaagctggtctcgatctcctgacctcgtgatccacctgcctcggcctcccaaagtgctgggatgacaggctggagccactgcacccggccggctcagtgggttttaggagcatcccagcattccccggacacaaaatgtgcctctctgtgatttttactaactcgcctggagtcaccaatgttgttgccatattttgaccaaaacagtaataaaaggggcaattttcctaggggctcttgttctggtagaagaacaacttcccgctgcctgcattgcaggtgcctctgactcaggaggaaacgcagaatttggcgaacacgtgaagtcttttttcgctaaatctaaattctacagggtggctggggccaattgcagtacggatctgaggcattgtagatggcaagagtgcatgtgtgcgtgtgtgtatgtgtctgagtgtgcatgtatgtctacacttgccataaacgaaagcacaaaagggaaatgtcagaaagaaaccagcaaaggaagccagcatcattcacaatgctggtgtctgttacccacagaggatgacatcgtcattcaggtggccatgaagaaaggctttgaatgacactcccagaacaagagcctggagatctaacatccactctgattctgcccctagccttgggtgacgtgggtttaactgtgacctcaccaagatgtgtccacccagaacctaggaatgaaagctcacttggatatcagatctttgcatacaattaggttgcactagagtagtgtcattgcatacaactaggttgtcattgcatacaattaggttgcattagagtagtgtacgctgttaactgaataactggtgtccttataagaaaaggaacattggaggccgggtatagtggctcacgcctgtcatcccagcactttgggaggctgaggcaggcagatcttgaggtcaggagactgagaccatcctgcccaacatggtgaaaccctgtctctactaaaaatacaaaaattagccgggcacggtggtgcacacctgtagtcccagctactcaggaggctaaggcaggagaatcacttgaacccgggaggcagaagttgcagtgagccgagatcacaccactgcactccagcctgggtgacaagagcaaaaactctatctcaaaaaaaaaaaaggagaagaggaacactgtggcatagagacacagagatggccacgacaaaggcagatactgtattgatgcttctacaccagccgtccccagcctttctggcacagagactagtttcatggaacacaatttttccacacacacacaaaaactgtcttcatagaaagacagtcactgtgagtgcagggggaaggatctggggatgatttgagcgtatgacatttattgtgcactttatttctatgatgatacgttaaatgaagtaattctacaatacaactcattgccatgtagactcagtgggagccccaaacttgttttcctgcaactagatggtcccatccggggggtgatgggagacagtggcagatcatcaggcattagattctcataagaagcatgcaacccagatccctggtctgcccacttcccaatagggttctcaatcttctgataatctaatgccactgctgatctgacaggaggtgacctcaggcggtaatgcgtgcagtgggaagtggctgtgaacacacatgaagctttgctcagtaccagtccacagccagggggttggagtcctctgttctacaggacaagaaacaaccaggattgctagctagcgaaggaagccagaagagatagcggaggatcctcctccagagcctccgcaaggggcacagccctgccttaatactccagaatgaaatgcatttcataattgcagtgtgcacacaatactttttttttttttttgagacagagtcttgctctgtcgccaggctggagtgcagtggcatgatctcagctcactgcaacctccgcctcccgggttcaagtgattctcctgcctcagcctcctgagtagctgggactacaggtgcgtgccaccacacccggctaattttttgtatgtttagtagagatggagtttcaccatgttggccaggatggcctcgatctcttgacctcgtgatccgcctgcctcggcctcccaaagtgctgggataacaggcatgagccactgcgcccggccgtgtgcacacaatacttcaacttactgaacgcttattctttgtgtctggtgcaatagtgacctgctggagatttgcaaatatacttagtgactggaaggttgtatttccacccggatgtgttggctttctgctccaggaatgtcctttgacacgggctctgcccttggatgaccaggtggtcagcctgccttggctgtggacttctggtgttcagagctgtcagagatttgacttctgtggctttcagccagctggtttgtagaattgtgtcgcagcagctccaggaaactaaaatattgagcctcccctatgacagtggacccttgaacaccacgggcttgaattgaatgggtgtccccttatatgtggattttcttctgcctctgccacccgagacacccccttctcttcctcctcctcctcaacgtcaagatgacgaggatgaagacatttatcatgagccacttccacctgataaacagtaaagatattttctcatccttacgattttcttaaggaaaatcacagcttactttattgtaagaatataatatagaatatttactatatttttctctaggttacttcattgtaagaatatagtatataatacatactatatttttttctcttgattaattttttttttgagacagagttgtgctcttgtcacccaggctggagtgcagtggtgcgatctcggctcactgcaacctccacctcccaggttcaagtgattctcctacctcagccccccgagtagctgggattgcaggtgcgcaccaccacgcctggctacttttttgtatttttagtacagacggggtagccccatgatggtcaggctggtcacgaactcccaacctcaggtgattcgcctgcctcaacctcccaaagtgttaggattacaggcgtgagccaccgcgcccggcctttggcttactttattgtaagaatattactatattatttgtgtctggtgcaataatgacctgcctcatgatctgtcactgtctcccattacccctagatgggaccgtctagttgcaggaaaggcttccagccaacagcaagctattagttaagttttgggggagtgaagagttacacaaggtcttcacgtgcccctaaccctcacgtggcttcagagtcccctgtaaatgaatgtgtggcaagcaaagaaagaagaacatgaagaaaagagggagaggaataccctaccactacacaagaccatatatcaccaacaccattaattcttccttctacatgataagccggcaaagtccctgtccttgataactgtgccaatgacgtctgattcccagtagatggatgatgactaattagtcctacatggcaaacaaacgaagggttaattaatctgagcctgcctgagttatctgtgaatgaggatagcccagtcacttgacaatcattttaaacaggtcaacggatgatcaatcacgactgaaattcccccgtaaaagacgtgtccactcaactggaatttatttctaggaagaaaatgagcgacctgtgggctggcagtggaggttttttttttttttttttttttttaatgatgctgctgtttcttaaaatgggctttgagttttttgtgttattctatccaggagagctcatgaaggaccctgtcagtgtggggggcatccaaaacacattaaggccagattcctagagaaagctgttttgccgaaacaaaaatgatgtctggtggcatcacaggctttctttaatccacttgggctcagtcgtaatggcaaagctaatgaacacagagggatatttgcaggataaaagcaattagaacaattatgagggtaattaactggcccaacacactcgtcaacacatctagcaggaccgccagaatctgagactccaaaacccaaggtttttcttttctgttgattccaaaatcctggatggatttcctgctaaaagattgcattggccgggcccattcgctcacacctgtaatcccagcacttcgggaggccgaggcgggcaaaccatgaggtcaggagtccaagaccagcctggccaacatggtgaaaccctgtctctactaaaaatacagagcttagctgtgcatggtggcacgtccccataatcccagctactcgggaggctgaggcaggagaattgcttgaaccgggacccaggaggcggaggttgcagtgagctgagatcatgccactgcactccagcctgggctacagagcaagactccgtctcaaaaaaaaaaaaaaaaaaaaaaaaaagactgcattgcaggatgagatgtcttaaaaaaaaaaaagtagctgtaatctctcatggaactatacaaccttagaaacatatgataaggaagcaggatgttgaaggaatacagggaaagatggtctctacaggtcctactgagtctagcagggatggttcaggagagatgtatagatatgatgtatgagtttactattgctgctgttatggtttggctctgtgtccccatccaaatctcacgttgaattgtaattcccagcgttgagggagggacctggtgggaggtgattggatcatggtggcggatttcccccttgctgttctcatgatagtgagtgagttctcacgaggtctgacagtttagaagtgtgtggcattccccccttgctctctcttcatccatcaccaccgagcattcatgctgcacacgtaaactcaaagactcaaggtcgccatgtgctatggtttcaatgtctgtgtcctctcgaaatccccattttttggttattgttttgttttgtttttgcttttgcttttttgttttgttttgttttttgagacggagtctcacacagtcgccaggctggagtgcagtggtgtgatctcggctcactgcaacctccgcctccgaggttcaagcgattctcctgcctcagcttcctgagtagcttgggattacaggtgtgcaccaccacacccggctaatttttgtatttttagtagagacagggtttcaccatgttggccaggctggcctcgaactcctgacctcaggtgatccgcctgcctcagcctcctaaagtgctgggattacaggcgtgagccaccacacccggccccagatccctgtcttgagacataacctacaaggtgatagtgttaagaggtggagccctttaagacgtgatgaggtcatgagggtggggcctcaggaatgagatgagtgtccttctaaaagggaccccagagagctccctcgacccttctgccacgtgatgacaagagtgagaaggcaccgtctgtgaaccaggaagcaggtcctcaccagacactgaacgtggcatgctttgatcttggacttctagcctccagaagtgtgagcctgaccaacagggagaaaccccgtctatactaaaaatacaaaattagctgggcatggtggcgcatgcctgtaatcccagctactcaggaggctgaggcaggagaatcgcttgaacccagagggcagaggttgtggtgagccgagatcacaccattgcactccagcctgggcaacaagagggaaactctgcctcaaaaaaataaaaatgaaaaaaataaagaggcaaaagagccagaagcaaaatgtgcatccgcctatttcccctgagggcacgtacgttccctaagagcgacaggtagagtgactaaaagcacctttgttccaacagtggcaggctgtagcatccccgttctcaggaagccacaaccaaaaaaaaaaaaaaaaaaaaaaagccagcaacacacatgaggtgagaaggattttcctgaaaacttccagcctgacaggtgcatgattattttaaaagcagagcctagatgtgcaaatctgcaggaggggtaacatgaaactaaaacatggcattgtttgcaagctacatggcttcgtaggagagtctgctgtatggggggccatggcttgcatggctgacagcatcacttctcctgcatagtgcaaaacatggacaagaagatgcctgaagaggtcctgtgggcctgcctagactcatctggcttaattacaatattcagaaatgcaacacctactctctggagaagtattccattccctctttctgggctcccacaagcacagtctttgcttggctgagccaagggagctgacagcagaatccctgagtcttcggatattagggctgttgttagctatggaaggagggcagagttgagggtgtcagacttggccaacctacccaccagaaggaggacatgcaagccacagagacttgggaggaaggacacagaacagtccacagatagtcaagtagagcaagattgtttcaggaaaaggggttggttctttcacagaatccatgaacagcaatcattaccattttcataatcatcactatcaccaccatcaccaacatcatagccaccaccatcatcattaccatcatcaccatcaccaccatcatcactaccatcatcaccatcatcatcatcaccatcaccatcatcatcatcaccatcaccatcatcatcaccatcatcaccatcaccatcatcaccaccatcatcaccatcatcaccatcaccatcatcaccaccatcatcaccatcatcatcaccatcaccatcatcaccatcatcaccatcaccatcatcaccaccatcatcaccatcatcatcgccatcatcatcactatcatcatcatcatcatcaccatcaccatcatcaccatcatcatcaccatcaccgtcatcaccaccatcatcaccatcatcatcgccatcatcattatcaccatcatcatcactatcatcatcatcatcaccaccatcaccatcatcaccatcattagcagcagcagcagcatgaccatcatcaccatcattatcatttctatcatcaccatcaccatcatcaccatcatcagcagcatcatcaccatcaccaacatcattatcatttctattaccaccactatcaccatcatcatcatcaccaccatcaccatcatcagcagcagcagcatcaccaccatcaccatcatcattatttctatcaccaccaccattgtcatcaccatcatgaccatcatcatcactgaccatcatcatcatcacatgaccatgaccatcactatcaccatcctcatcaccatcatcattatcatttctatcaccccatcatcatcaccatcagcatcagcatcatcaacaccaatattttcatcatcactatcatcaccatcataaacaccatcatcaccatcaccatcatcattatcacatcagcagcagcagcataatcattatcatcaccatcatcaccatcgtcatgatcatcaccatcatcatcatcatcaccatcatcacagtcattactatatcaccatcaccataattatcaccatcatcaccattaccactgtcatcatcattgccatcatcactaccaccatcatcacaaccatcatcaccatcagaatcaccattatcatcaacatcatcattgtggcagctgtcattcatgagatcccacaatgcacaaaatattttcctgtattttattcctttggccagtactttttatatcccagtgatgttccatggaccatcatggggctggggaaatcagtgacacaattaaacaaccaacgatacaatgtgtgaggttggcgatagaagggattaagtgtcccaagggagcagggagttgtaaggcacctggcttcaggacaactgctttacagcatgctataaaagctgagaagactagcatgaaagggacttggatggtcaggaggcagaggaggggaagaattctcaagaaccaggaaccacatgtgcacagctacagcaaacaggtggaggcatgaagggcattctgcccatatgggtttaagcaggttaagacaacagtgtgactcagcaggatctctctgactgcagtgtagacagttcagggagggaaacctggaagccgagagactagccaggaagcagagttatgaagcaggtaagggataggtgtgacctgctgtagggagtgataccgaaaatgacggagtgtttttgataagcatgtaggtggtctacagagctctcagttgccaccagggagaggaatgccaaggtggagaaaagcatctcagacactctaggatcgactgtaggcagctgagaggatggtagtccactgacttacacagagagaaggaaaatgtcaaatacattcctgcacttgctgtggaagcagggaggtgtaggaggcaggagtttggaaacaaatatattggtgagaactagcagagcagagttttggagaacacggacgtggttgcaagacctaaggaaaggtgtgtagtgtgagatgctacgaggaaacgctgaggaaaggcagcataaaagaaacagtcaagaaagaagccacacaggagggtaggtcttggagaaagcaaacccagagggtggaacctcatgagaggatggaattgaatctttcaagacagctgttaaaggacactttttaagagtgtttatcataattttgctcactcagataagtggatgattatttaattcctcactccagctggactataaattccacacaggcaagaagcaagcttatttggttgtatttaaaattgaacaatgggatcacgtggacacaggaaggggaacatcacactctgcggactgttgtggggtggggggaggggggggatggcattgggagatatacctaatgctggatgaccagttggtgggtgcagcacaccggcatggcacatgtatacgtatgtaactaacctgcacaatgtgcacatgtaccctaaaacttaaagtataataataaaaaataaataaatttaaaaaaaaaaagaaaaaaaaatatatatatatacatttgctgcgcacctgtagtcccagctgctcgggaggctgaggcaggagaatcgcttgagcctggaaggcggaggttgtagtgagccaagattgtgccactgcactccagcctggcgacagagtgagactccatctcaaatatatatgtgtgtgtgtgtgtgtgtgtgtgtgtatgtgtatatatatgtgtgtgtgtgtatacatacatacacacatccaacaagtaccatcattaccatcaccatcatcaccatcatcatcatttagggaaaggaacacaaatgtgacactggaaattcacatttgaatttggaaattcatccatgaatcagccagagggctatggtggtggctagtgatggtcatggttgctttaaaagatgcatgctttattgtggtttatgagagaaccaccaagaatggaaagaatgtagcacacagaccgtaattctcattccatagccacagcaggcatcactaattgatgactattccttgctgcaggatcattcttatctcagggtgctggcagccagaaccaatcaatcagccttaggagggaaaatccacttgccatccattcaatttgtgattcgggtgtagagcatctcctgcattccggctgctgttatgagattaattccttcagaggtttactaattaatggatgttgaattatcccaaatgcttccctgttacctaatgagaagcatcctttggtctacaggtggatgagttgcaactaagtcaggagtaattttttttttaacctggaagtctattcagtggataagattaaactagattttctttatttaggttggtaagtagaaccagccgatgatgcttctttgaaaagtgttcatttgggagtaaaacggtttactcagacacaggttggtggctctggtcactttgaagagtacagccagtagatttttggata

SEQ ID NO: 2546 - DNA, 4491 bp, Homo sapiens
tctcagctacataggaggctgaggtgggaggatcgcttgagtccaagaggtagaggctgcagtgagccagatagcaccactacactccagcctgggcaacagagcaagaacctgcctctaaaacagaaacataaataaacaaaaatgaaaataaactatcctgcattcttcagacaacactgtgactacaggacaagcggtcacgctgtcatggaaggatggagcccatctcaaagggaatttctggagtgcagaaagcaaccacatcaggtgggaatacgccctcccagtcagcaggtgcgttctcaaatctccagcgggtaattagtgcacatcacacaatgaatgagcttccgataagtgaaagtatggtatgcacaccgcggctgtgaaatgcggttcgttcttggatatcatgggcagcattgaaaacttaaacctttttcttcttgtggaaaaggctggggcttgtcatcactgtctcctcccttcccctcgcagtttatatttagctgggcacacgccgtgtggatgcccgttttcttcctcctaggggagaatcctcagctacagggttgttttggtttccttgtgtgtttgtttcttgatttattctctcttgagtcagcaagagaacggctcgatgggatggttggttggttggtcggttggttggttggttggctggttggttggtttttgagacagagtctcactctgtcgccaagctggagggcagtagtgcgatctcggctcactgcaacgtccgcctcctaggttcaagtgattctcctgcctcagcctcctcagtagctacgactacaggcgtgcacccccacgcctggctaatttttgtatttttagtagagacggggtttcaccatgttggccaagctggtctcgatctcctgacctcgtgatccacctgcctcggcctcccaaagtgctgggatgacaggctggagccactgcacccggccggctcagtgggttttaggagcatcccagcattccccggacacaaaatgtgcctctctgtgatttttactaactcgcctggagtcaccaatgttgttgccatattttgaccaaaacagtaataaaaggggcaattttcctaggggctcttgttctggtagaagaacaacttcccgctgcctgcattgcaggtgcctctgactcaggaggaaacgcagaatttggcgaacacgtgaagtcttttttcgctaaatctaaattctacagggtggctggggccaattgcagtacggatctgaggcattgtagatggcaagagtgcatgtgtgcgtgtgtgtatgtgtctgagtgtgcatgtatgtctacacttgccataaacgaaagcacaaaagggaaatgtcagaaagaaaccagcaaaggaagccagcatcattcacaatgctggtgtctgttacccacagaggatgacatcgtcattcaggtggccatgaagaaaggctttgaatgacactcccagaacaagagcctggagatctaacatccactctgattctgcccctagccttgggtgacgtgggtttaactgtgacctcaccaagatgtgtccacccagaacctaggaatgaaagctcacttggatatcagatctttgcatacaattaggttgcactagagtagtgtcattgcatacaactaggttgtcattgcatacaattaggttgcattagagtagtgtacgctgttaactgaataactggtgtccttataagaaaaggaacattggaggccgggtatagtggctcacgcctgtcatcccagcactttgggaggctgaggcaggcagatcttgaggtcaggagactgagaccatcctgcccaacatggtgaaaccctgtctctactaaaaatacaaaaattagccgggcacggtggtgcacacctgtagtcccagctactcaggaggctaaggcaggagaatcacttgaacccgggaggcagaagttgcagtgagccgagatcacaccactgcactccagcctgggtgacaagagcaaaaactctatctcaaaaaaaaaaaaggagaagaggaacactgtggcatagagacacagagatggccacgacaaaggcagatactgtattgatgcttctacaccagccgtccccagcctttctggcacagagactagtttcatggaacacaatttttccacacacacacaaaaactgtcttcatagaaagacagtcactgtgagtgcagggggaaggatctggggatgatttgagcgtatgacatttattgtgcactttatttctatgatgatacgttaaatgaagtaattctacaatacaactcattgccatgtagactcagtgggagccccaaacttgttttcctgcaactagatggtcccatccggggggtgatgggagacagtggcagatcatcaggcattagattctcataagaagcatgcaacccagatccctggtctgcccacttcccaatagggttctcaatcttctgataatctaatgccactgctgatctgacaggaggtgacctcaggcggtaatgcgtgcagtgggaagtggctgtgaacacacatgaagctttgctcagtaccagtccacagccagggggttggagtcctctgttctacaggacaagaaacaaccaggattgctagctagcgaaggaagccagaagagatagcggaggatcctcctccagagcctccgcaaggggcacagccctgccttaatactccagaatgaaatgcatttcataattgcagtgtgcacacaatactttttttttttttttgagacagagtcttgctctgtcgccaggctggagtgcagtggcatgatctcagctcactgcaacctccgcctcccgggttcaagtgattctcctgcctcagcctcctgagtagctgggactacaggtgcgtgccaccacacccggctaattttttgtatgtttagtagagatggagtttcaccatgttggccaggatggcctcgatctcttgacctcgtgatccgcctgcctcggcctcccaaagtgctgggataacaggcatgagccactgcgcccggccgtgtgcacacaatacttcaacttactgaacgcttattctttgtgtctggtgcaatagtgacctgctggagatttgcaaatatacttagtgactggaaggttgtatttccacccggatgtgttggctttctgctccaggaatgtcctttgacacgggctctgcccttggatgaccaggtggtcagcctgccttggctgtggacttctggtgttcagagctgtcagagatttgacttctgtggctttcagccagctggtttgtagaattgtgtcgcagcagctccaggaaactaaaatattgagcctcccctatgacagtggacccttgaacaccacgggcttgaattgaatgggtgtccccttatatgtggattttcttctgcctctgccacccgagacacccccttctcttcctcctcctcctcaacgtcaagatgacgaggatgaagacatttatcatgagccacttccacctgataaacagtaaagatattttctcatccttacgattttcttaaggaaaatcacagcttactttattgtaagaatataatatagaatatttactatatttttctctaggttacttcattgtaagaatatagtatataatacatactatatttttttctcttgattaattttttttttgagacagagttgtgctcttgtcacccaggctggagtgcagtggtgcgatctcggctcactgcaacctccacctcccaggttcaagtgattctcctacctcagccccccgagtagctgggattgcaggtgcgcaccaccacgcctggctacttttttgtatttttagtacagacggggtagccccatgatggtcaggctggtcacgaactcccaacctcaggtgattcgcctgcctcaacctcccaaagtgttaggattacaggcgtgagccaccgcgcccggcctttggcttactttattgtaagaatattactatattatttgtgtctggtgcaataatgacctgcctcatgatctgtcactgtctcccattacccctagatgggaccgtctagttgcaggaaaggcttccagccaacagcaagctattagttaagttttgggggagtgaagagttacacaaggtcttcacgtgcccctaaccctcacgtggcttcagagtcccctgtaaatgaatgtgtggcaagcaaagaaagaagaacatgaagaaaagagggagaggaataccctaccactacacaagaccatatatcaccaacaccattaattcttccttctacatgataagccggcaaagtccctgtccttgataactgtgccaatgacgtctgattcccagtagatggatgatgactaattagtcctacatggcaaacaaacgaagggttaattaatctgagcctgcctgagttat

SEQ ID NO: 2547 - DNA, 6839 bp, Homo sapiens
tggaaggacacagtttctctccaccttcgggttattgtaagtaatactgctgctgcaaacgtggtttgtgcaaatatctgttggagaccctgtttccaattctttgaggtatatacccagcagtggaattcctggtgccatctgttcttactttttatttcatggaatgctgttttattggggacccaagaatttggcaggatcagtctatcctcagggagtcagtgaagttcaataataaagaaactctccaggtcgtccctccttaaaagtcaggttccttcaagacagaatacaagtgacctgccctcaggcaaaagggatgccggcaacgttgcaccactggtgcaacaccagtatgcaccaaggcataacccaagatttaagacgcagccaagagccctttcccaggaggagccataggtaggaattctcaggcaggcaggggactgggggaaaaaataaacccacctaggggtggaatcctgccaagtaagagaggaatatagaaggcagcagacacaggggtcacacccagaaatgcaaaggctgatgtgaaaagcctgccacgaagcacccagcccatcttaagtgaaattcaagaggactcctgtaatcccagcactttgggaggccgaggtgggcagatcacctgaggtcaggagttcgagaccagcctgaccaacatggtgaaattcccatctctactaaaaatacaaaaattagctgggtgtggtgggacacacctgtaatcccagctactggggagactgaggcaggagaattgcttgaatccaggaggtgaaggttgcagtgggccaagattgcaccactgcactccagcctgggtgacagagcgaaattccgactaaaagaaaaaaaaaggaaagaaattcaagagggactgtgaaaagagcagtgattgctacacagtccaaggcgatccatggggatgagtcagcaattatgcatccaacgaagtgaggtttgcaaggtgaggaaggaggagggaaaacgctgtcgttcaccatccctcgccacagggaggccacaggcaatgccagcaattcaaacgtgctgcttaaacaaagcatcctggtccttcctggggaaatggaaatgggtatgacggtcagggagggtgacgctaccctcaagcccagcccttcacttcaatgggatttaaatgccatgcatgttacagttcagttttatgaaacctctgcttttatctaaagcatatataatttcataaagtatatgtaaagcatttatcattttatatatgcagcacatacaattttaggaggaaatgatggtgcacgcctgtagtcccagctcctcgagaggctgaggtgggaggatcgcttgagttccagaggcaaagccagcccgggcaacacagcaagactcacgtctcttaaaaaataaaataaaataagtaggtatataattttatgtatatattaattttatattttgtatactgatatatatgtattatatattatatgttacaatgtttatttatattatatattatgatatatgcttattatatattatatttattatatattatgtgttacatagtatgatatatataaaataatatatacataaaattaaacatccaataactatagtttatacttatatattataaattcgtgtttattataaagtatgatataaaaatatatactaaatatatatactatttatagaatagcataaatatttaatataaattatttataatgacacaaatataatttatagttatcattatatatttatgtaatatatattttatatatacacaaaatgtattgtgcatattatattatgttttatatataaatatataaataaaatatatcaaagtatatcttgtatataattttatattacaaatatatgttacaaaatatatatacattacaaaatgtaacatacatatgaatgtgaattcatatgtatatacattataatataaattcatattatgtcattatgtatttaatatatacattgaacataatacatcatatataataatacattataatttaatgtatatgctttataataataaatatatagtaagtatataaacctaaaatattaatatagatcaaatatataaatgtgtatacaataaatatatgaacctaaaatatgaatatatataaagtagatgaatataacacataaacaaactataaatgtctagacattgaccatgtacaagtgtgcagtgtggacagtgaatggaaatgtgagcatgaaatgtgtgttgacgcctcccatctcctgtgcacacacaagacacagcgacctccccatctcctgcgcacacatgacacacagggacctccccatctcctgtgcacacacatgacacacagggacctccccatctcctgcacacacatgacacacagggacctccccgtctcctccgcacacacgacacacagggacctccctgtctccggcgcacacaggacacccagggacctccccatctcctctgcacacacgacacacagggacctccccgtctcctgcacacacgacacacagggacctccccgtctcctccgcacacacgacacacagggacctccctgtctcctgcgcacacacgacacacagggacctccccgtctcctgcacacacgacacacagggacctccccatctcctgggcacacaacacccagggacctccctgtctcctgcacacacgacacacagggacctccccgtctcctgcacacacgacacacagggacctccccatctcctgggcacacaacacccagggacctccctgtctcctgcacacacgacacacagtgacctgcccgtctcctgcgcacacacaacacacagggaccattcggggttcagggacgcgtgtccatggtaggatccctggcaatttttctgatttgcccgagcactcatgagtttcatgactgctatgatttttcacagaagcttggctgtgggcaagatgggttggcagatgcagggggaaccggatggaaggctgcttgtgtccgggctcactgtcctggcggctgcaggtgcctaggccatgaggacatctgagcagacagggcgccggaggagagggcaggacaagaatgggagtgcagacagcaggctccctgtgaaggccagtgggcccagctgagacccagggaggggtatacctgccccacaggagagacctggacttggcagcagcagggagctggggcaggagggaaatcggccccacccacatgctgcaagcacgtcagccaggtcagagttccaggtgaggacgaggttacagctacaggtgatatgatgtcagagctatcggtgaggatagccggttagagctacaggtgagggtaagaggtcagaatgccaggtgaagatgagattacagctacaggtgaggatgacatcacatttacacgtgaggataacaggttagagctacagatgaggataagagttggagttggggccgggcacagtggctcacgcctgtaatcccagcactttgggaggctgaggcgggcagatcacaaggtcaagagatcgagaccgtcctggccaacatggtgaaaccccatctctactaaaaatacataaattagatgggcgtggtggcacgtgcctgtagtcccagctactcagtaggctgaggcgggagaatggcgtgaacctgggaggcggaagttgccgtgagccgagattgtgccactgcactccagcctgggcaacacagtgagactccgtctcatgaaaaaaaaaaaaaagagttggagttggagttccaggtagtgatgagaggttggacttccaggtgacaatgagtggtcagcattacaggtgatggagggaggttggagtcctaggtgaggacaagtggtccgagttacaggtgatggggagaggttcgagtcccaggtgaggatcagtggtcagcgttataggtgatgataagaggttgaagttccaggtaaagataagccatcactggggccaaggacagcccgaggtcacagggctggctcaaccctgattcctccaagacctgtgttctttcctgcacctgtttccttggaacgagtctgttcaggactcacactcacctgctgcagggagctcagctctccagcccacctgcactctctccagaacccctccctgcccgtgtgaagcaggagggtgtcacagatcagcacccaacacacctcggccactggggccagccagggggtggaggggccgagctacgtaagtccctgcgcgcaccacaaagggggcttgtactgtgtctagaaacctttcatttctgttttgagtttactttctcactggggttccactcctggcagacctccctttttcccatagagaggccgcacgcagaatttccaagcatctggaaccccggctgcttggaaacatgtagcgcctcctgtcatgccccatcggtgaccagagaggactgagtaagggatgttcccgtgactgcaaggaaggcatggatgggggcgtgtccacctccagcggaacccccaggggacttggaatttggaggcagagtctgaggccaacacttcagagtgacacacgcatgttcagggtcaccttaccggaagccatgcatttccctgatgagccaggggggtgactatgtctccccaagttcttgtcccatgacctggggtcaggacacagtgtgctgatgtcacaccatgtcacacagctgtagtatgcctctatcagcaatgcaactagatattctattcctgcccgatctatgtctctactcgtctcccgaggctgctgtgacaaatgaccacacctggggaacttaattcaacaggaattcatcctctactggctctggagaccaaaagtctgagatcaggtgtctcaggaccatgctccctccgggggctctcaggaaggggcctccctgcctctcctagttcctgggggctccaggagtccctgggtttgtggccgcatcgctccagtctctgcctctgtctccacaaggccttctcctctgtgtctgtgtctcctctcctgtctcctacaaggacagctatcattggatttaagactcaccctaatccagaatgatctcatcttgagatccttaactaattacatctgcaaagaccctatttccaaataagttcctgttcacaggttctggggattaggacatggacatatcttttggagatcagcattcaaccccttgcaattgtgtttgatgctttctttctttttcttttttttttttttttttttgagacagaatcatgctctgtctcccaggctggagtgcattggcaatatctcagctcactgcaacctcagcctcccgggttcaagccattctccagcctcagcctcccgaggagctgggatgacaggctcccgccaccacgcctggctaatttttgtatttttagtagagatgaggtttcaccatgttggccaggctggtctcgaactcctggcctcaagcaatccacccgccttggcctcccaaaggtgtctgatactttctgaagactctagggggcatccttcctgcctcttccagctcctggtatccctaagttgatggccgcatcactccagtctctgtctccacatggccttatctgtgtctcccttttttttttttttttgagatggagtttcactcttgttgcccaggccggagcgcaataccacgatctcggctcaccacaacctccgcctcctgggttcaagcgattctcctgtctcagcctcctgattagctaaaattgctcttaatattttaaaggatactgcagaatacagaggcatttgaaggaataaagagaatggctgaaaacagctgaaattcagcttctttttactattattccatttttatttagagaaaagggtcttgctctgtcgcccaagctaaagtacagggtcgcgatcatggctcaccacagccttgacctccaggctcaaacgatcctcctgcctcagcctcctgagtagctgagactccaggcacgcacaccacgcctgactaatttttttatttagttgtagagacaaggtcttgccatgttgcccaggctggtcttgaagtcctgggctcaagcgatcctcctgcctctgcctcccgagtagctgggaccacagtgcaccccaccaagccagactgatttgttaatattttgtagagacggagtctctctacgccaccctgactgctgtcgaactcctggcctcaagcaatcttcttgcctcagcctcccaaagtgctggaattccaagcgtgagccaccgggcccgaccctggcattcacccctcttgagacacggtgggaaagaaactgtgaatagttattttcacacgtgccgcctgtgctctggtgggagaagagcaatgagaacactcgccttgtttctctacctcggttctcattcacagacaaaaaaaaaaacaacagtaacacagccaggcagggtagagataactccctccactgacagagacattttttttttcccattttaacaacactcattaattcttatctgttaaatagcgcgtagaatttgtgcctctaaacccactcgataatcttttgggtaattaacttgtaaaacaaccccagtcctcgttacgggcgggatggaaaaatgtgaagtagcgcatttgcaaagcagaccatacacaattacttattaaacatgccccaggtgtgccggcaagtcggcggcaagtggaagccctcagccttgtcgtctaatgg

SEQ ID NO: 2548 - DNA, 3045 bp, Homo sapiens
atgctgaaacgctgtgtctactaaaaatacaaaaattagccaggtgtggtggcaggcacctgtaatcccagctactcaggaggctgaggcaggagaattgcttcaacccgggagatgttggctgcagtgagccgagattgagctattgcactccggcctgggcaacaagagagaaactccgtctcaaaaaaaaaaaaagacatattcatgttgagatttctacactgtgaaaaaagatctccaatagtgtgcatcaggcaccccaaaaattcccaattctattaaccaatcaaatctactaggaaattgcaattggaatgactccacggtttcccagaaaggccaacaccattctaatagaaagcattcactgtttttatgcaaatcatttcatccatacctcaaaacgacgtcatgtagactggataaagaaaggtgggagcatatacactatggaatactatgcacccatgaaaaagaatgggattggttgggcgtggtggctcacgcctgtaatctcagaaatttgggaggccgaggcgggtggattacctgaggtccggagttcaagaccagcctgtccaacatggagaaaccctgtctctactaaaaacacaaaattagctgggcgtggtggcatgcacctgtaatctcagctactcagaaggctaaggcaggagaatcactggaacccgggagccagaggttgcggtgagtcaagatcacacaattgaactccagcctgggcaacaagagggaaaccccatctcaaaaaaaaaaaaacgggatgatgtcctttgcaggaacctgcatggaggtggaggccattatccttagcaaacttacacagcaacagaagacaaaatacctcctgttctcactgataagtggtaggtaagcattgggtacccgtggatataaagaagggatcagactccggggcctgctggaaggtggagggtgggacaaacgagaggattgaaaaattacctatcaggtggtagtaggcttattacctggttgatgaaataatctctacactaaacccccaggacatgcaatttacccgtgtaacgaacctgcgcatgtgcccctcaacctgaaataaaagtaaaaacaagtaggccgggagcagtgattcctaatcccagcactttgggagggcaaggcgggtggatcacttgaggccaggagttcgagaccaccctgaccaacatgatgaaaccctgtcactactaaaaatacaaaattagtcgggcatggtggcacacacctataatcccagctacgtgacaggctgatgcgggagaatcccgtgaaccctggagacggaggttgcagtgagccgagattgtgctactgcactccagccttggcgacaagaacaaaacttcgtctcaaaaaaaaaaaaaaaaaaaacaataaaaagcacacacaaaacactgcatgcttctatggggaacattttactgatttttttttaactcttttaaaatgttagattagtgtcttaggaaatcagggatttccagaggcaggacttcacgacaccaacgttgagtgtcaaaaggattcctttcaatgtagaaggtgcatgcctgctctgggcttccacaaatccccgagacttaataagacacctggctccgtcactgatcaaagaatgggtaccacgacttagcatccactgcaaagctccatggtgcctagctttagccagtttgttcacagccgtgattaaggtgtccacagcatcctcaccagcctcaggaacagggcacagtcaactcaccacaggggtgaccccagaaacaagagacacgactgtaacagggacaatgtgcgggacgccaaaaaccagaacaagagacaggaatattataacagggacaaagtcgacaccacatggaagatggatgactcatttgtcacaggtagaaacagtttatctgcgagtttgtaaccaggtgaatcaagaatgaagggtgcggccgggcgcagtggctcatgcctgttatcccagaactttgggaggctgaggcaggtggatcacctgaggtcaggagttcaagaccagcctggccaacatgatgaaaccccatctctactaaaaatacaaagattagccatgtgtggtggcaggtgcctgtaatcccagctactcgggaggctgtggcaggagaatggcttgaacacaggaggcggaggttgcagtgagctgacatcacagcactgcactccagcctgggggacacagcaagactcctcttcaaaaaaaaaaaaaaaaaacagctggatgaagaatgaaaggtgcacaaaggcagccagggatgcaagccccttccaccctgggccctggaactgcacaggccaccttctaaggtttctctcctgtcatcctcccaagtctacacgaatataaagaaacacactagaagtctctgatgggatgggggcatctccagaaatccgaagattcaggttctgaatctctgatctgagtgcggctggggagctgctgttccagaaagcaaatgaaactttggctgtgattcagaccatttcttggtagcaagggtgtagggaaagaaggatgtggaccgtgcaggagaaggaatgaatggggtcaggacagtggctggagaatgtctgagatggccacgtgcagagaggagcaggctggctgtgtctctcactgtgcctgggatgggtggtgacagatgagtgggattccacatgatagagacacccaatgaagaaataaaagcagcttacagggagcaaatgacacagacactcagaagaaagtggccaagggatcgtccccatgtatgaactgaagacgttttctaagaatgtggccaagggtccacactgaagatgatccctaagaatgtggccaagggaccaccaccatgtaggcactgaagacgttccctaagaatgtggcagcgggatggccactgtgtagaaactgaagatgttccctaaggatgtggccaagggaccaccaccatgtacacactgaagacgttccctaagtat

SEQ ID NO: 2549 - DNA, 19171 bp, Homo sapiens
tgaattcagagagaatctttttcttctcctttgtttcttttagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggagattatgcctcactactcaaagagtgtggctcaggaaccagtgtagcttggccatgccctggcagtatgttggaaatgcctgccccagaccagttgatgttactaagaacgcccaggggatgagaatggactttatttacagtttgggaagcactggtctaatatgctctcagggaagctgaggtttctactgctttttactttttacccttccactagatgtcctttgcagcagtgtttttctagttggcattacaggtgtctcctctgaggttccagttatttctatactaccaaaattaaaaagacccaagggctgggcatggtggttcacacctgtaatcccagcactttgggaggctgaggcaggcagattgcttgagctcaggagttcaagaccagcctgggcaacatagggagacccctgcctctacaaaaatacaaatgagccaggtgtggtagcccacacctgtggtcctagctacttggaaggctgaggcaggaggatcgcttgagcccaggagatccaggctgcagtaagccatgatcatgccactgcacttcagcctgggtgacagagactctgtttcaaaaaagggagggggggcaagtttttagggggatgagaaatattcttggtaaatcgggcatttctttttttgtttgtttttttttcttggagacagaatcttgctctgtcacccaggctggagtgcagtggcttgatctcagctcacggcaacctccgcctcccaagttcaagcgattctcccacctcagcctccagagtagctgggattacaggcaaccgccaccatgcccagctaatttttttgtatttttagcagagatggggtttcaccgtgttggccaggctggtctcaagctcctgatctcaaatgatccgcacgccttgacctcccaaagtgttgggattacaggcatgagccacagccttaattggtaatttttgaaaaaaaaactagagaaacattgtttcagagataaagcagcaattacacttgtactcccagtgatttaagatgcactattgtaatcaagatgatttgctttaatcaaaatattgttaaaaataggatttcaggacatttaaaaggtttcagcagaaatcttatgattatgtctgacttgcagtattttatttgcctctttgacggctttttttttttttttttttttgagacagagtctcacactgttgcctgggctggaatgcaatggcgcagtctcagctcactgcaaacctccggctcccgggttcaggcagttctcctgcctcagcctccctagtagctgggattataggcatgtgccaccacacccggctaatttttgtatttttagtagagacagggtttcgccatgttggtcaggctggtcttgaactcccaacctcaggtgatccgcccgcctcggcctcccaaagtgctgggattacaggcgtgagccactgcgcccaaccttaatggctttttggtattaaaaaccaggactctgaatgtgcatcaataattcaaataattttatatagttactctttctagtaatagatacccccctccatttttaagtaaagataaacattttttaattaggaaaattaggcacatttaattttagcaaatttagtttttcaacttttttttttttctttttttttttttttgagatggaggctcactctgttgccctggctggagtgcagtggccgcaacctcggctcactgcaacctccgcctcctgggttcaagtgattctcctgcctcagcctcccgagtagctgggattacaggcgtgtgccaccacacctggctaatttttgtatttttagtagagacggggtttcaccatgttggccaggctggtcttgaacgactggcctcaggtgatccgcccacctcggcctctcaaagtgctgggattacaggcatgagccaccatgcccagccagtttttcaacttttaaaaataaaagtggtagaatttttttttttctttttgagacagggtcttgctctgtcactcaggctagagtgcagtggtgggatctcagctcactgcagcctccgcctcccaggcttaagggatcctccctcctcagcctcccgagtagctgggaccacaggcatgcaccaccacgcctggctaatttttgtattttttgtagagatgggtgtctccccatgttgctcaggctgttcttgaacttctgagctcaggtgatctatctgcctcggccttccaaagtgctgggattacaggcatgatgagccactgcacctggccaaaagtggcagaaattttgatatggtttataatcagttttattgtggggaagatgggccattttaatgaatgattatttctattggctaaactaccgagtcacgacatgacaaatacacatgaagctttaatcacatgcagttatatacttctcacaaatcatcaaattatttatctggtcttcacactaagggatttacttagataagccatcgatgatttcagttgttaaaagtgtggctttttaaacagcatttattcagtgcatcctgatttatttcaaaatgaaaaattgttacctttttttctgaataaataaagcttacttttagtggcaaggtataagttataatggttgttcctggataactaaaaattcaggcaaagaggacctgtaaatatttcaaagccatctggtatgtaggctcctattgttagaatttaaactgcctcgagatagtattgcattttaagaacacattttgctttcactgtagacttctcaaattcaatgggttgtccttcataataaaagaccattctaacccacggtcaggagctctggtattccaaggctgttgtgggatttttccttcactgccacctgcccccaaggagtgacaatatatagtgatttttcttgttcttccctgataaccataatgaacagtgagtatgctttctgccagccagagctaaaactcagcgacgttaaccagctcctatgacctaataaatagagataatagatcaattcatcataatggaggttttgagtgactactcctacagtacccagtgtccaactgtaatcagcataatagcaataaagtgcataatgttctctgccattactgcacttagacaatgaaaaaatcctgatatagcaaaatgaccatgtcactcagcaattttaaactgtttcatggagatttactttagggtataagtggcatgtgagaactgagctaaataatatgccactatcaaaggagtgtggcacaagaacactgtattgatgccactaacaaaattgttgagtgttcattgttaattggagtaacagagtacatgcttgtgaaattgaggcatgaaaatagatactatttaaaatctggggccaggtgcggtggctcacgcctgtaatcccagcactttgggaggcggaggcgggtggatcacaaggtcaggagtttgagaccagtctggctaacacagtgaaaccccatctctactaaaaatacaaaaattagccgggtgtggtggtgtgcacctgcaatcccagctactcgggaggcttaggcaggagaatcacgtgaacccgggaggcagaggtcacagctgaggtcgcaccattacactccagcctgggtgacagtgtgagactccatctcaaaaaaaaaaaaaaatctggataacacacaaatgtaattaataaaaataggccaggcacagaggctcacacctgtaatccaaacactttgggataccaaggtgggcggatcacttgaacccaggagtttgagaccagcctgggcaacagggtgaaagcctttctcaattaaaaaaaaaaaaaaaagccaggcgtggtggcgggcacctggagtcccgctactcgggaggctgaggtgggaggatggcttgagcccaggaggaggagattgcagcgagccacaatcaggccactgcactccagcctgggcgacagagccagaccctgtctcaaacaaacaaataaataaataataatgagcttgtgatggatgtcttgatgtccacattaccatgcttttagaaatggactaaaccagtcaatctcctggcagcgggtagtcatcctcaagcgtggccgcacaataggacctcctggcaagtccaggtgctactgatgcccaggctcccctgcagagatactgatttatttggctggggatgtagcccttgagggtacagggttgtttgaaactctccaagactttgtaacagcagctaagattgagaaccacggggcccagggaaagagactcaagtggaaagtcaggagacttggtgaaaatactcagcctgacacactcaagcttctttatcagtacaatgaaagggttggactgcacgttttttaacaacctatgtctaaaatgtcatcctatttttaaagaggcctttgtaaaataaatactgttttagttctgttttcaaagtggggttttgttttttagttttctgaaatgtacaatatcttaggttctcacataaatatatgcatgtatctccactccatccacaaaccccactgaatgacagtaaaggaatgaaaagaaaagctatacattcatagtgacaaaaacagaagggtcagcaacagccaagtgataccaagaacattttcatgcttcagaagcctggaaatgctcaggaattctggaggtgcagtaactcggaaggctgaggaaaagttggtatcagggtgggcaatttgtggtctctgccacaatctacaactgaaaatcaagggcaagtggcgtaagcatattgttatgagacacagacacaaacagacaaaattgctaagttttaaatggctcctgagaagtgggaattggggatgtgaaatggcctttgcaaaaagtgtaacagtgacaaagttatggcagtgtgtagatctgacctaactgactccatcttgcttctgtgttcattcctgggcataggccaaactaactttgggaagaactttaactttgacataaagattgtaacagccctttcctgaaacaaaccccattcttgcatgggaaccacactgcctttgtaggactaacacatgagccacaatattatggtttagtgtcacagctgttttagaatttatctagcaggttttctggtctttactggaaagcccaagaaagtaaaaatagccgggtgcggtggctcacgcctgtaatcccagcactttgggaggctgaggcaggcagatcatgaggtcaggagatagagaccatcctggcttacacggtgaaaccccatctctactaaatatgcaaaaaaaaaaaaattagccgggcgtggtggcgggtgcctataatcccagctactcgggaggctgaggcaggagaatggcatgaacccaggaggcggaggttgcagtgagccaagatcgcgccactgcactccagcatgggcgacagagcgagactccgtccaaaaaaaaaaagaaaaagaaagtaaaaataataataataataataaaagaaaaatagcccgggcacggtggctcatgcctgtaatcccagcactttgggaggctgaggcaggcagatcacctgaggtcaggaattcaagaccagcccagccaacttggtgaaaccctgtctctactaaaaatacaaaaattagccagacatggtggcaggtgtctgtaatcccaactactcaggaggctgaggcaggagaatcgcttgaacctgggaggcagaggttgcagcgagccaaggtcgtgccactgcactccagcctgggcaacaagagcgaaactctgtctcaaaataaataaataaataaaaataaaaaataaaaaaataaagaaattatggttctggagtcttgcagctagaggccacaagattctaaacctcctcaattgctcctagggataacatcactacccactaccataaaacctaagattaggtgctgaagatatttttcagtccatggattagctggtgccacccagatcaataaactggctcatctggtgttgtggcccccacccaggaaccgactcattgctagagcacagcttcgactgacctcctaggatttcatctctgacccgaccaatcagcactccccactccttagccccatacccaccaaattatcctttaaaaacctcagtttccaaatcttcagggagactgatttcaggaatgtgaaacccaaaaatctgagacaggcctcagttaatttagaaactttattttgccaaggtcgaggatgtgtgcctgtgacacagcctcatgaggtcctgacaacatgtgcccaacgtggtcagagcacagcttggtttcatacattttagggagacatgagacaccaatcaacatatgtaagatgaacattggtgtggtccggaaaggcgggacaactggaagcaaaagcgcacaactcgaaaggggagagggctttcaggtcacaggtagatgagagacaaaccgttgcattgagtttctgattagcttttccaaaggaggcaatcagatatgcatttatctcagtgagcagagggatggctttgaatagaatgggaggcaagtttgccctgagcagttcccagcttgaattttccctttagcttagtgattttgggggcccaagatattttctattcacagtaataataaaactccggtctcctgttcagccagctctgtgtgtattaaactctattgcaattcccttgttttgataaatcggctccatctgggcagtgggcaaaatgaacccattgggtagttacaaagagagaagcactggtcaagggtctctgttgttttaaaagccttgtgtaatttgacttctaaaattaaggacatgcatcttttttttttttttttttttgaaacggagtcttgctctgtcgcccaggctggagtgcagtggtgcgatctcggctcactgcaacctccgcctccagggttcaagctattctcctgcctcagcctctcgagtagctgggattacaggcacctgccaccatgcccagctaatttttgtagatttcttttaatacctaattttgacacgggtatggggaaaaagcataaaaatactgtagatgggagtgtaaaattgttaaatctttccaaatggcagtcgggtaacaagcatcaaaatgttaaatgtgaggaacatttaacccgacatttctactcttggaatttatgctaaggaagcaattagacaagcaagactttgagtatacaatagaaaaattggcaggtacctatatgtcatacaccagaatcttgatttgaacaaatggtggttcatccacatgatggaattgtgtgcaaatattttaagtgatatattttatacccaccagatggtcaaaaatgtagaagtctgaaggctgggtgcagtggctcacgcctgtaatcctaagactttgggaggctgaggtgggcagattgcctgagctcaggagttgaagaccagcctgggcaacatgatgaaaccccatctctacgaaaatacaaaaattagctgggcatggtggtgcgcgcctgtagtcccagctgcttgggagactgtggtgggagaaccacttgaacctgggaggcaaaggttgcagtaagccgagatcgtgccactgcactccaacctgggtgacagagtagaccctatctcaaaaaaaaaaaaaaaaaaaaagtagaagtctgaaaatatcaagagttagtaagcatgtgaaacaacaggaacatcgacgtgctattggcgcaactatgcactggcacaatctctttggaagtaagccaaaactggcattacttcaatgaaaagttgaatatgtacttctctttgcccagcaagcagttcctctcctagggaataccaaatggtattaaccacttatgaaaataactaccattacttagtaaagtggaagataaaaacatcatatggcatgtgctagtaggtggcacatgcacgactgtcaataaaagtgatgttctagtgacctcaggctgcacccaacccaaatgtgcatcaacagtagaatggaattataatgacagtgtgataaccatagcaaagagccaagaacacgaaaaaataacagctgtgcacagtgctgtgagtgaatctatgaatctcataaatgtaatgttaaacagaaaatgcaagattggagagaagacctacgtaaactccaaatacaggtacaactatactacatatgtagtagaactaaaagaaacagctaccataaaagtcagatattacatagcataagagaaatcaagaaactacagctacataaaacaaggagaagacaggtcccaacattacacacctcaataaaacacccagttaaaactctactcactgggcctggtggctcatgcctataatcccagcaccttgggaggccaaggctagcagatcccttgagcccaggagttctataccagcctgagcaacatagtgagaccccatctctaataaaaatacaaaaaattcaccaggtatggtggcatgcacttgtagtcctagctactcgggaggctgagatgggaggatcacttgagcctgggaggtcaaggttgcagtgagctgtgattgcaccactgtactccagcctgggcgactgggcaactgtcttaaaaaacaaacaaacaaacaaaaacccaacaaagactgtctcaaaaaacaaacaaaaaacccccaacaaactctacttagttttatttttgcttaaatctttaataaaagggaaagccaggcacagtggctcatgcttgtatccccgctgtgggaggatcacttgagccgaggaatttgagaccagcctgaccaacaaagtgagacgctgtctcaaaaaaaaacaaataaaaaaaaacaaataattaaaatgtaaaaataaaaaactagctgggcatttaccattgtggcaagagggtggtctaagcccaggaggccgaggctacagcgagccatatttgtaccactacaatgcagtgtaggtagcagaacaagatcctgtctcataaaatagtaacagaattaaaaaaaaaaaaaaaacgactaactctattaatctaaaaacaagaaaaaacaacagcaagcttggaaaggcagttgccaggtaacagccacctctggtacactgagggtgaaattaagcccagctcaaatacatacagcacttctttcaggcgaatgtgtaaggaaaagtatcattcttcaaaacagcaggtttaaaggacacctacggcttttaacttgtaaatatattgcatgcagtgcaccatggttatgcaaatgaagctgagtcattgccctatagattaatgccgtagctcccaagcatggctgcagcctgcaaggtagggaaaaggcccagtccagagtccacccgggaaactcaaccaatttgttttgttcaccgatgccctgactgtgatttcttttggataaaggatttcttgaatgctttcaaaaatgacgtccaagcgctacatttgacataagagaaggttcacaatataatgttaaatgaaatataaaaggcaatttacaaaaatatttaatacgattacactttttcttccaaaaatgcccgtgtatgtgtgtgttgggcatgcttttgtgttaccggtggagggtgtccacgttcttggcgttttgaacaaagaattggacaaaacgcacaaagcaaggaaagaatgaagcaacaaaagcagagatttactgaaaacaaaagtacattccacaaggctggagcaggcctagtacaggggctcaagagccccagaattttctggaatttaaataccctctaggggtttcccattggttacatggtgtacaccctatgtaaatgaaatagcggcctgcaatcagtctgtttggttgtggaaagcaaccaatcagaggatgaagtgtagttacaaagttacactcactcctatgcaaacgtctgattggctacagaaagcaaccaatcaggctgggcgtggtggttcacgcctggaaccccggcactttgggaggccaaggcgggtggatcacctgaggtcaggagtttgagaccagtctggccaacatgaggaattatctctactaaaaataaaaaatttagctgggcgtggtggcacgtgcctgtaattccagctacttgagaggctgaggcacaaaaatcgcctgaacctgggaggcagagattgcagtgagccaagatcgtgccactgcactccagcctgggccacagaggtagacaacttccccacccccctaaaaaaaaaaaaaaaaaaaaaagaaagaaagaaaagaaggcaaccaatcagaaatgctttcaattttccatctgccgcacagaaaggtggggtgggggtggggtggatttgcaaagggagtagtttacaatccttttgttatttacctgtggaaagttgggatgttccttttgacttagttttttttttttttttttttgagacggacttcactcttattgcccaggctggagtgcaatggcacgatctcggctcaccgcaacctccgcctcccgggttcaagcgcttctcctgcctcagcctcctgagtagctgggattacaggtatgcgccaccatgcccggctaattttgtatttttagtagagacagggtttctccatattggtcaggctggtctcaaactcccgacctcaggtgatctgcctgcctcggcctcccaaagtgctgggattacaggcgtgagccaccgcgcccggccattgacttagttctagaaagccagcttgaatcggccttaggttccctgcctccggaccctattctcctgcctcatatgcatagaaaagactcgggaggcttacaccaaaatggcggctatatctttttttttttttttttttgagacggagtttcgctcttgttgcccaggttggagtgcaatggcgtgatctcggctctccgcaacctccgcctcccgggttcaagcgattctcctgcctcagcctcccaagtagctgagattacaggcatgtgccaccacaccgggccaattttgtatttttagtagagacggggtttctccatgttggtcaggctggtctcgaactcccgacctcaggtgatccgcccgccttggcctcccaaagtgctgggagtacagacgtgagccacccgcacttggccatcttttttttatatatttttttaactatttgtggttatgtttttgggaatttctgtgcttaacatagtaggaaaaataagaaaaatcggtaataatttacatttcctttcctcagacctggaagcaggcatttcttcaaggaatcttgattccttttgatgggaaaagctatttactcttcaagaattgtcagcctggcgtggtggctcacgcctgtaatcccagcactttgggatgccaaggcaggaggatcacctgatgtcaggagttcaagaccagcctgaacaacatggtgaaaccccgtctctactaagaatacaaaattagccaagcgtggtggtggtgcatgcctgtaatcccaactacttgggaggctgaggcaggagaattgcttgaccccaggaggcagaggttgcagtgagccaagatggggccattgcactccagcctgagcaacaagagtgaaactctgtctcaaaaaaaaaaaaaaaaagaattgtcctgcagactgggggcagtggctcacaccaatcccagcactttggaaggccaaggagggaggatcctttgagcccaggagttcaagaccagcctgggcaacatagtaacaccaagtctctaccaataaaatgaaataaataaataaaaattagccaggcatggtggtgcatgcctctagtcccagctatttgggaggctgaggtgggaggatcactttgctacccgggaagagtgtccaggttcttggcgtcttgagcaaagaattagacaaaacgcacaaagcaaggaaggaatgaagggatttattgaaaatgaaagtacactccacagggtttgagcaggcccaagcatagctcaaaggccctgtttcagaatttttgggagtttaaaaataacctctacttgaggtatgccctatgtaaatgaagaggataaagtaaagttacaatcatttacttggcctacgccctatggagaggctatttcctgtcatagctgaagtgtgaatcggccttatattccctacctccagatcctattttcctgcctcaacttgagccctggaggtagaggctgcagtgagctatgatcacaccactgcactccagccttggtgacagagcaagacttgtctcacaaattaataattaaataaaaagtaaataaaatatgacattgatcaaaacttcattagtagtattagaagacaaagttgagatcatctacaaagtacagatgtttcctgacttatgatggcgttatgttccaataaacccatcagaagttgaaaatatcataagtggaaaatgcatttaatacacttaacctggccgggcgtggtggctcatgcctgtaaccccagcactttgagaggccaaggcgggtggatcacctgaggtcaggagttcgagaccagcctggccaacatggtgaaaccccttctctactaaaaatacaaaattagccaggtgtagtggcacatgcctgtagtctcagctactcgggaggctgagatagaagaattgcttgaacctgggaggtggaggccacagtgagccaagatggtgacactgcactccagcttgggcaagacagagcaagactccatctcggaaaaaaaaaaaatacacttaacctaccaaacatcataacttagcctagcctaccttaatgtaagctcataatactttgtttttttgagacggagtcttgctctattgcccgggctggagtgcagtgagacgatctcggctcactgcaacctctgcctcccaggttcaagtgattcgcgtgcctcagcctcccaagtagctgggattacaggcgccagccaccacgcccggctaatttttgtattttagtagagatggggtttcaccatgttagccaggtgtgtctcgaactcctgacctcaggtgatctgcccacctcggcctcccaaagtactgggattacaggcgtaagccactactcctggccaagctcataatacttatattagcctacagttggtcaaaatcatcaaacacaaagctgttttataataaagtgttgaatatctcatgtgctttattgaatacttgtactgaaagtgaaaaacagaatggttgtatgggtactcaaagtcaaattcatacaactttggcaccatcgcaacatcaaaaattgtaaccctggaactgtctgtagcaaaacaggatataggaaaatagaagagaaaagataagaaacatggagcagggcaccgtggctcccactgaggtgggaggatcacttgagtccaggagtttgagaccagcctgggcaacagagcaagaccctatctcaattttaaaaaaagaaaaaagaaacataaaaaagaaattattaataggatactatacaactaggttgtgaataatatctacatgaaaataatgtaaaaaaaattaagatattaaattaacaaaatgaaaacaaccatttagagaggatgatgtgatgatgggaggaagtgagcatctgtgtgtgtgtgtgtgtgtgtgtgtgtgtgtgtgtgtgtgactgtgagtgaaaaagcatagaccctcttccctagaagcaaatctatatatatctttctgtgatttcagaatcagcttgatggcaagtgacagaaaaatccagaattacagtggtttaaactggatgctgatttctttctttttcttttttctttcttttttcttttttttttttttttttgagtctcactctgtcgcccaggatagagtgcagtggcacaatctcagctcactgcaacctctgcctcctgggttcaagggattctactgcctcagcctcccgagtagctgagattacaggcttccaccactatgcctggctaattttttgtatttttagtagagacggggtttcaccaggttggccaggatggttcccctttcttttctcttctcttttcttctcttctcttctcttttttctttttcttgagacggattcttgctctgtcggtggtgcgatctcagttcactgcaacctccacctcccaggttcaagcaattcccctgcctcagcctcccaagtagctgggattacaggcacgcgcccctacatccagttaattttttttttttttaagatggagtttcactcttattgcccaggttggagtgcaatggtgcgatctcagctgaccgcaatctccgcctcccgggttcaagcaattctcctgcctcagcggcccaagtagctgggattacaggcatgcgccaccacgactggctaattttgtattttttagtagaaacggggtttctccatgttggtcagcctggtcgtgaactcccaacctcaagtgatctgcccaccttggcctcccaaagtgctgggattacaggcatgaaccaccgtgcctggcctaatttttgtgttttctttttagtagagatgagatttcaccatgttggccaggctggtctcgaactactgacctcaggtgatccacctgccttggcctcccaaagtgctgggattacaggcgtgaaccaccgagcccagcccttttcttttctctctttttttttttttttttttgagacaaggtcttactctgtcgcccaatttgacgctgtagtgggctaggatgaaaaccactatactccagccagggtaacacagagaaagagattctgtttcttaaaacaaaatgaaacaaaaaaaaaaacttgaaaaaattgttcggctgggcgcagtggctcacacctgtgatcccagcactttgggatcacaaaatacaaaaattagctgggcgtggtggcttgcacctgtaatcccagctactcaggaggctgaggcaggagaatcacttgaacccgggaggcggaggttgcattgagccgagagcgtgccaactgcactctagcctgggtgacagagcaagactccgcctcaaaaaaaaaaattgttttaattgttttgagacagggtctcagtttgtcaaaacaaaaaattgttttaattgttttgagacagggtctcactttgcattctagcctaggtgacagagcgagactctgtctcaaaaaaaaaaattgttttgttttgagacagggtctcactctgtcacccaggctggaatgcactggcatgatcacagctcactgcagcctcaacctcctaggctcaaacgatcctcctgcctcagcctcccaagtagctgtgactacaggtgtgcaccaccacacttggctaaggctaattttttattttttgtagagatggggtctccctatgttgcccaggctggtcttgaactcctggcctcaagcaatccccctgcctcgaactcccaaagtgctgggattacagacatgtgctaccactcctggccccgagattttcaataaagcctaaacctatttgtagtttgtatttttcttttccattgtctctatacatgaacattgtttccatgtccttgaagtctataattataggcgagacttggggaagtatatcaaaacaaaatgaatgaatcccaatactctgaaatatgcaatatacgtattcgaatttttgaaacgcacatactctctcccaatagtccatacatgagaagagtttttattttaaaaatcctctttctgctagagctggcaccctggtgtgtgccaatctaatagtacactccatagcctgccatcagtatgcctgagtgatctgtgtataaagtataatcattttctaaatctttcagtgtctgccagaaatgtggacatctatagcaaatgcagaaactggccaaattcctacaaggactaaaatcagggttagctcagaaagatggtattgtgtaatcatattaaacaataagctttttgttctatgaagaggcaaacactctttttcactacctacaaccccaatagtatgcaacaaacatgaaattcaactcttttgatgaaacaatactcttggctgatttaaaagttagtaggagcttttctttctgtgaaagtactctgaggtggacaagtcagactagtgtggctaatttaacttctgttgaccctttagacacagctcagatgtcaccttaaaccatccttaaacctccccaccaccagtagaaaataaccctcaagaggttaccctgcaatacctccattttataaattactttattgtttgttgtacatgtgagtgttcagtgttggcctgggtaccccttattctaaatcaaggtatgcctggtgactaatacagtgctcctgtttaactgatgaatgaaaactttctattgccaccaagtttatcctggaatgaccttggtcccttggctgctggagggtctacacagtgttgcagagggacactgctgtcagaaaactctccaagatgtcacaagaagggataggatatcaccttggggaattgaaggttt

SEQ ID NO: 2550 - DNA, 18461 bp, Homo sapiens
tgcaccaccacgcctggctaatttttgtatttttagtagagacagggtttcaccatgttgtccaggctggtctcaaactcctggccttaagtgattcacccacctcggcctcccaaagtgttaagattacaggcgtgagccaccgcacctggcctaaaatgttttaaagcaatgtttcaatactgagtaaaaaactaaaaatgggaggtaatatcttagataggaggcactcaaattattgattaatgacctgagcatgctgacgtgtaggccatttcttcttaatcttctctagatcaggcaattgcaaggaagaaactcatggaatcgctactttccagaggtgacatgggaggccaagccaaatggagaaagcctgaaataacagcatatttataatgagatataggcatggctttcacatatttgagtgattggcatagtaacacaaaagtactttggcataaaaggaaataaaagacttctgggtgactatggagaacattctagggacaaatttgcttcagctcattaatctggtaacaatgctccctctgttcctgccattttggctctcttaaatatatataacatgaatatgtgcatatccatctgtgtattgctatcttactgactgctatcagttctggaaggtcaatgattaggaattcaatgatgatacaagtatacaaggaagacttagagttcccaaatctaattgaaatctggaaattctaaattctctttgacattctgttcccctgtcatcctcactggctggctggctgacaagtcaaaagaggctcctgcagtgggaatacagagttcaatgagctgtgcattcagggccacagaggaggagaatacaagccatacacatacagagaacccaaacacacaccacatccccattcatccactggcagaggacagagacttcttcattctgaatctcccactggcattcaagaattgcaagttctgtacaaactaggaggtgacagccacaacaaggggtcactgttactgtttccttttatatgtcttctaatcatcgtcagggaaactgtattacttacaagttttgttccttgtgctagttattgaagcatctctcggactccagagctactcttctatactatgtgttgtggggcccagactcagcaggctgtgagctgatacttccctaagagttacctgttgtctttaactcacatacaccatccataccacacacacacacaaacatgcaccacacacacaaaccatgcatacacacacaccatacacacttagaccatcactcagtgatatcggatttttttttttaacttgggttttaattaggtacataaatagcaacatgagaatgaggagttctaaggcttgtacattatctctaggtgaagggattccaggttagtttgcttgtaggatgatttcacagaagataacagaggtctggtctagtttttcctgaagaagaaagccaatttaatacattcaatactgacttctatgccatttttctgtagaaatactgatttattctatggagtttccaatgtttacctataactaaaagaaagaaaagaaaaacataagtaactgtgccagaaaaaattttgcattatgaaaattcttcagatttaaatagagaaaccaggccaggcgcggtggcccatgcctgtaatcccagcactttgggaagccgaggcgggtggatcacctgaggtcagaagttcgagaccagcctgcccaacatggtgaaaccccgtctctactaaaaatacaaaaagattggctgggcatggtggcaagtgcctgtaatcccagctacgcaggaggctgaggcaggagaatcacttgaacctaggagacagaggctgcagtgagctgagatcatgccattgcactccagcctgggcgacaagaatgaaactccatctcaaaataaataaataaatagagaaaccatagaaaatatttacatcaccattatatgaccataagaaacatgagccagagaaaactgtaattattcccattttaaagacagttaaactaagaatcagaaaggtcgagtgtggtggctcatgcctgtaatcccagcactttaggaggccgaggcaggtggatcatctgtggtcaggagttcgagaccagcctggctaacatggtgaaatcccatctttactaaaaatacaaaaaattagccgggcatggtggcgggcgcctgtaatcccagctaatcgggaggctgaggcagtagaattgcttgaacccgggaggcagaggacgcagtgaaccaagactgagccactgcactccagcctgggcaacagagcaaaactctgtctcaaaaaaaaaaaaaaaaaaaagattttgtgttccatcaacattacatatacactacattcagatcctcaattggctgtgtatctgagtgtaattaaccaactagatggatgaataaataaaaaacaaatgcctaaatggcacagtacacatcacatctgaagattaaacaactacatttccatctatctgctggaaagcatgattacatcaccctcagtttgatgtgtaattttcctcgcatcacccccatcatacttttctggaataaaatacacatatagtcaaagacatgtcaaagacaaactgagtcttctccagattgcttttttcatattttttttttttttgagatggagtcttgctctgtcacccaagctggagtgcagtggcgtgatctcggctcactgtaacctctgcctcccaggttcaagcaattctgcctcagcctcccaagtagctgggattacaggtgcccgccaccacacccagctaattttttatatttttggtagagacagggtttcaccatgttggccaggctggtctcgaactcctgacctaaagtgatctgcttgcctcagcttcccaaagtgctgggattacagccgtgagccaccacgcctggctttttttcataatttgtaatgaatatactcagcaattagagatttttttttttttttgagacggagtttcactcttgttgcccaggctggagtacagtggcgtcctctcggttcaccgcaacctccatctcccgggttcaagcaattctcctgcctcagcctcctgagtagctgggattacaggcaggcgccaccacgcccggctaattttttgtatttttagtagagatgtggtttcaccatgttgggcaggctggtctcgaactcctgacctgaggtgattcacccgcctcagcctcccaaagtgctgggattacaggtatgagccaccgtgcccggcacaattggagatttctaaatattttagaggccagtgactattcacttgatcttttaatatacaaccaaaaattcttaaacatgtaaactactagcttattttttctatctcagtttattaatctgcttttgtcttccccaggaatttgatagatttattgcattgttaaaaactaaaaactggaaacaacctatgttggtaaggattaagtagatcatggtagtccatactaggaaatcattaagcaactagagaaggaatgcgtagctctattaagtactgacagggaaatacttacacaatatgttatgtaaaacaagttcattcattcatcagcatagattaatatagtactgtctatggcaaaaaaaaaaaatgaacctaagtctaattaagccttcggatccaactataagtttatgggaaatatagagaagaaagaaaccaagagataaacagaatgatactaaatggatacattcggccacagccagaacatgagaaattctttttttcccctcccagctcaatccttgtagaaaacaggaattctaaaggacaaataagccaggtttttcaacagataaatagcaagggacaatgagggagcggaaactattacagttctaagagacctatcagtcaaacacaacaggcagatcttgtttggatcctggttcaaacgaaccaactgtaaaaagttattcatgaaacaaccaggaaaatgtgtacattgaactggatattagatgatgttaaggaattagtgcaatttctttctttctttgagacggagtctctctctgttgcccaggctgggagtgtgcagtggcacgatcttggctcactgcaacctctacctcccgggttcaagcaattctcctgcctcagcctcctgagtagtttgaactacaggcatgagccaccatgcccggccttaatttcctttttttcttttttcttttttttttgagacagagtctcactctgtcacccaggctggagtgcagtggcgtgatctcggctcactgcaacctccgcctttcgggttcaagcgattcccctgcctcggcctcccgagtagctgggactacaggcgcacgccaccatgtctggctaatttttgtatttttagtagagacagggtttcaccatattggccaggctagtctcaaactcctaacctcatgatccgcccacctcagcttcccaaagtgctgggaccacaggcgtgagccaccacgcccagccccagcctaatttcttttttttttttttttccccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaaaaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcagtagacgcagcaaagaaagcctaatttctttatgtatgataatataattacaattatatgccttcagtaagttttctgtgcagctactcagaagggtgaagtgggaggatcacctaaacccaggagttgaagtccagcctgggtaacacagcaagatcccatccccccagataaataacagtaaaaagaaagttttctgtgaacttgtaaaacaatatgtggaatatgatcccattttgtcaaaaaaccaaaaacatgcatgtatgcatgaatatattataaatgtataaataaatttatttaatttataaataaattttaaatataaataaatatatatatttgtttttgagacagggtatcactctgttgcccaggttggagtgcagtggagtgatcatggctcactgcaacctctttctcccaggctcaggagatcctcccacctcagcctccaagtaactgggactacaggtgttcgtcatcacactcagctaatttttttaattttttgtagagacagggtttcgccatattgcccaggctgttctcgaactgccagactcatataatccacctacctcagcctcccaaagtgctaggagtacaggtgtgagccactgcacccggcctatctatctatctatctatctatctatctatctatctatctatctatatttaaaagtctggaatgatataccaaactattaacaaaaattacctctggaaaaaagaataaaggggccagatgtggtggctcacacctgtaatcccagtactttgggaggctgaggcaggtggatcacctgaggtcaggagttcgagaccagcctgaccaatatgctaaaaccctgtctctactaaaaaatacaaaattagctgggcatggtggtgcatgcctgtaatcccagctacttgggaggctgaggcaggagaatgacttgaacccgggaggcctcagaggctgcagtgagcaagattgctccactgcactccagcctgggcaacaagagtgaaactctatctcaaaaaaaaaaaaaaaaaaaagaaagaaagaaaaagaaaagaataaaggataagacaagcttttttgttttgtttttgagacagagtttcactctttttgcccaggctagagtgcaatggcacgatctcggctcactgcaacctccgcctcctgggttcaagcgattctcctgcctcagcctcccaagtagctgggattacaggcaactaccaccatgcctggctttttttttttgtatttttagtagagacgggctttcaccatgttggccagggtggtctcgatctctcgacctcgtgatctgcccaccttggcctcccaaagtgctgggattacaggcgtgagccaccacacccggccaagacaagcttttaaaacagttagctaaaaacattttttacaaccaacacgaatcacttttataattaaaagctacacctcctccaataaagatctaaaaacaataaagaatgaagtcaaggttgtgtatttcagcaagctgaactctggtgcagagtatctttgaaaattgaaatggatatttacctaatttccctttattctatgtctttttcattgtccctgtacagaaatatatccattctggctgacagggatttaaaaaaagagagaaatataaccatattaaaagtcaagtctctagaggacatgtgtcactctgtggctgctcaccctccagtcatccttctaatggcacatcccatgcatatctggccccattcaccagagatactgattctggggtgccctttgccttttaccaagctccccgggtaatagtttgtatctgagaacatactgatgttgggttactgtatgaacagctatgctgtgaaagaggaactggatttgttttctgtgaccactaaggagacatatttttgcttagcagaggaaacagcttccaaaaactcagaattgtcccaggatggctgccccatagggtgagtttcccatcagtgctggtgtaaaagaaggaacatacagggtttcaggggagtctgcttgaggctgggggttgggccagataaccactctcaaattctcagtttatgtgactctttgggtctccaaaaatataaagaaagcttgaggaaaaaagacccttcaaactcagggttttcataaattttaagtaagggccatgatttacaataaatgtaacaccaattttcaaaaaattttctgattataaaatgcatactcattgcagaaaattttttaaatacagaaagttataaagaagaaaaaaatataaaaatcatcatgccactgaaagatacacactttctgtcgtatctcctggcttcatcccctctataaacatatcacactacctttttttcatttaacaataattgtgcacacgttcccatgcaattaaatactgtagaaacagaataataatattcttctttatagatataccataattaagccattttcctgtagttgaatatctaggttgcttccaaattcaattacagtcttctaattaccaggaaatcacaagtgctattatacaatttttcatatatacacaaacaatataactagtgttttgagcctctctgtaacagtcatgcattccagtgttcactgagtattagataaatacaagtgtacttactataataaagtgttgtttgaaaaaaacctaaggaataatgacacttttcaattgtttgaaatacatttgtagacaaatcccaactgtctggttctagcttgtctaaaaaacccaggtaacattagtggaacaaacacaaataagtaagtcacagcatttaagcccagaaactaaaagatggaataaaatattttcacatcaaattgaaactgttataattaattaaattaaattaattaaaaacaagtcatttcagctggcactacaatgctgaaaataatcacagaaatttcttgttttttacctgattaagatggcagagcatggagttttctacttagttccaggtgaattcttcacatttcctggcttttaaaacaaaagaaagagcttgaatgcagtttgaaaagaaatagtgcaactccttagtgtcctgagtatttggctgaacatgaacattaaaaattattatgggggacagggtcaaaccattttattgaggacttggggggttgttgaagaaaggctgaggaggacaatgagatcccacattctcgcagttaccgaccattaaatattattttactgcaaagtgatccatctgtcagtaaattgaagaagttactagggctctctgagggccctactgtagagtgacttgggcagagagagcaggaaataaagctccattaatcctcattatgcagattcagccaaacagttgattctaattaaaaaatcaatatatcttccttttatttcctgaaataaaggttttacacctatgggaaggcttcctgtaggtatttactccatgcattattcaccattatccaccataggggccaatccacaaaacatgtttactctgaaagaagttagaccacacccattctgcccagtggccctccgggaacatataattaggccatgtaatccataagaagcagtgtaggaaaagcttctagtgggaaaagttcacgtgctaaacttttaaggccttactttcttttctatacgttttttagactttaattctgaaaacacattaatagtcagagatcagatggcagtctgaaaaacaggaggctgcagctgggcgggccatgggggctaagattctgttgtatagacttggagcagtttctcctggtgcccctctttcagagttattcatggatgaaggaagaggaaaaggtgagaaagcaggagcacgtgactaaccctgtcatttcagagcatggtttctaggcaactttggggctccctggagtggctgagaactggtctataagtactgttttatacccgttgtcccaacataattaatagtgtcccctttcactctcaagagtatcctggtttgccgggcatgttggttcacgcctgtaatcccagcactttgggaggccgaggcgggaggatccattgagcctgggaattcaagaccagcttgggcaacatagaaaaagaagtttaaaaaaaaaaaaaaaaaaaaaaagagtatcctggttttgatgataaagtatatggtcaccacatccacttgatgatggagttctgggaaacaaggccatacgaactgcttggcggaccaatgatcaacatacaattctcaggtctacttgatgctctgaacaagagtgctacaggactgagaatctgtgcccttctcctcctccagagccactccccaccctgcctcctcacatgcatgcacacaagcgaacacacatacccatatgtgaacacacacccacctacaacccagaggcctttttgctgttgctcgaaattgacaaactccctactgggacaagacctttgcaaaatataccccactgaccgagaccagacaatcccaatttttgcctagctaaatgttattcatcctttacatcaaggctttctttgtaccctgtccttcaatttagcagaaccttctattccctttcatagcactcatgtacttcctgattgtgtaattatttctttcatgtttgagtctttcattaacctgtaagcttcatgagggcacaatatccctagggcctcctagcacacactattcaaatatttgttgcataaacaaatggaaagccaggggcagtggctcacacctgtaatcccagcacttcaggaggccgaggcgggtggatcacttgagcccaggagttcaagatcagcctgggcaacatgctgaaatcctgtctctaaaaaaaatacaaaaattagccaggtgggatgacacatgcctgtggtcccacctactcaggaggctgaggtgggaggatcacttaagccagggaggttgaggctgcagtaagctgtgactgcacaactgcactacagtttgggcaacagagtgagaccctgtctcaaaacaaacaaacaaatggaatggggtagaacttagagatctgatgaatgtaaaaaagcttgggtttctattttcttaacacatccatgaacacgaataacaatttctgttagcaaaattaaaacttaaaaaaaaatcaaaacattgatttctaattagtatgactgccatgtgaaggctgattgccagccaaacctttgaggtatagcagcctactgaaatgtctgggtccctcaccagactaatgaagaacaagaagagagaaaaaaaggcttataagggccagtgagataatcatgtccaacaatcgggtctggcataaaaacaaggtggttctcggcagggcgtggtggctcacgcctgtaatcccagcactttgggaggccaaggtgggtggatcacctgaggtcaggagttcgagaccagcctgaacaacagggagaaaccccgtctctactaaaaatacaaaattagcagggcatggtggcgcatgcctgtaatcccagctgctcgggaggctgaagcaggagaatcgcttgaacccaggaggcggaggttgcagtgagccaagatcacgccattgcactccagcctgggcaacaagagtgaaactccatctcaaaaacaaacaaaaacaaacaaacaaaaaaacaagttagttctctacttaaatacagtttaggtctgaattaacatactgcttgccaaatacttccaatgatattcttatatattctactatctatactcgccagtacctcaatctcaaaaaaataagatgctaaattcacaagcttttttatcttttggacaataagaaaatgagcacacaaaagcattcttctgattcaggaaaacaactttgttgctaggaaaattttcttgtttggttacatatcacttatagtataacaaaacagcacagtccaatatctcattaaaaaaatattgagcccatccaccaccctgtcacaaatcagatctctcttggcagagaactccaggatctcagacaaaacaacattctgacttcaaaaaacagttcgtgatttagcacaagccagaaatcatttttttttgcattttcagacagagaaagttttatctagaatattttgtaactcattttcatacatatctgatttcagtttttattttcttaccacgtccatgaacacaaatgacaatttctttttttttttttttttttttttgagacggagtttccctctgtcacccaggctggagtgcagtggcgcaatctcagctcacgtaacctctgcctcctgggttcaaacgattctcctgcctcagcctcctgagtagctgggattacaggcgcccactactacacccagctaattattgtatttttagtgaagacagggtttcaccatgttggccaggctggtctcaagctcccgaccacaggtgatttgcctgcctcggcctacaaagtgctgggattacaagcatgagccaccgtgcctgggcacaaatgacaatttctgctagcaaaaccaaaactttttaagaaaatcaagacactgatttctaattagtatgcctgccatgtgaaggctgattgccagccagccaaacctttgaggtacagcagcctactgaaatgtctgactccctcaccagttgaattattttcaacaattacttaacttctccaaaatgcagtttcctcacttataaatggggataataatagaacccacctcaaagactcttcctgagcaaagagtttagcgccaagggccaagctcacagcaagtaagtgctcaataaacattatctatcctatatggcaggccactttattttttggatgaagaaaataaaaggtaaggataaatgacctgttaaagaccccaacacaattctagttcacttgatgaggtaggcagaataatggcccctcaaagatgtcttctatttctggaacctgtgactgttacctcacacagcaaagggaaattaaggttgcattggaattaagtttactaatcagttgcccttaaaatagggagatgatcttggattatctgggtgggcttgattcaagcataagagtgcctgcagtctaagagggaggcagaagaagaggtcagaagggggatctgcaaacgacttgctgcaggcttcgacaatagaggaaggaagctggaaacagccctcagccagcaaaacagaccttggtcctacagcctcgaggaactgagttctgtcaacaatctaaatgagcaggaaagaaattcccccctagggcctctagaaaggaacgcaaccctgctgacaccttgatttagaattggacttctgacccacagaactaagataatcatttgcactactttcaacctgtaaatttgcagtcatttattttggcagcaatggaaaactaaaacaatgacataaggattcctgactacagggtatggttccattttctatcagtggacattatcttctcaggcagaagcgaaaatgtgcagtatcacatgagtggtggttgatgactatcatgtggctagagtccagccatttcatatgttcctcacatgagataaccttatttaatcctcaaaacagctccaggaggtactatgccagttcccacagagctggagtaacttcccaaggtttcagggctagtaagaggcagaggtggggtaggagtctggtgctcccgctcctcttagtccactggacaacgctgtatcctgcccactgataccaagagtgcattcctttctaaagaggagatgacattattcaggatttctaacttttcattttggtaaataatggtgtttttaaaaagaaagaaaaaatcatttcaaaatcatttcctaatacctgtagttcttagaattttagacagcaaaaaattacaaagcacaaactcataactttatggaaaacccatcaagctgtcatttaaaaaaaatacagtggtaagaatacttaacatgacatctgccctcttggcagatttttaagtgtacaatacggtactgttatctataggcacagtgttgtgcaaggggtctgtagaacttattctctttgcttgactaaaactttgttgattaccaactccctatctctccctcccccaatccctggcaatcgccattctattctctgcctctatgagtttgactattttaaatacctcatacaagtagaatcatgcagtaattgtccttctgtgattagcttacttcaaagatgaacattttaaaactacatgacttactttcagccaaactttgccatgtttagagagccgaggaacttctaatggaggaagaaaaagcagggcatgtttactcagggtggtggctgctgcttccctttcattttcctgctgagccagcaagggcctgaataaaactattaacagctcagctttagaagttctgctcagttttcacattggtaacaggtttatgcttctttattaatttcctgccttttaaataattagtgttggccttcagcagtcattgtacaattctgtgatagtaatttgttgcattaaaaaaaagctagtgaaaaactaaaatatgatatttactgagacatactgctgtgtttagctaattataagacaactctaagctgggtgcggtggctcacgcctgtaatcccagcactttgggaggccgaggcagggggatcacctgaggccaggagttcgagaccagcctggccaacatggcgaaaccccgtctctactaaaaatacaaaaaaaaaaattagccaggcatagtagtgaatgactgtaatcccagctacttgggaggctgaggcggaagaatcgcttgaacccagaaggcggaggttgtaatgaaccaagatggcaccattacactccagcctgggcgacagagcgagactccatctcaaaaaaaaaaaaaaaaaaaagacaactctagtcgggtgcagtggctcacgcctgtagtcccagcactttgggaggctgaggcgggtggatcacttgaggtcaggagttcaggaccagcctggccaagatggtgaaaccctgtctctactaaaaatacaaaaattagccaggcgtggtggcgcacgcctgtaatcccagctactcaggagcctgaggtaggagaattgcttgaacccaggaggtggaggttgcagtgaacgcgatcgcaccactgcaccactgcactccagcctgggctacagagcaagactccatctcaaaaaaaaaaaaaaaaaaaagacaactctaaaagagccatctgtgaccctgaggactgacacccacaactgacctcctgacacccacaactggccttcatctctgatactgagaccttgggttaggactattctgaaagggtttcggattagcaatggacaatcaataaatatttcatgcttttattaagctcctagagtcaaagagtgaaaaccataatggaaaaggtcaataaatcaactacatgaagaacttcttctgatcatcaagacaccaaaactgaaaagacaagccatattgagaaaagacatctgcaaacatctggccaaaactattaatatctaggaaaaaaataaagaacccttataaatcaataagggacaaatgacccatataaaaagtggccaaaagacatgaacaggcatttcaagaagaagccaataaacctgtgaaaagatgctcaatcagggcaatgtaaatgaaaaccacgatgggaaattctgggaacatcttcacatgctagatagtgaggtaactatcacagactacttgggtcatgtcaagaggactcagagccaacttccactagcaaaatgggacagtttgaactttaataagaccaagaattacaaagcattcaaaactatcaaatatgtttaaatctataaacccgtaatgatttttaatttatttattattttaagaaacagggtcttggccaggcgcagcggctcacacctgtaatcccagcactttgggaggccgaggcgggcggatcacgaggtcaggagatcgagatcatcctggctaacacggtgaaaccccgactctattaaaaatacaaaaaattagctgggcgtggtgacgcgtgcctgtagtcccagctactcgggaggctgaggcaggagaatggtgtgaacccgggaggcagagctagcagtgagccgagatcatgccactgcactccagcctgggcgacagtgcgagactccatctcaaaaaaaagaaaagaaaagaaaagaaacagggtctcgctctgtcacccaggctggagtggagtggtacgaacacagcgctcactgcagcctcaaactcctagactcaagtgatcctcctgtctcagcctcccaaagtgctgggattacaggtgtgagccattgtgcccagcctataattatatatatatatatatacacacacacacacatatatatccatctctatataaatatatatatatatttatttatttatattatttttttgagatggagtttcactcttgttgcccaggctggagtacaacggcgggatcttggctcactgcaacctccgcctcctgggttcaagcgattctcctgcctcagcttcccgagtagctggaactacaggcatgtgccaccacgcccaatttttttgtatttttagtagagacggggtttcaccatgttagctaggatggtctcgatctcctgacctcgtgatccgcccacttcagccccccaaagtgctgagattacaggcatgagccaccgcgtctggccctatttttttgagacaaaatctcactctgtcgcccaggctggagtgcagtgacgcgatcatggctcactgcaacctctaccgcccaggttcaggtgattctccagtctcagcctcctgagtagctgggactacaggcgcgtgccaccacacctggctaattttttatttttagtagagacggggtttcaccctgttggccaggctggtctcgaactcctgacctcaggtgatccacccgcctcggcctgccaaagtgctgggattacaggcgtgagccaccgtgcctggccattatttttaaagaaaaactaacaggtgatcttctgaggaaagggaatgaattcattattttgaaactggataaataagagaaaaaaatcaagtaattatcttgtttttcctatataaactataactgggtaactagtagataagagaaggggttctttatcaaaatatttcagctaatttgagaaaatgaaacaatagaagcaaaatatcaccattttcttttctttttttttttttttgagacagagtcttgttctgtcaaccaggctggagtgaggtggcatgatcttggctcactgcaacctctgccttgcagcttcaagcaattctcctgactgagtctcctgagtagctgggactacaggcacgtgccaccatgcgcggctgattttttttttttttttttttttgagatggagtctcactctgtcgcccaggctggagtgcagtggtaggatctcagctcactgcaagctccgcctcctgggttcacgccattctcctgcctcagcctcctgagtagctgggactacaggcgcctgccaccacgcctggctaatttttttgtatttttagtagagacagggtttcaccgtcttagccaggatggtctcaatctcctgaccatgtgtggctaatttttttgtatttttagtagagctggggtttcaccatgttggccaggcaggtttcgaactcctgatctcaagtgatctaccctcctcggcctcccaaagtgttgggattacaggtgtgagccactgcgcccggccaatatcaccatttctatcccccaaagattcaatgggtctaggcattgagcatctacagctgctaaaaccaataaaaacaaagcaaaaaccagacttatgtgcctacgtggatctagagcattgccaaaaggatcaaacaggatctggttcaagtagcccgtgcatccagctgccaatgtgcagggagtacagagaacacgttaaactatagcataaatgtgtaatcagcaaaacccaaaccgttggaaactctataggtgaaatgtgccagactgttttaacagataaactgtaaggaagtcaactccaaaagatggaaggggagcctgtagattaagagagacttaaaaaaaaaaaaaaaaaaaaaaaaaagttcgggcatggtggctcacacctgtaatctcagcactttgggaggccgaggcaggtggactgcctgaggtcaggagtttgagaccagcttgtccaatatggtgaaaccccatctctactaaaaatacaaaaattaggcgggggcggtggcgtgcgcctgcagtcccagctactcgcgaggctgaggcaggaaaattgcttgaacccagaaggcagaggttgcagtgagccaacatcacgccactgcactccagcctgggcgacagagtaacactccatctcgaaaaaaaaaaaaaaaatcaaaagttgtttaaggcaagtacattattggggcaactagggaaatttgaacatgggctatatattagataacatttgtgtaaataatgaaatgccaactttcctgagtacaataacggtattgtgatcatataaatgaatgtccacgttctttggaaatacatgctgaattagatacagatggaaaatgcaatgatatctacaattaattctcaaatggttcaggaaaataaaatatactcgtgtgtatgaacaccatgcataggtgaaaagatagattatgcaaatgcagcaaatgttagtgaatctaagtgaagggtatattcattgtactagtcctgcacctgatctgtagttttgaaattttctcaaaatgaaaattgggaaataaagtaaagccacatacacatatactccatgatgaaaaactcttttaaagccatcacactggcaaaaatggtaacaattacttggcatcatctagtaaaactgaagatatgcagaccctatgaatcaggaaccctggtctagaaaaattcttcacaaattatgaagccatgctgtgttgtaatagtaatatact

SEQ ID NO: 2551 - DNA, 17098 bp, Homo sapiens
aacatgagaatgaggagttctaaggcttgtacattatctctaggtgaagggattccaggttagtttgcttgtaggatgatttcacagaagataacagaggtctggtctagtttttcctgaagaagaaagccaatttaatacattcaatactgacttctatgccatttttctgtagaaatactgatttattctatggagtttccaatgtttacctataactaaaagaaagaaaagaaaaacataagtaactgtgccagaaaaaattttgcattatgaaaattcttcagatttaaatagagaaaccaggccaggcgcggtggcccatgcctgtaatcccagcactttgggaagccgaggcgggtggatcacctgaggtcagaagttcgagaccagcctgcccaacatggtgaaaccccgtctctactaaaaatacaaaaagattggctgggcatggtggcaagtgcctgtaatcccagctacgcaggaggctgaggcaggagaatcacttgaacctaggagacagaggctgcagtgagctgagatcatgccattgcactccagcctgggcgacaagaatgaaactccatctcaaaataaataaataaatagagaaaccatagaaaatatttacatcaccattatatgaccataagaaacatgagccagagaaaactgtaattattcccattttaaagacagttaaactaagaatcagaaaggtcgagtgtggtggctcatgcctgtaatcccagcactttaggaggccgaggcaggtggatcatctgtggtcaggagttcgagaccagcctggctaacatggtgaaatcccatctttactaaaaatacaaaaaattagccgggcatggtggcgggcgcctgtaatcccagctaatcgggaggctgaggcagtagaattgcttgaacccgggaggcagaggacgcagtgaaccaagactgagccactgcactccagcctgggcaacagagcaaaactctgtctcaaaaaaaaaaaaaaaaaaaagattttgtgttccatcaacattacatatacactacattcagatcctcaattggctgtgtatctgagtgtaattaaccaactagatggatgaataaataaaaaacaaatgcctaaatggcacagtacacatcacatctgaagattaaacaactacatttccatctatctgctggaaagcatgattacatcaccctcagtttgatgtgtaattttcctcgcatcacccccatcatacttttctggaataaaatacacatatagtcaaagacatgtcaaagacaaactgagtcttctccagattgcttttttcatattttttttttttttgagatggagtcttgctctgtcacccaagctggagtgcagtggcgtgatctcggctcactgtaacctctgcctcccaggttcaagcaattctgcctcagcctcccaagtagctgggattacaggtgcccgccaccacacccagctaattttttatatttttggtagagacagggtttcaccatgttggccaggctggtctcgaactcctgacctaaagtgatctgcttgcctcagcttcccaaagtgctgggattacagccgtgagccaccacgcctggctttttttcataatttgtaatgaatatactcagcaattagagatttttttttttttttgagacggagtttcactcttgttgcccaggctggagtacagtggcgtcctctcggttcaccgcaacctccatctcccgggttcaagcaattctcctgcctcagcctcctgagtagctgggattacaggcaggcgccaccacgcccggctaattttttgtatttttagtagagatgtggtttcaccatgttgggcaggctggtctcgaactcctgacctgaggtgattcacccgcctcagcctcccaaagtgctgggattacaggtatgagccaccgtgcccggcacaattggagatttctaaatattttagaggccagtgactattcacttgatcttttaatatacaaccaaaaattcttaaacatgtaaactactagcttattttttctatctcagtttattaatctgcttttgtcttccccaggaatttgatagatttattgcattgttaaaaactaaaaactggaaacaacctatgttggtaaggattaagtagatcatggtagtccatactaggaaatcattaagcaactagagaaggaatgcgtagctctattaagtactgacagggaaatacttacacaatatgttatgtaaaacaagttcattcattcatcagcatagattaatatagtactgtctatggcaaaaaaaaaaaatgaacctaagtctaattaagccttcggatccaactataagtttatgggaaatatagagaagaaagaaaccaagagataaacagaatgatactaaatggatacattcggccacagccagaacatgagaaattctttttttcccctcccagctcaatccttgtagaaaacaggaattctaaaggacaaataagccaggtttttcaacagataaatagcaagggacaatgagggagcggaaactattacagttctaagagacctatcagtcaaacacaacaggcagatcttgtttggatcctggttcaaacgaaccaactgtaaaaagttattcatgaaacaaccaggaaaatgtgtacattgaactggatattagatgatgttaaggaattagtgcaatttctttctttctttgagacggagtctctctctgttgcccaggctgggagtgtgcagtggcacgatcttggctcactgcaacctctacctcccgggttcaagcaattctcctgcctcagcctcctgagtagtttgaactacaggcatgagccaccatgcccggccttaatttcctttttttcttttttcttttttttttgagacagagtctcactctgtcacccaggctggagtgcagtggcgtgatctcggctcactgcaacctccgcctttcgggttcaagcgattcccctgcctcggcctcccgagtagctgggactacaggcgcacgccaccatgtctggctaatttttgtatttttagtagagacagggtttcaccatattggccaggctagtctcaaactcctaacctcatgatccgcccacctcagcttcccaaagtgctgggaccacaggcgtgagccaccacgcccagccccagcctaatttcttttttttttttttttccccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaaaaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcagtagacgcagcaaagaaagcctaatttctttatgtatgataatataattacaattatatgccttcagtaagttttctgtgcagctactcagaagggtgaagtgggaggatcacctaaacccaggagttgaagtccagcctgggtaacacagcaagatcccatccccccagataaataacagtaaaaagaaagttttctgtgaacttgtaaaacaatatgtggaatatgatcccattttgtcaaaaaaccaaaaacatgcatgtatgcatgaatatattataaatgtataaataaatttatttaatttataaataaattttaaatataaataaatatatatatttgtttttgagacagggtatcactctgttgcccaggttggagtgcagtggagtgatcatggctcactgcaacctctttctcccaggctcaggagatcctcccacctcagcctccaagtaactgggactacaggtgttcgtcatcacactcagctaatttttttaattttttgtagagacagggtttcgccatattgcccaggctgttctcgaactgccagactcatataatccacctacctcagcctcccaaagtgctaggagtacaggtgtgagccactgcacccggcctatctatctatctatctatctatctatctatctatctatctatctatatttaaaagtctggaatgatataccaaactattaacaaaaattacctctggaaaaaagaataaaggggccagatgtggtggctcacacctgtaatcccagtactttgggaggctgaggcaggtggatcacctgaggtcaggagttcgagaccagcctgaccaatatgctaaaaccctgtctctactaaaaaatacaaaattagctgggcatggtggtgcatgcctgtaatcccagctacttgggaggctgaggcaggagaatgacttgaacccgggaggcctcagaggctgcagtgagcaagattgctccactgcactccagcctgggcaacaagagtgaaactctatctcaaaaaaaaaaaaaaaaaaaagaaagaaagaaaaagaaaagaataaaggataagacaagcttttttgttttgtttttgagacagagtttcactctttttgcccaggctagagtgcaatggcacgatctcggctcactgcaacctccgcctcctgggttcaagcgattctcctgcctcagcctcccaagtagctgggattacaggcaactaccaccatgcctggctttttttttttgtatttttagtagagacgggctttcaccatgttggccagggtggtctcgatctctcgacctcgtgatctgcccaccttggcctcccaaagtgctgggattacaggcgtgagccaccacacccggccaagacaagcttttaaaacagttagctaaaaacattttttacaaccaacacgaatcacttttataattaaaagctacacctcctccaataaagatctaaaaacaataaagaatgaagtcaaggttgtgtatttcagcaagctgaactctggtgcagagtatctttgaaaattgaaatggatatttacctaatttccctttattctatgtctttttcattgtccctgtacagaaatatatccattctggctgacagggatttaaaaaaagagagaaatataaccatattaaaagtcaagtctctagaggacatgtgtcactctgtggctgctcaccctccagtcatccttctaatggcacatcccatgcatatctggccccattcaccagagatactgattctggggtgccctttgccttttaccaagctccccgggtaatagtttgtatctgagaacatactgatgttgggttactgtatgaacagctatgctgtgaaagaggaactggatttgttttctgtgaccactaaggagacatatttttgcttagcagaggaaacagcttccaaaaactcagaattgtcccaggatggctgccccatagggtgagtttcccatcagtgctggtgtaaaagaaggaacatacagggtttcaggggagtctgcttgaggctgggggttgggccagataaccactctcaaattctcagtttatgtgactctttgggtctccaaaaatataaagaaagcttgaggaaaaaagacccttcaaactcagggttttcataaattttaagtaagggccatgatttacaataaatgtaacaccaattttcaaaaaattttctgattataaaatgcatactcattgcagaaaattttttaaatacagaaagttataaagaagaaaaaaatataaaaatcatcatgccactgaaagatacacactttctgtcgtatctcctggcttcatcccctctataaacatatcacactacctttttttcatttaacaataattgtgcacacgttcccatgcaattaaatactgtagaaacagaataataatattcttctttatagatataccataattaagccattttcctgtagttgaatatctaggttgcttccaaattcaattacagtcttctaattaccaggaaatcacaagtgctattatacaatttttcatatatacacaaacaatataactagtgttttgagcctctctgtaacagtcatgcattccagtgttcactgagtattagataaatacaagtgtacttactataataaagtgttgtttgaaaaaaacctaaggaataatgacacttttcaattgtttgaaatacatttgtagacaaatcccaactgtctggttctagcttgtctaaaaaacccaggtaacattagtggaacaaacacaaataagtaagtcacagcatttaagcccagaaactaaaagatggaataaaatattttcacatcaaattgaaactgttataattaattaaattaaattaattaaaaacaagtcatttcagctggcactacaatgctgaaaataatcacagaaatttcttgttttttacctgattaagatggcagagcatggagttttctacttagttccaggtgaattcttcacatttcctggcttttaaaacaaaagaaagagcttgaatgcagtttgaaaagaaatagtgcaactccttagtgtcctgagtatttggctgaacatgaacattaaaaattattatgggggacagggtcaaaccattttattgaggacttggggggttgttgaagaaaggctgaggaggacaatgagatcccacattctcgcagttaccgaccattaaatattattttactgcaaagtgatccatctgtcagtaaattgaagaagttactagggctctctgagggccctactgtagagtgacttgggcagagagagcaggaaataaagctccattaatcctcattatgcagattcagccaaacagttgattctaattaaaaaatcaatatatcttccttttatttcctgaaataaaggttttacacctatgggaaggcttcctgtaggtatttactccatgcattattcaccattatccaccataggggccaatccacaaaacatgtttactctgaaagaagttagaccacacccattctgcccagtggccctccgggaacatataattaggccatgtaatccataagaagcagtgtaggaaaagcttctagtgggaaaagttcacgtgctaaacttttaaggccttactttcttttctatacgttttttagactttaattctgaaaacacattaatagtcagagatcagatggcagtctgaaaaacaggaggctgcagctgggcgggccatgggggctaagattctgttgtatagacttggagcagtttctcctggtgcccctctttcagagttattcatggatgaaggaagaggaaaaggtgagaaagcaggagcacgtgactaaccctgtcatttcagagcatggtttctaggcaactttggggctccctggagtggctgagaactggtctataagtactgttttatacccgttgtcccaacataattaatagtgtcccctttcactctcaagagtatcctggtttgccgggcatgttggttcacgcctgtaatcccagcactttgggaggccgaggcgggaggatccattgagcctgggaattcaagaccagcttgggcaacatagaaaaagaagtttaaaaaaaaaaaaaaaaaaaaaaagagtatcctggttttgatgataaagtatatggtcaccacatccacttgatgatggagttctgggaaacaaggccatacgaactgcttggcggaccaatgatcaacatacaattctcaggtctacttgatgctctgaacaagagtgctacaggactgagaatctgtgcccttctcctcctccagagccactccccaccctgcctcctcacatgcatgcacacaagcgaacacacatacccatatgtgaacacacacccacctacaacccagaggcctttttgctgttgctcgaaattgacaaactccctactgggacaagacctttgcaaaatataccccactgaccgagaccagacaatcccaatttttgcctagctaaatgttattcatcctttacatcaaggctttctttgtaccctgtccttcaatttagcagaaccttctattccctttcatagcactcatgtacttcctgattgtgtaattatttctttcatgtttgagtctttcattaacctgtaagcttcatgagggcacaatatccctagggcctcctagcacacactattcaaatatttgttgcataaacaaatggaaagccaggggcagtggctcacacctgtaatcccagcacttcaggaggccgaggcgggtggatcacttgagcccaggagttcaagatcagcctgggcaacatgctgaaatcctgtctctaaaaaaaatacaaaaattagccaggtgggatgacacatgcctgtggtcccacctactcaggaggctgaggtgggaggatcacttaagccagggaggttgaggctgcagtaagctgtgactgcacaactgcactacagtttgggcaacagagtgagaccctgtctcaaaacaaacaaacaaatggaatggggtagaacttagagatctgatgaatgtaaaaaagcttgggtttctattttcttaacacatccatgaacacgaataacaatttctgttagcaaaattaaaacttaaaaaaaaatcaaaacattgatttctaattagtatgactgccatgtgaaggctgattgccagccaaacctttgaggtatagcagcctactgaaatgtctgggtccctcaccagactaatgaagaacaagaagagagaaaaaaaggcttataagggccagtgagataatcatgtccaacaatcgggtctggcataaaaacaaggtggttctcggcagggcgtggtggctcacgcctgtaatcccagcactttgggaggccaaggtgggtggatcacctgaggtcaggagttcgagaccagcctgaacaacagggagaaaccccgtctctactaaaaatacaaaattagcagggcatggtggcgcatgcctgtaatcccagctgctcgggaggctgaagcaggagaatcgcttgaacccaggaggcggaggttgcagtgagccaagatcacgccattgcactccagcctgggcaacaagagtgaaactccatctcaaaaacaaacaaaaacaaacaaacaaaaaaacaagttagttctctacttaaatacagtttaggtctgaattaacatactgcttgccaaatacttccaatgatattcttatatattctactatctatactcgccagtacctcaatctcaaaaaaataagatgctaaattcacaagcttttttatcttttggacaataagaaaatgagcacacaaaagcattcttctgattcaggaaaacaactttgttgctaggaaaattttcttgtttggttacatatcacttatagtataacaaaacagcacagtccaatatctcattaaaaaaatattgagcccatccaccaccctgtcacaaatcagatctctcttggcagagaactccaggatctcagacaaaacaacattctgacttcaaaaaacagttcgtgatttagcacaagccagaaatcatttttttttgcattttcagacagagaaagttttatctagaatattttgtaactcattttcatacatatctgatttcagtttttattttcttaccacgtccatgaacacaaatgacaatttctttttttttttttttttttttttgagacggagtttccctctgtcacccaggctggagtgcagtggcgcaatctcagctcacgtaacctctgcctcctgggttcaaacgattctcctgcctcagcctcctgagtagctgggattacaggcgcccactactacacccagctaattattgtatttttagtgaagacagggtttcaccatgttggccaggctggtctcaagctcccgaccacaggtgatttgcctgcctcggcctacaaagtgctgggattacaagcatgagccaccgtgcctgggcacaaatgacaatttctgctagcaaaaccaaaactttttaagaaaatcaagacactgatttctaattagtatgcctgccatgtgaaggctgattgccagccagccaaacctttgaggtacagcagcctactgaaatgtctgactccctcaccagttgaattattttcaacaattacttaacttctccaaaatgcagtttcctcacttataaatggggataataatagaacccacctcaaagactcttcctgagcaaagagtttagcgccaagggccaagctcacagcaagtaagtgctcaataaacattatctatcctatatggcaggccactttattttttggatgaagaaaataaaaggtaaggataaatgacctgttaaagaccccaacacaattctagttcacttgatgaggtaggcagaataatggcccctcaaagatgtcttctatttctggaacctgtgactgttacctcacacagcaaagggaaattaaggttgcattggaattaagtttactaatcagttgcccttaaaatagggagatgatcttggattatctgggtgggcttgattcaagcataagagtgcctgcagtctaagagggaggcagaagaagaggtcagaagggggatctgcaaacgacttgctgcaggcttcgacaatagaggaaggaagctggaaacagccctcagccagcaaaacagaccttggtcctacagcctcgaggaactgagttctgtcaacaatctaaatgagcaggaaagaaattcccccctagggcctctagaaaggaacgcaaccctgctgacaccttgatttagaattggacttctgacccacagaactaagataatcatttgcactactttcaacctgtaaatttgcagtcatttattttggcagcaatggaaaactaaaacaatgacataaggattcctgactacagggtatggttccattttctatcagtggacattatcttctcaggcagaagcgaaaatgtgcagtatcacatgagtggtggttgatgactatcatgtggctagagtccagccatttcatatgttcctcacatgagataaccttatttaatcctcaaaacagctccaggaggtactatgccagttcccacagagctggagtaacttcccaaggtttcagggctagtaagaggcagaggtggggtaggagtctggtgctcccgctcctcttagtccactggacaacgctgtatcctgcccactgataccaagagtgcattcctttctaaagaggagatgacattattcaggatttctaacttttcattttggtaaataatggtgtttttaaaaagaaagaaaaaatcatttcaaaatcatttcctaatacctgtagttcttagaattttagacagcaaaaaattacaaagcacaaactcataactttatggaaaacccatcaagctgtcatttaaaaaaaatacagtggtaagaatacttaacatgacatctgccctcttggcagatttttaagtgtacaatacggtactgttatctataggcacagtgttgtgcaaggggtctgtagaacttattctctttgcttgactaaaactttgttgattaccaactccctatctctccctcccccaatccctggcaatcgccattctattctctgcctctatgagtttgactattttaaatacctcatacaagtagaatcatgcagtaattgtccttctgtgattagcttacttcaaagatgaacattttaaaactacatgacttactttcagccaaactttgccatgtttagagagccgaggaacttctaatggaggaagaaaaagcagggcatgtttactcagggtggtggctgctgcttccctttcattttcctgctgagccagcaagggcctgaataaaactattaacagctcagctttagaagttctgctcagttttcacattggtaacaggtttatgcttctttattaatttcctgccttttaaataattagtgttggccttcagcagtcattgtacaattctgtgatagtaatttgttgcattaaaaaaaagctagtgaaaaactaaaatatgatatttactgagacatactgctgtgtttagctaattataagacaactctaagctgggtgcggtggctcacgcctgtaatcccagcactttgggaggccgaggcagggggatcacctgaggccaggagttcgagaccagcctggccaacatggcgaaaccccgtctctactaaaaatacaaaaaaaaaaattagccaggcatagtagtgaatgactgtaatcccagctacttgggaggctgaggcggaagaatcgcttgaacccagaaggcggaggttgtaatgaaccaagatggcaccattacactccagcctgggcgacagagcgagactccatctcaaaaaaaaaaaaaaaaaaaagacaactctagtcgggtgcagtggctcacgcctgtagtcccagcactttgggaggctgaggcgggtggatcacttgaggtcaggagttcaggaccagcctggccaagatggtgaaaccctgtctctactaaaaatacaaaaattagccaggcgtggtggcgcacgcctgtaatcccagctactcaggagcctgaggtaggagaattgcttgaacccaggaggtggaggttgcagtgaacgcgatcgcaccactgcaccactgcactccagcctgggctacagagcaagactccatctcaaaaaaaaaaaaaaaaaaaagacaactctaaaagagccatctgtgaccctgaggactgacacccacaactgacctcctgacacccacaactggccttcatctctgatactgagaccttgggttaggactattctgaaagggtttcggattagcaatggacaatcaataaatatttcatgcttttattaagctcctagagtcaaagagtgaaaaccataatggaaaaggtcaataaatcaactacatgaagaacttcttctgatcatcaagacaccaaaactgaaaagacaagccatattgagaaaagacatctgcaaacatctggccaaaactattaatatctaggaaaaaaataaagaacccttataaatcaataagggacaaatgacccatataaaaagtggccaaaagacatgaacaggcatttcaagaagaagccaataaacctgtgaaaagatgctcaatcagggcaatgtaaatgaaaaccacgatgggaaattctgggaacatcttcacatgctagatagtgaggtaactatcacagactacttgggtcatgtcaagaggactcagagccaacttccactagcaaaatgggacagtttgaactttaataagaccaagaattacaaagcattcaaaactatcaaatatgtttaaatctataaacccgtaatgatttttaatttatttattattttaagaaacagggtcttggccaggcgcagcggctcacacctgtaatcccagcactttgggaggccgaggcgggcggatcacgaggtcaggagatcgagatcatcctggctaacacggtgaaaccccgactctattaaaaatacaaaaaattagctgggcgtggtgacgcgtgcctgtagtcccagctactcgggaggctgaggcaggagaatggtgtgaacccgggaggcagagctagcagtgagccgagatcatgccactgcactccagcctgggcgacagtgcgagactccatctcaaaaaaaagaaaagaaaagaaaagaaacagggtctcgctctgtcacccaggctggagtggagtggtacgaacacagcgctcactgcagcctcaaactcctagactcaagtgatcctcctgtctcagcctcccaaagtgctgggattacaggtgtgagccattgtgcccagcctataattatatatatatatatatacacacacacacacatatatatccatctctatataaatatatatatatatttatttatttatattatttttttgagatggagtttcactcttgttgcccaggctggagtacaacggcgggatcttggctcactgcaacctccgcctcctgggttcaagcgattctcctgcctcagcttcccgagtagctggaactacaggcatgtgccaccacgcccaatttttttgtatttttagtagagacggggtttcaccatgttagctaggatggtctcgatctcctgacctcgtgatccgcccacttcagccccccaaagtgctgagattacaggcatgagccaccgcgtctggccctatttttttgagacaaaatctcactctgtcgcccaggctggagtgcagtgacgcgatcatggctcactgcaacctctaccgcccaggttcaggtgattctccagtctcagcctcctgagtagctgggactacaggcgcgtgccaccacacctggctaattttttatttttagtagagacggggtttcaccctgttggccaggctggtctcgaactcctgacctcaggtgatccacccgcctcggcctgccaaagtgctgggattacaggcgtgagccaccgtgcctggccattatttttaaagaaaaactaacaggtgatcttctgaggaaagggaatgaattcattattttgaaactggataaataagagaaaaaaatcaagtaattatcttgtttttcctatataaactataactgggtaactagtagataagagaaggggttctttatcaaaatatttcagctaatttgagaaaatgaaacaatagaagcaaaatatcaccattttcttttctttttttttttttttgagacagagtcttgttctgtcaaccaggctggagtgaggtggcatgatcttggctcactgcaacctctgccttgcagcttcaagcaattctcctgactgagtctcctgagtagctgggactacaggcacgtgccaccatgcgcggctgattttttttttttttttttttttgagatggagtctcactctgtcgcccaggctggagtgcagtggtaggatctcagctcactgcaagctccgcctcctgggttcacgccattctcctgcctcagcctcctgagtagctgggactacaggcgcctgccaccacgcctggctaatttttttgtatttttagtagagacagggtttcaccgtcttagccaggatggtctcaatctcctgaccatgtgtggctaatttttttgtatttttagtagagctggggtttcaccatgttggccaggcaggtttcgaactcctgatctcaagtgatctaccctcctcggcctcccaaagtgttgggattacaggtgtgagccactgcgcccggccaatatcaccatttctatcccccaaagattcaatgggtctaggcattgagcatctacagctgctaaaaccaataaaaacaaagcaaaaaccagacttatgtgcctacgtggatctagagcattgccaaaaggatcaaacaggatctggttcaagtagcccgtgcatccagctgccaatgtgcagggagtacagagaacacgttaaactatagcataaatgtgtaatcagcaaaacccaaaccgttggaaactctataggtgaaatgtgccagactgttttaacagataaactgtaaggaagtcaactccaaaagatggaaggggagcctgtagattaagagagacttaaaaaaaaaaaaaaaaaaaaaaaaaagttcgggcatggtggctcacacctgtaatctcagcactttgggaggccgaggcaggtggactgcctgaggtcaggagtttgagaccagcttgtccaatatggtgaaaccccatctctactaaaaatacaaaaattaggcgggggcggtggcgtgcgcctgcagtcccagctactcgcgaggctgaggcaggaaaattgcttgaacccagaaggcagaggttgcagtgagccaacatcacgccactgcactccagcctgggcgacagagtaacactccatctcgaaaaaaaaaaaaaaaatcaaaagttgtttaaggcaagtacattattggggcaactagggaaatttgaacatgggctatatattagataacatttgtgtaaataatgaaatgccaactttcctgagtacaataacggtattgtgatcatataaatgaatgtccacgttctttggaaatacatgctgaattagatacagatggaaaatgcaatgatatctacaattaattctcaaatggttcaggaaaataaaatatactcgtgtgtatgaacaccatgcataggtgaaaagatagattatgcaaatgcagcaaatgttagtgaatctaagtgaagggtatattcattgtactagtcctgcacctgatctgtagttttgaaattttctcaaaatgaaaattgggaaataaagtaaagccacatacacatatactccatgatgaaaaactcttttaaagccatcacactggcaaaaatggtaacaattacttggcatcatctagtaaaactgaagatatgcagaccctatgaatcaggaaccctggtctagaaaaattcttcacaaattatgaagccatgctgtgttgtaatagtaatatact

SEQ ID NO: 2552 - DNA, 15372 bp, Homo sapiens
aaaagagagagagagagagagagaagttatttagaactaacagtatgcaaggcactgtgctggctgctaatgggagacacaaaggaatgcaaagtcatgaccctccagaggattataacctcagcggaaagacagacaggtgtacaagcagctatgatacaaggcaaatggaggtaatgctttaaaagagctagacaggggaaggagatgttacctctagtgggaaattttagatgacttcatgacaatgttgtgctctggccataaaggaaacataagacttctttttttctttctttcttttttttttttttgagacagagtctcgctctgtcacccaggctggagtggagtgtcgtgatctcagctcactgcaagctccacctcccgggttcacaccattttcctgcctcagcctcccgagtagctgggactacaggcgcctgccagcacgcccggctaattttttatatttttagtagagatggggtttcaccgtgttagccaggatggtctcgatctcttgaccatgtgatccgcccgcctcaggctcccaaagtgctgggattacaggcgtgagccaccctgcccggcccataagatttctttaataagagatgcagcaaagaacattctaggaagacattattacattatagaggcatgagagggtatagtcttgtctgcctcactctcagattcataaaccatgggaggggcctaggaatctgcattattaacaagctccctaggagattctgatggaggggttctgcaaactgcactctaagactgatatagaatatctaccaagaaatagagtagggaagagcaggaacaaggtatagtgtgaaagctataggcttgatgataataaaatgagaaagcaagtctaagcttgtggcaaagagtcaatgtaattttcagtgtaaggcaatgagtgccttgctatgacaatgttatatatttacaattaggtgaaatagatccatttgcataaaattcaaaaactggcaaaattaatctatggtattagaaatcacgataatgcttatccatgggggtagcacggagagactgaaaaggggcagaagggggcctctgaggtatcatcaaggttctgtttttaatctaagtgctggttaaagggatgtgttcagtttgtgcaaattcatctagctgcacctttatattaggcatgcttttctactgaagtatattatacttcagtaagaagttataaaaattaggctgagtaggtgtatttcaactaaaagaaaacatcctataattgttatcttattaatctcagaaaatttcataataacttaatacctctttcaattctctgaaagttatataaatgtgataaaatagaatataagaggaatgttctaaaacatttttcagatcattctaatggggaaaataacttcttaaagcttccttgctaacacttaaatcccatcagattgaaatttcttattctaaagttaccatccttgagtctattatttatcctcactgtctcagcttgctgtgccccttcacagtaaaacttcttgaaaaagttgtctataatctttgtatctattttcccaccttatattatttactcagcctactcctctggaccttccatatccatcattctgttcaaattgctcttgtccagatcaccaaaaaattatatgttgccaaatccaatagtcacttatcttttcattatactgagcccctcataacatgctggttattaattactccctcccttcaacactctttttgtatctttcatattgccacactctcttgattcccctcctaattcttggtattctatattggatgtccctcttctgttccacttctaaacatctgagtgtctcagggcttgatcttgagactatttatgttctcctggaggtctctagcgccatggctctagacagatccttaatgtgcatctgccagccctaagctcttctctaaaatccacatttatattcagtttcctagggtctctaataagcatccccaaactagcatgtccaaataaagattcttgatactttttgaacaaatctgctcttactttataatattctacatctcaataaatggtaataccctcatcataattattcaagttaaacattaaagagttaacactgatttatttttttctcctaccaattaagccttgttgactacaaatctgaaatcagtcgcttcaatctctccagtacaatcgtccttgtccaagccactatcatctctcacacggactactcaattaatgactggtctttttattccactttcaccccctacattccgttttcgataagccagtcaaagtgaagctaatactctccaatcacttgccaccataattacaataaaatctaaacaatttataaaaacgaacaagtctttatatgagctggccattgcctacttctccaactcactcatcctcaatgtcttagccatattggcttattgttgttgttgccccatgaatatgttaacttgtctttacaccaaacactatgcattagtggtactcctgcctagaatactgttccttttgattgttattataggagatcaatatataccactccaaaatatggcactttgacataaagattacttttagttagaggcaagtaagaatcaatataagcaaaaagaagccttcccagtgcttcccttgtctaaataaaagcagaaacttctgagaaatgataactgctataagccctctctcctgggaaattgttatggccatgaagaatacgaaaagttgatctcaagatagacttggcataaacaaactatactccatgtttctcccatatatttaccttcctacagtttggcaaccctaaatacctaaaccccttttttctttgttttgtcatttctctacaagtttactgttctttgttcagatgctatataaacccaacattctaaccacccctttgagttactcatcactgagtttctaccaggtgtatgtgcactgaatattttaataaacttctaggcttttcctcttgttaatctgtcttttgtcactctaactttgtaggactccagctgggcagcctagaagggtagaaggaacatatttttcttcccctacatcacagagctggccccttcttgtcattcagatctctgtttaaataacatggctcagaaaaaaatgtccttgcttgggcctggtgggtcacgcctgtaaatcccagcactttgggaggctgaggcgggtggatcgcttgaggtcagaagtttgagaccagcctgggcaacatggtcaaaccccatctctactaaaaatacaaaaatcagctgggcctggtggtgcatgcctctagtcccagttatttgggaggcggaggcacacgaaaagcttgaacatgggaggcagaggttgcagtgagctgagattgcaccactgcgctccagcctgggcaacagagcaagactccgaaaggcagaaagaaaaagaaagaaaagaaagaaaaagaaaaagaaaaaaaagaaagagggagggaggggaaaaaaaaagaaaaaaatgtcctagatattctgaaccaaagtggtcatcctgtcacaatctgtaattttaccccattttaaagtctctttatgtatattttctagttattttgttttctgtctcctgtgagagaatgtaatatccatgtcgatacaaatcatatcttgattgttaattgctgaaatcccagtgcgcccaaaattgcacgtcctgtaataggtgtttgataaacttttgttgaattctgaatgttaaaccctttgacaagtgacctgacatgatgaataaaaacttatagggtttaaggattaaaaaatttccataaagaattgtttacttaattcacaatggctaggacttgccaatgggtatagaggccaccagaaactggtgaactattttttaaaatctcataatataagaggaatcatattattaactggccactattctgagttttgaaaaacattttacaactttaaaaaatgattcaaataaagcaaggagacgagtaatgcaagtaatgccaagtatgacttgtgtttatctaataatggactttgttacttatagccacatggaattttagggctgcaaacaacaaggagaggcacctccttctgtaatcacagtgttgctataattacagacaaaggtttgtcagcatttccattaaaagaacttaactaagctgttaaatgtccattagcctaatatatggcttataatatcttagctaactgcatattaaaaacagctaattaaaaatggatggatttttaaataaagttatgtaaatacccagaagaaatcagctctttaagtgtgcacatttctataacaatataagtgcaagctttttttccccagtatttgaattgtctatttatatgcattatttttaaaacttaacctaaaatgttctggaaagggattacataacaataagcacaatgttgtcataagaaggaagaatgaacggcttgactactgtgatggacgctgatgaactactcagatttcccttcaataaagaacttgtcccagcaggtggaagggctggtggcagacagccttcagctctcagttttaggggtggtcccagccatgaagagcccccttgcacaaggtcatgacttatttctgagaaggctatcatccaatgactgattaatgcaggagtagtaaggctcactgttctcaggactactctgaagggtcattcgaagctctgaagcttcccatatgtttggtcaattgggaaacagctctatggaggtgcccaatgatattataagtatccacataggccacatacacaaagttcaactgcagattgacccacgtcttgacaaatgctctgtgatccttccaacatgggaagataggcagtcttgagaggaagtctaccaaggcaatattccacccacctctgtatctttagggaagtcccttaccttgtgggaggtggcgatagaacatttctcatctgcctttctggttatggtgagacatatgatgttccatctcagctccccttaaagtacagctgcagagtataaaactgcttaattgcatgacgaaattggcttctcaacaacagagtgcacactgcttgtgttgcatgtcatctggtctctttaattttggtatcatactgtgggacaagtgacacaggaaactgacaccatgctgatcatacttttgatgcctataaaactgtttgggttgactgtctcattaactgctgaatctctcagcctgcttaacactaaggctgttattgggcctgcattacagctcaacttctctttctgtccaatcctgcttctaagccctctcttgaatatgtattggtccagtgggcattccctgataagtattctgcatattaaactttattttagagtctggccgggcgtagtggctcacgcctgtaatcccagcactttgggaggcagaagtgggtggatcacctgaggtcgggtgtttgagaccagcctgaccaacatgatgaaaccccgtctctactaaaaatacaaaattagccaggcgtggtagtacttgcctgtaatcccagatacttgggagtttgaggcagaagaatcacttgaacccataaggcggaaattacagtgagacgagattgtgccattacactccaacatggacaacgagagcaaaattctgtctaaaataataataataataataataacaacaaataaagtaaaaataaaaatgttttagagtctgtttcccagagaacccaacctgtaacacctacttagtatgtcaaagcaaccaaggaagtcaagggctgtattatttctctttttatttggctgtcaggagttgtgtttattactctatctgaggagcccagagtgattttacgtacacgatctctttttgcagtttcatattacatgttcttagttgctttaactagatgactgctgagcaggcatctaggccatctccactgaagtcgtgcaacctcttccaatacaactccagcaggcagccaggtttggaagtactctattccattacatctaaaaagtatgccttttgttttcgagacaggatctcactctgtcacccaggctggagtgcagtggcaggagggagcacagctcaccatagacttgacctcatgggctcaaacgattctcccatctcagcctcctgagtagctggggctacaggggcacactacctcgcccggctatctatctatctatctatctatctatctatctatctatctatctattttgtagagatgaggcctattttactcaggctggtcttgaactgctagcctcaagcgatccttacaccacagccccccagtgttgggattactagtgtgaggcactgcacctggccattatttccttttgttatttccactcatttgttttattgctccctttctgagcaaagatgatgctttaacatcctttgtaaaaaacagcctttgaggttaacatacatctacttctcagttttcctacaactagatttttctaccccatggagaaatagtctcaattacaactagtcctaagatcagctctttggggctatttgattattcaaaagtcctatgtaaattgaagacctaaaggataaaaagatccctcccaaccatacctcccctacatgtgtgatgaaagcttcagctgagctagatggcccctttaatggtgtttttaatttatacctgctcttgatggaagagaaaataaaggagttctccaaagggatttaggcgtgggagtcaatattagatccaaagcaagggtcattctgttcctatgtttctaagggctttctcatttactcaatctaataatttttaagcacctcttattgtcctagctaacaccctggatgaaatggtcagaaagcactacatgtatttgacctcagacaagtaatagaaagcctattctgactttttaaataacatttcaagaagtcctgcataactcctttctattattttatgaacatagtccatggaggcttccaactagcaacccgtgaacttaacctaaggcttctatttaatgagtctgatagccacctgaataaaaaatcttttttttttttctttttttgagatggagtctggctctgtcgcccaggctggagtggagtggcaggatctcggctaccgggttcaagtgattctcctgcctcagcctcccgagtagctgggactaccggcacatgccactacgcccggctgattttttgtatttgtagtagaggtgggttttcaccgtgttagccaggatggtctctatctcctgacctcatgatccgcctgcctcggcctcccaaagtgctgggattacaggcgtgagccaccatgcctggccctgaatcaaaaatcttttgcgtagataaggaaaaaaaaatcaacagtgttgtataaggggctcatagccacttcatggattgaggtagcttacaaagcaaaataacagggaagtgccacaaaacaattcaatacactactggattctttgaaccaaaaccttgaaaacagcacaaatctgttccagtacttgggagatcaaccattgaaaattaacatttcatttacaacttctgcctgctcttctgttctagcctcctcttctgttctagcctgctcttctgtggctgttcatcgcagccacatttgtaggtttaaatgttcagattgcctagaaagctttgcatatgcaaatatatgcataatcatctggttatgctttctatcagactcataaacctgctttattctctccagcatttttcttctaatatttcataaatagggctgtaacctcaaccttaaattccaaatattctgaattttctttttgtctataattgtattttgtcaagatttttttttactaatatttaaaatgaactttaaatgtttctgaattttaatattgaaacctcaaatcctcacacactcaccttaggtaagtaaaaaagctttagagcttgagttagtaagaaggacttagtcaaggaaagagacaatacagtgagtgagtgagtgtgtgtttgtgtatgtgcctgtgtgtgtgttgaggggtcatttgtgtattgcacatgacatcgagaagtgagggatgtgaaaaccaagatgtttccttcctgaggccgtgtgacctgattcagagctgcatctcattcacctcttaggtccctggttggagtgcctttttcaaatgtctctgcccaaagtgagggacatcttttattaaaccatcaagtcaaaacgagtgatctttctaatacatacaaagactcaggatatgccatatacagacatgcaaatgaccaaggcctattttcaagcattattactaaaataattatttgggataaaacttaataaacacaagtagtatctgctttatagatagatgatggtgccaaattgaatatgaatatcagttgtttgcaatagggaacatattttccacataagcattggatacttagtagctcagttgccaattacactgccgactctaacttaagctatctaatgaggacaacagacctgctattgggattacggaattcaggaaacagtaaattcactctgagagcaattgagatcctctgaaatggggtctcggaaggcggggaattaataacagggcctttgagtatggcctcacaagttgtaaattgcttccagaggcactgagctgagaggcgcagagaagctgaaatcttcaagccacgaaacctggccccgggctctatctgcccagtaaaaggaccactgttttccttctctcaagggatccacatgggttagcacgtgtcttaagtgtttgggttatcatgctgactgtacactcttgaaaggcaagccaaattattccttcctagacaaaagcaagaaatatatgaagaaaaaagaaaacaacttgagaggtgagatacttgccacaagtttggatggacaacccttgtaaattgagcattcattgcagcatccatgcttattttaagtgtaagttatatacacacacacaaacacatatgtatatgcatatgtatgtatgcatacatatacacatatttatttttatttaaataattttttatttgtatgaatgtaaggggtacaagtgcaattttattatgtgagtatgttggatagtggtgaactttggatttttagtgtatccatcacccaaattatgtacattgtagccattaatttatcactgattcccttgcacacccccacacttcagtctccaatgcttatcactacacactctatgtccatgtgtacatgtttatacattatttgtctttcacttataagtgagaacatggggtatctttctgcttctgagttgtttcatatatatatatacacacacacatatatgtatatatgtgtatatatatacgtatatatatacacatatatacgtatatatatgtgtgtatatatacgtatatatacacacgcgtatatatatacgtatatatacacacgcgtatatatatacacatacactgatattgatggcttttctctagaaaaagtataaatctctatatttatcaaactgtgcatttacgatatctggcaatatcttatctactaaatcaaaatgtatacaatgtgccccaatatttagcaatctcagttctgggtatacacccatgtgaaatgtgtaaattcttataccaaaagacatgtaatagaatatatgtctgcaacagcactatttgtaatagctaagttatcaataaaactgttatatttaccctatggaatattatgcagcccataaaatgattgtttaataactacacacaagagaatagctgatacacaaatacaatgcactaagaagccagacattaaagagcatatattgtataattcagcaaaaatatagtagggcaaaaccaatctatgctgtcacagatcagatcggtgattactcttgggagactaatgattgcaaagaggaaccaggggtactgttttgttttctttcttgaagtggatgctgattacatgactggctttagattttgaggcatatacttgtgatacgtgcactttttattgtatatgcacttttataaaattatttaaaatagagtacagatctctaaaatgttagcataccatagttttcatctttttgctactgctatgaaccacatccagagtaaggtgtttcacgcatattatctttaattcacacaatatggattgtatggcctgtctggtcaggatgattaccctcattgcacaagtgatccagcctttgacgcaaaaaactgaatacattaattggcattcatcctttgttgttgggtgggggggaagaagcacaatcatcatcactgtggatgtgttcatgatatgaattgtcactccaagtttccttgatgctttaggagtataaagatgatgtagctgcttgaggccactcatcctagaagcagtctggagaggcatgtgacagtagatgctaattgacattcttatttgtctgtgtcaacaatctaattaaggttttttcctgcctagtagattggtctcattttaattcacagtaccaaaaaagaaacacttccaggtaaatagaacaaaaaaagtcttccgaagaaaaagaaaaagtacaaaaaccaacttaaatggcctggagctccaaaagtactttgttgacaaagaattctgtgaacacgtcatatatattattgactaaaaaacctgcaaagttcagcacaatgctctgatccctagatattttattttatagtctacacactgttaaggtttttgatgttaagaattgaaacgagagtagtatccttataaagcattcttgcctatcttaaccaccactccctttctaatgactaggaaagagtataatgtaaaataaaaaattgattcaaaattttcgagcatgaaaaaattatcatgagggaattcttctccttaacttatccactgatgtagaaacgtacatgtaattgagaaaaataataaaatggatgttgacggtatttcccagaagaattaacaaatttgaaattaagtgagtaaagctgttattcagtcattatttcagggtcttttctcaagcctctgaagtacatgtgggaaaatgctacataaacgtagcagaaatgttaatttctgcagcttattaagttagttattagcctataattcaagatctttgagtatcattaaaggacccgcacaggtacatcattttaatgacttatgtgagaaaatagatatataaaaataggaacatgatctggacgttaagaaataattttgaggttctccttactgatacatcgtgttgtgcgttggaatttttgccctgatattgacccgctagtccgagtcaatcagacctggaattctcctgatgactggttctagactaagagcagtctcatgtcctaaattggctcaaatggattgaagagacatattccaacgaggtggaagaggttttctctctcttcagcttgtagcttaaaagccaatctatgactacaggaggaataaaacttaggaattcacgagcataaagagtaaggccagtaatcaaggcatccctatacttggcaaacctggccactctgaggcttctctttggaggattccacctctgctacatctagacaatgactcagtgttatttctggatataaggcactgctgggaacacacagatgaatctgacatgaattctataatgagtttctcaggagaataatgaattttggtaatgggaaatgaaagtggggaaatgtactgtatgttatggacttgaccttcgtctataatatgggtgtctgccactcgttcaacaatccattagcaaatcatttaacttaaaaatattttatccatatgttaaattgggctactaaaacatataatgaaagggcatatagagctatgggcttctttaaggaaatacaataacagctaatattcctaggagctttatgcatatcaggcactgtgctaaacactgaataagcaatttcttaaccttcacatgaaccccatgagatagacatggttttcccccattttacagttgacgaaatagaagagatttcagccacttgttcgaggtcatttgttcaaggtcagacaggttccacggtggaacctggaaagtaatctcagatagtttctcaaattgaagctctcaaccaggaactctttttacctccagcatatattcagacatggcataagcagaggacagaggctgttctatgaagcgatgactaaaaaaaaaaaaaaaagtacaaatatttatttttgccatcataagctaaataagtgggctttcctaagtagtttcgtaataggagaaaagctgatgaataatgagatagaagggttggtgttgaggcagaggggctttggagactaaagcaaatatttaaatgaaaatagctctgaagtgtgtgtgtgtgtgtgtgtgtgtgtgtgtgtgaaaacagaagttccataattaataatctactatgtgccaaatactgccatgcacaatcactacaaaagtgaatggccttgatcctttccttttactacagagaatgacacatataaataaaccatgtcaatctgctacgacaagcgctaagattgaagttcattgagtgttcagtccgagccctaaaagaaactactgattgccacatgtatgtaaaggcaagcaagacaaggtttcctggatgagatgaggcctaggctgaaacatgaactgaaaaatgtgtttttctggagatccattcaatacgctatatttaggtatccctttgcttaaagacaaagtatttgttattggaattgatgtgtagtaaaatccgctccttttgaagtaaagttctgtgagttctgacaagggcttagtcgtgtagccatcatcgcaggcaagacacagaacagcttcatcaccccccaaaatgctcttgtgctgtccttacccccatctcacctcctcagaagcaatctcttttaacccttctactctgtggtgtattgtactgaaaataagatacgtttattttataacttttaaattaggttcaggggtacacgtgcaggtttgctatacaggtgaactgcattttgcgggggtttggtgtaaagattattttctcacgcaggtactaaacatagtacccaataattatttttcctgatcttctccctccacttgtgttccaccctccagtaggccccagtgtgtgttattcccctctttgtgtccatatgttctcatcatttagcttccatttataagtgagaacacgcagtatttggttttctgtttccatataagtttgctaaggataatggccactggctccatccatgtcgctgcaaaggacatgatctcattctttttcatggccacatagtattccatggtgtatatgtaccacattttctttattcagtctgttcattgataggcatttaagttgaatccatgtctttgctattgtgagtagtgttgcaatgaacatacacaacgtgcatatgtctttatggtagaatgatttctattcctctgggtatatgcccaataatgggattgctgggtcaaatggtaattcttttgtaagttatttgagaaatcaccacactgctttcaacgaccgaactaatttacgttcccaccagcagtgtgttaagtgttcctattaagagattattaaatccctatccttctaggaagttatttgaagtagtcaagaactacacagagatcactgagacaaagatttgaagaacaattggaatcttacagctagctactatcagaaataacaacccgtagtaaatattatgtagttaataattttctacttacattatgtttaatgagtcctcatcaagaaaccatgagtaacataaagttaataaacagagatgacatgatagaatctccaagaagttgaatcagagattaccttcaaagtttaccagaacaaatcaacagaaattgcatagaattagaaagctctagaagtccattaggaggggagttagaataccttcagagaaaaacaaacaggaaaagtgaaatttaactatctaaggaaaatgtgtgaaagacatatttaaatccctgtcactaacaaagctgaaggaagagtgtcttcagattacaggtgtttcttctacctacatgaaaacctgggaaatgggcaagtgaagagcacagatttatctctgaagaaagaaccctcccaccttacagctactagagtggtcaacccacttttaaggtggggattattcgtcagcgttatccacagcctcagggaaatactcctcaaagacatctcattccttgctccattgcttctgatcatgaagtccgtttcatgatcatcgctctctaattctaaaacttctaaccatgagataagtttctaagttaccctcacacactcaggtatccagtttctgaaaaggtagtacaagtaatgtgaatgaaagagtattccggtttggatatgattctgaattttgggttttttttttctgctgggacaatccaatctaggtgagccaacccaatgctgagggacagaccctggttaaaggagatgcttcaacacaggccatcctatgaggtgctgtctgagaggccagtcaacctctctgaaagctctgctcatgtgtttaattttcagcaacggatattgcaagagaaaagcatgctctgtcattttcctatgattagacaactaataaataagccagctctggcttaaatgtagcacttttaactcaggccatgcccatttttttatgccacacatcttctcaggcacagcgggaacacacttgcggcgtagcagcagcagatgatttttttcaaagaagagaagagaagacacctttggcaaaacagtgctgataaactaatagtcaggagctttgacagaatgttaaagaaaagctgattttcttcgatttttttcaggacaacatctctgttatccttgaattgaattcttattccacacatcaaaatccatatctaagaaacaccagagaattcttccagatacatagaaacttatatatttttttcagtgataagcagtttgattataaaagatataaaacatgactgataaaaaagcatggcttagatgttgagtaaatattgtagctaaatcctgaaagctcaacatcaataaataatggaagctttaga

SEQ ID NO: 2553 - DNA, 6261 bp, Homo sapiens
aagcaaggaggtcgattagaaaaatctggtgagaaaggcttcctctggagaggctggagcgctctgcgtggctctaacttctccccatctgaagccaagtaatagagacggggtagtttacatgagctgtaaacctggccatatgtttgcagagatttgcatgctataggaaccatacactcaagtgacaggagaggcttcttgggataaactacatgtctgctgctttaacctaaaggcatttatcaagggcaaaaatttgagtaaactactaagtttgcaggaggttttgctttgggaggagtgtactccttgcaggtcgccgggcttcaaaaatcctgagaacatgctcaagagggactttgctgaggtcaaggacataggcatactatttacggaggtgagcagaacaaacaaatattggagaaatatttgtagaagaatcttctgcattccacaaatattgcaagcaagcacggggccccctaacaaacagggttttgtaaaggaatcaaaaagcagtgtagaacaacagaagctgtttgggggatttcataatctcacccagagaaaattcaacctttggtggctttcccctggtgtgtatgtgctacatttcctgtccttctcagttctgggaattaacccactaagctgccagcaccaacttacttgtgctcttctgataaatgctcaaattttgaaaattcaatattttaaatttccccaactgttaagtccttcgagatgacaaggcatagtggcagttattgcaatgacattttcatcaaatgatgcactctttttccagtttctataaaagtggcagagaaaggtcatcctggtaagtcaaaatcaccgaacttcatcatatcaaagagggtaagtgcactgaaagggctatttgcatggaacccttgtctaacagtaaggcaatttctgaaggtcttaggggttagaacaacttccatggtgtatctcttccgtctctaaatactattaataataactatcaaagtcagcattaagggggaaaatgatataaaggcagcctgagagatgtgcgcaggtggaaccagcttcacgtttgtgcaacctgagcagttgcacagggccctgagcgcagaagaaacacatgcctctattatctgctgatactatcctgaaattgtaaataattttatttttgaatttgtgttttagaagtgaagtcctatgtgcaatgaaggatgcacatgcgcagaggagacaggtggtataatatgtgtatctgtcctatttgcatatagcattttcaatgccctagaagcacagaagtctggtgagctcacagtaagtttagtaagattcaaagaatatggcgtaagtgtgttatgtctataactgagtaaacaaggttgctggcagccctgggagataatgcttcctatctgaaccagaccctgcttcaaatgcagcaagaaggcaattttttcaagaaaatacaaacgaccaagaaaccctatcatatcctttcctactcctgttatgttcctatatgaaccaaccacttatgctgaaattgatgatatagaaagaaagggaatcttgtgactttgggagttacctagccctgcataagccttagtttctgcttctgtaaaatgggaacaataatacttccataataagattgtggtaagaattaaagagtgcataatgcacttcacagagtgaccttgtataacaactaaataaagtatgttacggctgtaattattatcaaattcctctgcatatataagaagtgttttgaagcataaattgccccaagattaccttcttaagtcactgttcaggtttcaggagatggaaaattattgtcgaaaatacgcccccaaaaatgtgtaagagcaaacattatttaactctttttgaaatctgaaccttaacctagctcgtatttaagagttcttaaaaatcattaactatcttgagttcaaataatcttctccaaacgaagcattgtaaacagcactaatactcaagtaacacaatactttacactgtgcaatttgaatcaaaatattaaacactttatgatttattgatatttacacaggattgaattttggaagaaaatattaaaaggtgtatacttatactcaaggacatgacatctagtactcaaattctgaacctaaatattttgtctgaggatgtgcataaaacaaaaacatttcaaagacagccttcttaaagataaattcaaatctgaataagctatgcaaaattttatatttatatccatcaattcaactatatatatacagaattataatcaaaatttgaatttaagatctgagtaattatttgtctagatagactattgtttttcaaattgtaagtcagaatccattcatggttcataaaatcatgttagtaggttatgactaggaatattttaaaattaaacagaaaaatagtagtctgtgtcacttatataatactaacaattattgtctcaatttttgtttcagatgtgcatatgggtttattttgatatgtatatgtatatatgttctaaggtgagattaaacttttttctgcagtttgtaaaacaaaattggaaatggctctagaatttcagactaagcaaaccgacgaaaaaagaaatttgcctgaattctacatttgtatattttccatagagaccttggaataaaagacattttaaaataaaacgatgtttaatctgagaatttggaaataaagatataaaaagtggcttatgctttgtttcagcaccccaaaatatgtttttatcatcacagaattttacattgtacctaagattggagatcacttcatacatgtcatggcatcaaatgaagagattttctaggaaagttggtttttgttctttatagatctatttataagaaagatagaccccaatcgtttcatgaatgaagatgccagtatcatcaactggaactaattatttttcctatgcttcaatcctattttgtctttatcacagtagtttatgtttctcttcagtacattgggcaaataatgattacgatgagaggcatgacagtgaatggatgaaacgattctgtttttgttttttttttttcccccaaaattgagtacactcaaatttattcaacgttatccacagacttcagaggcttaattactgcctgttagatttaggaagtattagatattgtcacctatgttccttgaagacatcgctcattaaaaaaggtggaagaggccgggtgcggtggctcagacctgtaatcccagcactttgggaggctgaggcaggcggatcacgaggtcaggagatcgagaccatcttcgctaacatggttaaaccccgtctctactaaaaatacaaaaaattagccgggcgcggtggcggcgcctgtagtcccagttactcgggaggctgaggtaggaggagaaaggcgtgaacccgggaggcggagcttgcagtgagccgagaaagcgccactgcactccggcctgggcaaaacagcaagactccgtctcttttaaaaaaaaaaaaaaaaaaaaaaaaggtgaaagagcagaaaggagaaaggtaaaaaaatcagggatgataaatgactgttttagtccagcaatgtctagaaaaatctctagacactcatttctggagacaatttctagtcataatttctactcgtagaatttctctgactagaaatggttctaatgaagtatacagcaatagccttgatacttctgaatatataaatatattttaaaatccagtttactatctgtctgatcttgggtatttaacctctctgcatctcagttaccccatctataaaacaagaaaaataaaaatatacgtacgtaaggctgctggaaagattagatgagatagtgcatataaaatgctaagcacattctagatcccaagaaatgctctgcaatgcctgtgtttgggggccaaagttcattgaaatgataaatgatttttatggggaaacaggtgaatgagctctgtgtgtttctggaagcatgatttgggcaattcaaactgagataagtaatcaagtggctacatgtaggtagtgaaaccagcagcccagcaaaccacaaagctcttagaaaaaatagctgggacactatgagagggcacagtctatcactgagcagttttatatcactgataaaatggattttggcaatttatctaaattcagccttaaagtatgatacgactgttaacctggatcaaaaacagttttattggtcttgaatgcataaatgcttcaagaacatttgcaaattttatcattctcagttcatttaaatgtatcatacttctttttcatggagtctaagtcaatgcatggatggtgaattttttggtgtattctataatctttttacccctcagtaaaagattatttccaagataaaggattacagagggataaccaagcggttctttcactaaataacagaagagcatttctgaacaaccaggattagtacctggaaatattcttgacacatttccgctgtgttttctcacagatataacacgtaaaccaaggtactattcaaagcataaaaatgattactgaagtgatttatgagaaattaatccatcatgcaacactgtacatgacattcaacctaatgacactattaaataggtaatttttaatatagatagggcctgaaattgagttcaaagttaagccctaatgaggatttaggaaaaatcatggcctgctgttagggcaacaatcaacaacaaatacaactactaccgcatatacaacagcaataacaacagctgccattatttattgagtacttagtgtcagtcaatttgctaatcacttaacacgcattatatcatttttcactacaacagatcagggtgatagaaattagtaggatgaggaaatggaaatagaaaaattagatgacttgccaaaggtcacaaaggtaactggtggttctgggacttaaaaccaggttgtttggattccaaaacacgtctttatcccaatatgatcaatctctttaaatgaagaaaatgaattaagagtctaagcaacagcacttttaaaaaaatataatataactttttttttttctgtttttttgagattgagtattgctcttcctgcccaggctggagtgcaatggtgggatctcggctcactgcagcctctcccttctgggttcaagccattctcctgcctcagcctcccgagtagctgggattacaggcacaagccaccacaccgggctaatttttatatttttaatagagacagggtttcaacacgttggccaggctggtctcaaactcctgacctcaggtcatccgcccacctcagcctcccaaagtgctgggattacaggtgtgagccacggtgtccggccctcacgtaacttcttaaaaataagtcaaagtgtattttttcttaatttccacaaattcaatcaatggtttggaagctactaggaaaatacctcgtcttcattacgttgctgagtaggaaatcaaatgtcaagtctaaataatgcacgcaagtcacagacactgatatcacactgaggaagataccagaataccagaaagacagcaatgggacacagcccagatggtagtacagacccggtaaatcctccattatccatgatgtccttatttcacactgcatgtctgtatcaaaacatctcatgtaccccataaatacatacacctactacgtagccacaaaaatttaaaacataattttaacagttttttaaaaacataaacagaaaaagaagtcagaagaagctgagcaaaaaataaagctaacaaattctttctaaaagaaggcatgtgtcaagtccaccattcgaactctgcgccttctgttaatccctatgatttgcctttgatgttaaatgtcagcaaatttaacattcttcactattgcagaaccactcacagaaatgctacattgtgcctccgatgctccagttaagaagacaaaaatgggtatcatacgtacacatatggggtattttagtttttaaaaatctcattctatagcctattaaacaaaaggttctagagccaaaaacattaatctttttttttatactttaaatactagggtacatgtgcacaacgttcaggtttgttacatatgtatacatgtgccatgatggtgtgctacacccattaactcgtcatttaacatcaggtatatctcctaa

SEQ ID NO: 2554 - DNA, 23004 bp, Homo sapiens
acacccctatagtcccagctgctcaggaggttgagacaggagaatcgcttgaacccaggaggcggaggttgcattgagccgagatcatgccactgcactccagcctgagtgacagagcaagactccatctcacaaaaaagaaaaaaagaaataatgtatacatatttagaaaataagataatacacccaattgattaaattatgattttcatctgtaaatgttcctatgccttcagatgtttattttaggactgtggccgacttggttctaaagaagatggatcaccaggtcattacagggctttccttcacaattagaaactaaatataagactcaacccagagtaatttcagaaaaaaaataaaataccaatataaggtgtattgtcaaagataattgtgctcctgcagcttttctgtgtataatagactcttccttccttgtagcagcttgcctagattgtgaaaaacatggtgtttgacccttagaaaggtcaaagacttatataagatatatatgtatatatgagcatatgtatgtgtgatatatatatatatcacactgatatctatatatgtacatatatcagtgtgggaaggaaatggaggaatagaatgttaattggaacaagactagtagtagctgattagttcttcattccactaaacataacgatgggcaaatatctagctgctttaagtcttattttataaattgaatatcaaatactaaagaaaaaatacattttcacagccaggaaaaacatagaatttttttcaaatttcaaaatgccaagtaaaacttgagaggaaataccgagcaaataaggaactttgtcccaaggtatggaaacattgacaaaactattaccagttatagctgacctttactgggtaaaacctggataaacaggaaaaactttaagagaaaagtcttcttcagtgggtcaaatcccatggttttcatgaactgggcggactgctacagggcaggaagagtttactacacagagaaaagttgtgggaacacaattatctttgaagaactcttgggccagtgtaggccccgtggtgccagttccctgtgctaagaggcagccagggatatatacctcaccctttgctatatagctgccttgcttagaaacttcttctaagagaaatgccttatcttttcagatttatattaaatattttccaattctatttctgcctttatctcaggaaattccaagtgagtatgaagctcatgctccctccctaaaatagcaaaatagcaagctctttgcatggatttttaaaaatttatctttttttttgagacagggtctcactctctcacccagattggagtgcagtggtgcaatctcggctcgatgcaacctccgcctcccaggctcaagtgattcccccacctcagcctcctgagtagctgggattacaggcgtgcgccattacactgaactaatttttatatttttagtagagacgggtttcaccatgttggccaggttggtctccaactcctgacctcaaatgatccacctgtctgggcctcccaaagtgctgggattacaggcatgagacactgcgcccggccgtatgatctttttacaaggtttcaagtaacaattttatttcctttgcttcaaaatttccaactattgccattcaagtgctttccactgatagtctgcaaatacacaacccttgaagaactcattgtaactatggccaaaagagtcactgttttaaacacaatctcacataaagaagacttaaactaggtgtactagttgactccatctagaaaattatttctcctagacagaaatcttagattaggcaaatgtgactgagctaaacaaagtctttataatttacaagttcttagggatcaattcttaattttgtacaaaaccacaattaccaacatatgatctccaactctgacaatggggtcttatttttaatctccattataaattggcaacagaaatcttctcatctcatttcagtaaagttggctttgccaaaataaagaaactctctttgaacctgaatcagatgatggatgtacaagtcacttattttctgggcttagagttactctggagagtaaccaatgtttaatttatcaatgttcctagaaattaattagtttaacatgacctactgttgttaccaaagtgtttttcatactaggtaatacaaattgggcctgattatctaggcaattgtatttaattttctgttttggttcatggcaaccaaattggcacttataactttttcccttttgtccaaaattccattggaatgacggaaggtattcatgtgtttagaggaataaaattataatcaacctagaaaacaagaaagcaagcaagcaaaagaccaagatactggtgaaaatactgaaagatgtagatgggatctcactggtaaagaaaacaaagaagagtcaataaaaccacaaacaccaggagtaagaagaagcttcacacctttggttgacaaatagtgtacttcaattctgctggctgttgtaaaggagattacaggatacctggaagatatataatgggagaagtagtctcatatagaagctattgtgggtttgggtcctttagaaatttctctgaggaagaaacattaagttgtggcctaaaagatgaaaaaggaggctgatagtagtcctgtattttaaaagaaaatcagtatcaccgtaatttagggagggaggttggagagaagtggaaaatcagaaagagatagctgttaaaaggtagagccctataggttgtggcataaactttacagtaatggacagctattgaagagttataaacaacagtcaaataaatgttgtaaaaacatttattccatttgccatattgaaaatggggtacaggggccaggcgaggtggttcacgcctgtaatcccagcactttgggaggccgaggcgggcagatcacttgaggtcaggagtttgagaccagcctggccaacgtggtgaaactccgtctctactaaaaacagaaaaattaggctggtgtagtagcaggcgcctgtaatcccagctactcgggaggctgaggcgcgaggaatgcttgaacccaggaggcggaggttgcagtgaaccgagatcgcgccactgcaccactcctgcttgggcgacagagccagactctgtctcaaaaaaaaaaaaaaaaaaaaaaaaaggagtaaaatggagtacagggtattaggaagaatatataaagtacaataagatagacaaatgcaagttttatgcacaaatgaacatcgttagaactccgacacaatgtcttcttcccttcaaatgtcttcacttttccattcccactatcatccttcagcctagtctctaccaccagttttactgacgcgtcccccaaacggttccttcaccctcttctccaacctgctcccaagtatccttcatagtacaaggaaacaaattttccgaatcataatatttttcatttcatttttctgcttaaaaatttatcatgtcttcatattacttatagatggagtttgagaaaattattaaatctattccccacctaggttcgtaatcaattaagccgcacatataggagtcagacgaatagagatgaaaatatctcctttactaatgataaagctgttatcagcgaacatagcattaagtcttcttattatgtatgtttgctaataatttgcctagtgacatccattagtaagcattaaatggaagaagaagcattccctatataatttatatcatgggggcttaaccccaatttaaagagcatgaagccatacctactcaattcctcctccaaaaatcagggtagatggttcatttctgctttcttaattggagtacatggagggacagggaaaacgggcaatattattaccctagcgtagttctctccacaattggatatttgaaacaacaagcaaggagggtccaaagatttaattgcatatacattaacagtttttgtctcattttcaatattctttagagtttgcttattcaaacttcttgctaattatcatcacaagccgctatttctgtcattttccttgtgctgtccatattacttgcctcttcttttaactctagtaccaagattgactgatgataggccattcaatcttttccaaagccgaggttagcatgcttagctgaatgagttcgggcaaatttcaattttatgcggttcatagcaatagccatattaactagtatgtttatttgtctctaaataaggtttaggtattctgaaatgtctctctagcactggatttccagttaatgagcatctcactagaaatttatattgacaacaaccttattaatattaatcccctagcatttgcaagactaggacaaaatttcagatatcatttatatgatatttttgaagacattttataaatacaacaaatatgatggattatttctattactataactaaattatgttttgaaataccatactatttactaagagctataaaatgtgatagtatcctataaaattaatatctcaataactctaaaacatgtcagttgaaaatagtgcatatatattagtgtgaatgtatgtgggggtatgtcaaaagagaatctccttaatacaagcctctgctggaaataaaaaataaagaaaaaaagcagaaaatgaattatttaataatttctaagatgttctcaggtgccaacacaacaaatcctaatgaacccagggttgattaaatgcagataaagaagatatgcatttttcaaatctcatgaagagaaaaaagatttttctgtcgatcattctctaattaaagtattaacggtaagatagagactgtattccctcttactggaaagataaactgtatgtttctataatatatgtcaccctagcaacaacacacaaagcatcaactgcctttaataaaaactgattttataattaaaggagctaactgttgaaaaatagtcactttttatagacacttgaatatgaaaattggtttctcacacctcattataatactaagtgcaaattagtataagcctttgctcatccattccaagtaaagcagaagcacagacagatcaaccaacctagcactgtacatgacacgttgtaggaattcaactagttctgttaatttaaatacctgcaatagtttttattatatctgcactatggatttttaaaaaatatgtaacagcaaaaaaactaccaagaatatttataatataaacagttttttaaaaatattctttctcatgaaaaagtctatttaggaacttctggtaagggtaagataacttcgacccatttttcccttcctcttcccactaaaacagcaacaaatgctggtaataatgcaggaataaacccaagataactctgaaggtagtcagaagaagacgacggagttttggtttactgggtctggagcagaagttgagtgacttacatcttttcacttaatagaagcaagtgacccagactcaccatttcgagacccacaaccagcagtcgaaagcagcctagaaaggcttatctctccacatctaagaggattccctgagacaacatcaggttctcctgacactttctaggacaggatgggtagatgcaatccagagaattgccaacagtaaggggaaacactctctgttcctggtgggcctgcttcagctctcatccacagatacctgtgaaggagtaaaggatgttccatccccaaatatgccagattggtatgttggctattttcagttggaaactttggagaaattgtagtttcagaaagagttagctcacctgtctcttcctacatgcagcaaaccataaagattcctctgggaggggcaccctcacaggaccagagtgagaaaatagcccttattaccagagacttagaattggaggcttcaatggacctgaataaatatatttactgaagtaacccttatctttcactagttttatacccactatctatctcctagtgactcccctagagaaaatttactgtccctagccagattctctttatcctgtcattgctttccaaattcatcaaattcatcattcatcattaaaagcatcttgctttgactacttcttcaggcttcactttcttgtgatgatctccacgtacatgtataagtaatacaatttgtattcttttcttttgttttctgcctgatgtcgatttggtttctagatccaactgaagagcctactaagaactaaaagggggattggaggtgatatccaattcccctacacctgcacatgtgatgaaactgtacagaactaaatacacacacacacacacacacacacacacacacacacacacacacacatataggaacaccgagagaaactgaataaaattgctgaattgtagtaatgtcaatattctggctgtgatattatattatagttttgcaaaatattaactttagggaaaaaatggtaaagtgtacataggatatccgtattatttcttattaactgtatatgtatctacaattatctccataaaatgtcaatttttttaaaagtcaattttgatttttttattttctgtttggatttcactagatgttcttattgattttattcactatataattgagaatcatcttgctctgtgtttactcagagcaagctgaactttcagcaatcttatttttaaaaaatgctacatgatatgaccttatcagcaatttactaagttatttgaatggactttatggacatgaacttatcttcaaagcgtcttttctgtttaaagctatgtcctttaccgttttttttaaactggaagcattccttccctgccagctaaagaaaattccatgttattaaaaatggtggttctcagccataattaatacacatagttcataacacccatttaaaattggtaatgtgtttataagagaggtgagacatgcaagaaaagaagtggtaccaagtgatcaccagagacacatggagtgtgtgagtgtaggagagttatttaacctctgtgctatttatttatttacttatttgagatggagtttccttcctgttccccaggctggagcgcaatggcgccatctcggctcactgcaacttccgcctcccaggttcaagcgattctcctgcctcagcctcccaagtagctgggattacaggcacccaccaccacacccggctaatttttgtatttttagtagagacagggttttgtcatgttggccaggctggtctcaaactcttgacctcaggtgatccacccgctttggccgcccaaagtgctgggattgtaggagtgagccaccgtgcccggcccacctctgtgttttactttccctatctataaaaagggaagtaaaaatagtatcttctacttaggatagttatgtgctataatatgtgaagcccttatttcagagccaagcatatagtaagcacttccataaatattaattattattattactcatggaacataattgattcccattagaatttgtaggagtaaggaggtaacactttaaatctactttgttcagagctgcttctcgctggaaaccttttaagtagtgtttgtatcaccttttctcctagcacttacatagtgtactgcttgtgtaattaactccatggataaagaaatatccttccccttccatttactagctttttaatagtgcagcttcaggtcttccactagaaatattagaattgtcacttaattttcaacctcccgatatttaattgaaagatgtacaatataatttaaaaggtacctacccatagggcaactaattctgaaaacgggtgataagtgaataaaggaagtatgcttaatttcattttcatgctttcgcagtttctatcttatattgataaagaaatcctaagctctacatctgtataagaatgtatcatcctttcaatatacttgtatctatataaaatgcagatgtgtatattcttgtgtgtgcatacacacatgcacagctatagaatatagatattttaatttagataattttaggactttacataaaatgaatcacatatgcactattatgatgttttccccaatgcaagataatattttctaagattttagacataagatgtattttatcatgtacaatgcactctaaaacttaccaagtttccatttacaagggaaaacgattaaaaccacaaattgctatagttaagagtttgggattattttattttattttacaaatgagagcattcatttctgaatacctaccataacacatgcatacatctgtcagaaaaaaaaaatcatatttagaatccaagtttactcccggagaaccttaacctatttcaaaaacatctttgggaagatgtcaggaattttcacaatttctattacactcttctgatttgagtcaaagaaaataattttcaacataataggacagcccagggaggcgagtttcagccagttgctgtggaaaaaccagaggcagtcgctgtcatgcagctgccaacaccacagttgggggccttgccaagtagacagatgccaaaacagaaaaaatagcttattccaattaattgttgaaacctataaaggtaaaacacttcatgtgtgggcctgactacagaactgctttgtcccccaaaggcatcgtgtatttgcttttcattgtgggggttgctagaaacatagaaataatattattaaagtatagaagatgtccaaggaacatgcatctttcctctagcaaagaataatttaaaattaaaataagtattatacttattacttttctaaattgcgacttctctccatgcctcactttccctctctgtaaaatggagataatagcatcacactgctattttaatgagaaaagtgaaataatacatgtgatgtacttaatggtgccaagtagttagcatacatcaaacatgagcaattatattattcctattattataccaagttagttaaacttgtattattttactactaatatttgtattactgcactaagttagataaatcaaaaccattgttaaagctgatctagaagtaagttattagacatttctgtttaggagatatcagttacttagaaatttagttactataaataagtcttacatatagaaaattacctttttttggtgactttagaaatttagggcgtaagaaataacttttcaaagaaaaaaattatgtcatcattttaaagagctctctcagtgagtattaattgtgttcatagctagataaatgtgtgcacacacaacacattacggccaattcaaattttaaaacaatgccattatagtggaatttcatcctattctgtatgggatcaaagcatccagaggtctaaaaaacattaaaataaccaatcctctaggtgctttttaagttttcagttaatttgtcttatctacattgaagcaaacaatctaaaacttgcaatggatatctgtgaagcatacatcaaaagaaaagtatagtagctgttagttcaaggaactgaatgatagagcttccaattaaaaatacacacatgtgttgtttatcttatttcagtgaactaaaaggttatttgcatttcttgtaaagtgtgctcatccctttaagtttcagtgaactgtttgagaagacatagggaatgggaatgcattttattacaacctttccctttatttggaaagattattcggtagctgtttctgaaatgtctagtactactgtgaaaaactagtacccacaatatagttctagaaacagaatagacaaagttgcttctgatatctttctgtctactagtcaggaatgcaagacaatttcagatcaatgatccttctactatcaaaagtcatgggacctaaggatcaagatcacttttatttttgctccatttgaattatccaggcaaaaccaatgacataaatgaggccttacgtgacctgacatccctatgcctgatctagcaggactgtgacatcaacagtaaagctagacggatcaaaaggtgcctccaatgcccgtgtcagcgtcagcttcagcagaagctccccacttggcattcctgcttgagtgctttgcagtcctggcatgtcacctaactggctggtgcttcctaataggccctacaccacttctgattgatgtgtgaatatgcaaaccttactggaatccaggagccagatggcccacataccaagtatagcagccagacaaaacagaggcagattcagcaaactgttggagagttacatttttggtgattcctacagacacctaagtatacatagtcctatttaattgatttcattccatgttaacccacaacaatagtgcctctgtcattaaactgccacattctaattaaaggagaaaattctttcttttctcctttccatttagcatgaaatgaaggcttttataatcaacctgattctaccctgctacttgtagaggctgtcatgtagtctctaaaggcacaggtgaacaaaatctctttgctgcttctctaggataaagcagtcacttatttctttcattaaacttagatgaattatttaaaacaaaagccataacttgtataaaagagtgcccagatgagggtgtatcctccctgagtgagtaatatctagtatatatcagccacacaataaaaaatgatgaaaatggtaaaaattataaaatgataaaaaatgattaacaaaacacaggaaaatcatatatacatatatatgtgtatatatatatataaaatcacacacagcatgtctcataatgaaaagtagaagttacttaatatcggttttctttttttacatatgtaaaatatcattcatgggtgtacttgtgtgtgtgcacaaccacattgaatggagacatttcaattagaacttctccgatagaagaaatttaatccacaaataggaaaagcagtatatctcagcgttaatcacttatgccttaaaaataatcatgatagcaaccaaaattctttctggaatctgaatcagccacacacatgtgtttctgactttattcattaagattagcagccttccagaaatcactaaaatggaatcttcaaaagctccagttcaagatctggagataaaatgaaagtctggtgatcctttccatagactctgaggactttctttaccgtcttaatgtcttcaatggaaaaacgaccgtgtatgacaaaataataagtttgcttcctgagcttgaaatgaatggctgcctatcagatccactctgagcatatcacttcaggctgtcaggccagccacattgctcacaatttccctttgggataagctaatcctaaaatcattttatagtttggatagtttcagcatgagatattgatgtctttgtagaagttctattgcataacatatacatggaagactcaagttatacggatatgtatgtactacactaattgtgtagtgtgactatgtatgcattaagaattttaatcaattgtgtaaagggaagcaaatgttcatctttcatatctcaaccaatagttttggttctcatggaaatcaaacattacctttttgtaataaaatcagtgtttcaacagaaatatatttcacaatgaaccttgtttataatgaccatctaaaatttctttaagagatgggcattacaggtcaaagataatctgtatgaaaaaaatacataagatattataaaatgtagcttaaactgttgtgtattaggaaaaatttaatacaaattctgctataattcaaaaagaaaataatgaagggaaataaaagaaaagaataaagtggaacaaaatgtgtcacataaaacaacatataccagggtagggtactataaagttttatttctacagctttgaaagaagctaaaaactcacttgtgactctgtagctcatgagtaatgtggtcatttcaaacttatggtgataaaactttatggcactctagttcagaacatatgtcaaacagagaaaaaagtaaaaatcaaaatgaaatgtgacaaaacactgcaaaacccttctcatctgacaccactattctggttttgtctgggaatcggtggtcaatttcattttgaaatttctgtctcagagtcatgtagcaacttaaatgactgctctgattagcatcaaagtaagtgtagaaaaatgatttgctttcatcatgatggtgttaacaatatgtacttcagaaaatgtcatcgttagtgttgctaaagtaagaacagaagcataattcctgcagttaaattccaatctaagatatttgaccttcacacgaaaagaatgaagacaaagcctttctcttttaaaaactatttttatggaatatattaattttagagaaaatgtcatgtctttacaatgagagctcaatattttcaaatgatgtggttatatattaaatgaatacgttcattttcttaccattaaatttttggtattagttctgggaggccataatttttctacttaaatttttgcctgtatataaaaagtactttgtgtaaatagagtccaatttgactttagtttattagtattaattagttgtattttgtcacttggacaacttgcaaaactttggtgttattctgattgtcactccattttcttagctgtagggccagaatctaattaatcctattattaatagttgtctaatttctcactattctgttccttagcctaaaggtttcataactctgtatgaaaatgagaaaacctgtcattgattaatatatgtttgtttttgtattaattgtgcaactgcaatgttactgcacatagaaatgtaactccttgattgaggagcacattgccacacatggaatctccaaaatgccaagtgaaaatcaccactcttaagagtttatttcagagtgttgactaaattgtttggggacttctttgcctataacataaacttaagagtttttgaggtacttgttttccttttaatcaaatacttagggaattataagtgtcttcttagagaccatgctttcatgcctagctacagttgaccaactcttttaaaaagctttgtctcctgaaataataataggaacaaactcaacatttctaagagaagaagacaccgttatcaactgagtgcagtgtaattcatcagtcattgataaaatcatattctagattaatccaggattcattcaattatttctaccaaatctctttcccttcaagagagggagtggagttagttgtcatccaaaatgctaatccaaaataataagggccatttaagagaagttattgagttgctttagaacttgtagattctatgctatgctgtcactgtaagtagcattattttagaaaataaacccctaaaccttaatttaacatgaaatggttcataactacaaccacctgaactgtgatcaaatcatgtcacttagatccatgtaaagcagtacttactacacccctctcacctggagagtttactgaaaggcatacctagggaaaaggcattcatctagtgctgccccagtttgaaagcgtaccaaaaagtattcacacaaggtttgtgtcacacaaggagaaactgtatgtgcctgttcttgaaacccacagcagtaatggtaacagaagaataacaagaatacatatcttgattccatataccaagctttatcctagaaaaggttgggattactggacttaaaagaacatggtattccgtaatcagacaaccttaatttgggaccattctggagactgcttaccacagtgataattatacctaatttgttaaaattcattttttccaattataataataattagaaaactataaaagtatacaaatgcagtacgttttatcttagttttcttctacttcaaaattatatatattatctaaaatttgtttttcttttcaggttatttctaaggtactttgatttttgttaaataattcagtttaaattccacgtttttatgtagaaaaaaatcaaggatttgatttctcttatattcaaaagtgcaatcgttttctttctacattgagatgaaagtattttggagcataaacaatacacgctaaataattgcaaatagcttttaaaggctaaagtttgcaatactgaagagctaaaccagcattgtccattagaatttttggtggtgataaaaaacaaaaaatgttctatacatgcactacataacacgatggccactaaaaccatgtgactactgagcacttcaaatgtagctagcaaaatggaggaacaacatagtttcttttactttcactaatttaaattcaaaataattttttgccattgtctaatggctaccaaattggacagcacaagtctagaatttaattactaatacatgtatactttttttattggtacatatgtcatataaggttgtatgcgcagaagcatacagataaatggatgccatcttgttactatctaaaagccaacatacaaatgttttatgacttaaaaaaatgccacagattcttgcttcactttaatgtgaggaactcagatatttattaacataattttgaccaaaagtagcctccataccaaatgcaattatttagccatttctgcaagactggagattttttccccaaaaactaactagaaaaataacttaatcctctgttttaatatgccatttcacagcttgcaattgcttattgtgaatgctcctatttcttttcttgaaactttggcaaaactattatgccagaacatgatttacattttgtcattcatttaaaattcagaatggctttttatgccattaagtctatttatttacattaaagacaaatgcatacttaacaatttggagaaaacaatcaaaagcttttgaatcattctaattggtgagggcttattctttaaaaagtaacatctatttgatgtagatctgtgatctgacagaaaactaattgttttaagtatttgtaatccaagcagcagtgatgcaaatgaatttaattatcagtttaaaaatccaaacaatgggaagtaagacaacacgctgccttcaaagctatagtaataaaagaagtgctagtacatttcctcatgtacctggaaatgagtggcccagatttgcttgcactaaagtctacatgcctaattttaatcattttgattgtataatcaacttcccccagtcatttctaaagataaattaagatgcatgctttcattaagaataaaacaccctgatttcttcatatttctaaataacttgccttttccaggttttctgaggtaagaattcctgaatgatactcacaaaagtaaaatgtacactgaatctagtaattatatttattttaattttctttctttaagaacagactgttggccaggtggggtaatctcagtattttgggaggccgatgggggcggatcacctgaggtcatgagttcaagaccagcctggtcaacatggtgaaaccccgtctctactaaaatacaaaaattagctgggcatggtggcaggtgcctgtaatcccaactacttgggaggctgaggaaggacaatcgcttgaacccaggaggcagaggttgcagtgagccaagaccacgccattgcactccagcctgggcaacaaaagccaagctctgtctcaaaaaaaaaaaaaaaaaaaaactgtctattttatattgaatttgagtaaaatgcaaaatatgcagtgaattttactaaaatcaatgtattttactgaatattagaccaacgcattgtagttggggattgcccctttggcaaagctcccatttagttcccaactattctgatttatagctaatatggagaaaagttaggaaatgaagaatttttggactgacacaattataaaaccaagaggaaaaagcctacagtttttaaaccaaaaaacctaactttagaacccggatttgtgagtaagtagtttgagcaagtcatttagacaaatgctcttcaagctataggtcaagacatttgtgagctgtacaacccgtttatgtgtcataactgccattaatgtaaaaaatcaaatagaaggctggtgcggtcgctcatgcctgtaatcctagcactttgggaggctgaggcgggcggactgcctgacctcaggagttcaagaccagcctgggcaacacggtgaaaccccgtctctactaaaatacaataattagccaggcatggtggtgtgtgcctgtagtcccagctacttgggaggctgtggcaggagaattgcttgaacccaggaggcagaggttgcagtgagctgatatcatgccactgcactccagcctgagcaacagagactccatctcaaaaaaaggaaaaaaaaaaacaaatagaaaagaatgaaataaaattattaaagtgtggctacatatactaaaaatgccaccttttataaaacttttgttttatttctgcatgtgtctgtgtgttttggggggtactggatcatcaagagtgctcactttttctcttaaattggattgtgaacaatgtaggggagaaaaaattgatttcctcgcctatcacaaggttcatagctgagacccctatagcaaaagaaaggttaacaagagaaaagcatacaaatgtatttaatataaattttacaaatgataccaggacacaggagcattcagaaatgaatacctaaagaaaaaggggagacctgtgtatttttatgctaaatttgatgaagagtggacaacctggcagaagtatgattggagaacaaaagggtgtaatctaatggtaataaagttggggtgggggggaatgtagcaaagcctgtttgttcagtcttctctgtgtcccagtgtgacattcctttcctttaggtatgggacacatgaggggtcttatggcctacttcagagcaaggccagataattcttttctgatctgcttcagaggaaaatggtggcagaaggtcagagactttctcacttccgctgtttcccgaaatgccaaggtgccatatttggggatgatatgtcctaaatcccactaacaacaaatataaaaaaggtggaagcccccaatttaaaaaaaaaaaaaaaatagattgtttaatcatttgaacttgggaatcttgaaaatattaaaaagaatcctgattctttctccgtttagccttgaacaagttatttaactattctctgctttggttctgtcatatgtaaaatgaggatactaataatgtctatctcagtacgttgctttaagaattaactgagagtgcacatatatctttgacaaatcaattaaaatacctttggatatatatccagaagtaggaaagttggatcatatggtaattccatttttaggtttttgaggaatctccatattattttccaaaatgaccatactaatttacattcccaccaagagtagacaacattctgaccacaaaacataagttagtgaggtgatagatatgttaattagcttgattgaatgtttctgtaatatattcatagattaaaatatcacattgtacaccataaattactcaactgttacttgttcattaaaaataaataaataaggtcagtcaccgtggctcacgccagcactttgagaggctaaagcaggtagatcacctgagctatggagtctgagaccagcctgggcaacataggggacccccatctctacaaaaaataggaacattagctgagcatggtgggggacacctgtagtcccagctacttgggggttcaggtaggaggatggcttggaggtcaaggctgcaatgagccgcaatgactccactgcactccaacctgagtgacgaagtgagatcttgtctcaaaaaccaaaccaaaacaagataaataaatgcaattaaagaactcatgcaaatccattataacaatgcttgacacttaataaaggctagccatctgtatgacatctctgttctatgactttttagttacttttaggtttaatgtgaatgttttttctttctttttaacttaaatgccgtataaagcactcttttaaataatgtacatagaaactttatctaaaattcctagttatgtgattttgctaacaggcatatttttcatggaacaaaaagtcacggacaacaagccctcattgtccatttttctcatatgaatttctctgtacttgaaatgttactgtcaggacttggctctgccctgcttctatcatgcctgtcaccttattcaatagaaacaagatgagtgttcttggcattgggaagcaagaagttagtattgtaagtatgattatttcacacaatactagaaatcgttgctgaggaacagcctgcatattgccacggaagaaggctgggatcctgtaccctgagataggccaagtgaaataaggtctattcatagacttgtatggtagttacaacattggttgttttagataataatgtagacttcataaatcatctaacacttggaaaatattacgtaccatatagtaaactcttgaaagagcattttagtacccccagaacaatgcttgaaaatttaaggcaaattacttccaaatcaacacaattttgagtgtaacttaactctggcctttgatatggtaaactgccaattatagctatctagctcggatttaaattgaattagattaaactgtgacccagtgatttttctggtttcttatgtggtcagtgcaaacagttatatttaatggtggtaaagctgagataaaaacgttaaatgtaagagtcaattgcaaggtcattttctttccaagtaatgaaaacgtagtacttgatccgctgtaaaattacaggctaatgactcagtcctacagagtagctctcaaaccttgttcgatgtacccacactgatttaagcaaagacaaagtatcattttgacgattaaataatgacaaggagcataaatcacgtcttagatggtgccacaaaatacaaattttaaaggtctcaatagacatttttggataaaataatgagaaaaaaatgttcaatcaaaggtggatggtaaatatttacaaattttaaaaataaatatttataagtcctattacttaaaaaagtaatatagtacacattgtaatattttaagaaagttttagtattgttttctgaggcatcaaattccattttttgaaagtatcatgaagaaggatattaaagtactttagattgccctgccaactgtaggagaccgaaatatgccatcccaaaatatgtcacaaaatatgtcaagaaagcaggcttgatggccgcggtggctcatgcctgtaatcccagcactttgggaggcagaggcgggcgggtcacctgaggtcaggagttcgagaccagccgggccaacatggcaaaacctctaccaaaaataaaaaattagccaggcatggtggcacacacctgtagtcccagctacctgggaggccgaggcaggagaatcgcttgaaccctggaggtgaaggttgcagtgagccgagatagtgccattgcactccaccttgggcgacagagcaagactgtttcaaaaaaaaaaaaaaactagcttgcattttattgctggatttctcaagttgtgctcatagggcacaatggagaaagaaaaacatgttctaataacatattttcaaggttagccattgtcaaaagttttcattcactgaaataaaacagattaatgaatctataagaaagcatatgtatatttgcctttttctgttgttatttttatagatttaggaggtacagtgtagttttgttacatgcatatgttggatagtagtgatgtctggtcttctagtgaaaccatcactccaatagtgtacattgtacctaataggtaatttctcactcctcactcccctgccacaatctcaccttttaaaaaattttgtatttttaatttttgtgggtacactgtaggtgtataaatttctggggtacatgagagcctcccgccattttttttttttttgagatggagtctcgccctgtgcacccaggctggagtgcagtggcgcgatctcggctcactgcaacctccgcctcctgggttcaatcaattctcctgcctcggtctcctgaatagctgggattacaggcacgcgccaccatgcccgactgatttttgtatttttagtagagacagggtttaaccatgttggtcaggctggtctcgaactcctgacctcgtgatctgcctgcctcagcctcccaaagttctggggttataggcgtgagccaccgcacccggcccctctcaccttttgaagtctccaatgtctattattccattctctatgttcatgaaaatatgccactttgacacaggactattttgagctaaaggcaattcagaagaagcagatataagttctctgccctcccactatttgcctgaaaacagtacatacatttgcaaaggtgtccatcctctcctctctatcagaaaggacaaagtttgatcaccaatgacaactttagatctttatcagcccggagactgcatcagaggaatctacataataaattttcttaactagcctttatctaccatcagtttcccatatatttgccttcctgaaattggccactcatagagactcagggtccttttcccttgtcttgttacttctcaaaaaacgtattgttctttgtcagagaaatttattcatttttccttatatatctttcatgtatacatgaggtgtgtatgttagtaaactttattgtttttttcttgttgatatctcttttgttataggagtcccagttaagaaataaaggtagaggctagatgcggtggctcacacctgtaatcccagctctttgggaggctgagactgaaggatcacttgagctcaagcattcaagaccagccttggcaacatagcaagaccctcatttctccaaaaagtaaaaaaaataataaattagcccggcatggtggtgcatgcctgtagctaagctaccggggaggctgaggtggaaggatggctcaaacccgggaggttgaagctatagtgagacaagattgcattaccacactccagcctgggccacaaagtgagacccagtgtcaaaaaaaaaaaaaaaaaaaaaaaaaatcaaggtagaggtaaaattatgttttcttcccctatgcaatgtgtttcttttatttaaatgtttatttagcaaattgtttacctgatgaacaactaatctgagagtgagtagtatgagcaaatggcttttgtaaagattttctcaaatttacctgacttgagctaaccacattcagattttaattactttaaagttctctacctatttatatatatatatacacacacacacacatttgcatatatatgtttatatacacacacacacacaaatgctacatatatattctaattgttttattcattttctgtgtattttaactaacttattgagatgcttgaacaaattgaaatgctttttataatgcttttaaaaataatcactacatataacatattctccagtagttgaacaatgtaaagaatttcttatatgtatgactttattctaacattcatatttcttgggtacttactaaatgttaggcactcacagctagtaatgtaaaatggtgggcaaagtctcttccaaaactatagtttataggctaataatggaagctttaggacacttttccaataattacacaacatgttatagtttgaagtgtgaaccttcgaaacagaagttgctggaaattcagtgtccttacactattcgaaggatttatacatgcagaaccagaaaacaaacaaacaaaaatatctcagttaaaatcagtcacttcagaggaaacaaattgatcgcgatagcagtagggaaaattttggagaaaaaatgttagctttgaagcaagcttgtccaacccgcagcctacaggctgcatgaggcccaggacagctttgaatgcagcccaacacaaatttgtaaactttcttgaaacatcatgagatattttttagatttattttttttagctcatcatctatcattagtgttactgtatttaatgtgtggcccaagacaattctcccagtgtggcccagggaagctaaaagttctgacaattctgctttgaagactcccttttaagttggcaatgaatgtacttacatgattatgtaggtattgttacttaaatgtaacatgttacgtttaacatgtttaaacattgatgaccaacgcagaatctcagcactttgggaggctgaggcgggcagatcacgaggtcaggagattgagccatcctggctaacatggtgaaaccccgcctctactaaaaatacaaaaattagccgggtgtggtggcacgtgcctgtagtcccagctactcaggaggctgaggcaggagaatcgcttgaactagggagtcggaggttgcagtgagccaagagtgtgccactgcactccagcctgggtgacagagcgagactccatctcaaaaacaaaaacaaaaacaaaaacaaaaaacaaaaaaaaaaccgaaaaaacaagaaatgtcttctgaccaatttctgtttctggtctgtgcatttgacttgagcacagatccattgttgcatacttgaagcgtcacgtacacgtgttgagttaaggaaaaaaagtcacattttcttttgatcactctcccatgtaacttcgttgaaagttacctttcattcctttttccatatcatttcctgggctagtcttacataatgttcaaacagggatcatgtaacgaattccatatcagtttataagctagactattaagattggtaaatgtatattttgtgttttttttcttactgctttggagtattgaaaggagttttagtataggggtgtttttata

SEQ ID NO: 2555 - DNA, 6917 bp, Homo sapiens
gatattcagtatgattggagagtttgaattgtgtaaactttattaagagactagctagaaactcagcagagttttcatggattgcatgacactactttcattttctttgcagtcatcacacaagtaaaattttataggttcaacacactccacatacacctaattgctctctagggtagtaaaacaaccaagcagtgaatccacaaaaacagttcagtgagtttcatttaaaccatgcatacactaccaaaaagtgactcacagcagaggaaattaatttactcgccatgaaaacacaattcttaatgatcccaacactatgacagtacctaaaatttcttgtgtgtatatatttggacacacatgtccacacattttatagcaagaacataaacatttcaaactgaaatgcctaagcaacccttaaagatagcttttgtcaagctaaaatctggtgagaaaatgaaagttaaggcttttattttattttattttttgagatggagtttcactcttgttgcccaggctggagtgcaatggcacaatctccgctcactgcaacctccgcctcccagcttcaagcagttctcctgtctcagcctcccaagtagctgggattacaggcatgtgccaccatgctcggctaattttgcgtttttagtagagaaagggtttcaccatgttgatcaggctggtctggaactcctgacctcaggtgatccacccgccttggcctcccaaagtactgggattacaggcgtgagccgctgtgcccggcgaggcttttaaattggtgaaaatgccaaccattcaatttttactttgaataatcaaaactgaagtgattcaagtagtgattcatcatccagtgtaatctagcacagcaatggagattttgtgtgaaacataccaaaggaaaggtttggggtttttaattgcgtaattgactaattcttgggcacctccttccctcaatcaaagatacatcatctgaatagttcacagcctcccccgaataaatgaaagtgacaggctctgtatttcttaatttgacgcctttcaaagataaggttaatggaattaagtaaccataaagattattgtaaattaaatgttatatccttagatgtctgagttaatttaatgcatttcaataaatatgaggttaggaaacataaaaaggaaaatttatggtactaatttaaatggtacctttccacatctcttgtgcgtgctaaagcataggcttttatgtttgtcaactcacaaatattgttgcagggaagagatagaggtcccaagttgtcttaagaatatggagtcagatgttcagtatgattttaggaacagccatatgaaatgaaatagtcatagctatgaactattgttaaacatcaatagagggagggtacataaatagaagttaatcacaagtaaaataacctaacagtgattatttttattatcataatcatcaaggttagatttacagagcaaaacaaatgcttttctatgttggtttagtgagtattttcacagctatatgtattttagtttttctttaaatttttatatatattaactagaacataatacaaacttcactttggtactagaattacatttttaaaaccattaacgttataatttttacaaggagaaaggtaatgttttgtgatgattattatattattatcaatattggttatctcagaaactgtgcttaatacttttctcatggcaacttatgaagtctttattataatcattttatttataaggcaattgagtcttagaaaggttaaatagatagtataaggtcatccttctagaaaatgagtgacaaatttaaacttagatgatttctaagcttattcttttgactgtagcattatattatgttcctgtagttacagaataatataacacagtgtccaaaaactagaaatcattttattcccttatttagggtagagggctgataataaccttggcaataaaaaaacccaaaacctactgtcacagttcttactgttgatggttttaataaaagaaaaaatgtctttgaggttttccttttatgtggcatctggtatttgcctatatccatgatctatttacagcctctttgaaaattaaccgaatgatattaatagatagtttattttatatagcgttaactcctcctaactttgtacacatttctctgcataatttgaagaataagaacagaggaaatcaacaccgataatacagggaaaaaaatacagttttttttaaaccaagcaagaaaatgcaatctgatgccaaaacaaataaatatgaagaccagagaaaaatctgatatccaaagactggaatctaaagtaaatgatgaagatattagcaatctgttttctgttaaatggattcctctttgttacctttgcacacagcatacattcaaaatattagaaaaaaatcaagtttcaactgtggtttgctttattggcagtaatgtgaaggatcaagtactcaaataatttaagcaaattttagaaataagaggttgtctaatcaaaacacaacctagaaagacaaatattgcatgttctcacgcgtatgtgggagctaaaaaattgatctcatggaggtagaaagtggaatgattgttaccagaggctgggaagggtagtggggagggggtgatgaagaggggcttgtttaatgagtataaaaatacagttagctagtaggaataaaatctagtgttctgtaccacaatagggtgattatagttaacaataattaattgtttatttcaaattaactggaggagtagacttggaatgttcccaacacaaataaatgataaatgtttgaggtaatgaatattccaattatcctgatttgattattacagattgtatgcctgtatcaaaatatcacatgtatttcataaatatgtacaactcttacgtacccacaataattaaaaagaagaaagaaaaacaaaacatatcacaaaggatgacgtagcttgattgatgaattaatagtgtatgcaactaagatgattggagagtgtagaccttagtccatgaaaggaaaatcagagttttcacagagagcaaaagggtgattctatcttgtctttggatttctctccagccatagatgcacacgctcgctacctttgcataccttactccaccatctaaaaagtttccttttatttcaataccactggaaaacccaccatttccttcatcatagattaagaaagagtgggtttttctgaagttccaactaccattgttaatgctttcaatctattgtctattttccatgcttatgattgtgtcagcccatgtgtaactaactcttaccaagttgaaatacgttcactaaggttcttttttgcataagacctgtatagaatagctatatattgaggaattaatagaacagcaatattttttatataccaaccacgagtgagatactatactaggtgttattcatgtatttttgtaacttcacaataatcctccatgttagttatttcatatatgagaaaacatgggaaggctccttccaggctatcttgctaactataaccctagcatttctaaacacaaaatataagaaattcagtgtcttagcactggctattctttccttctggaaggttcttcctcagtttttacatgactggttcctctagacagtcatatctcagctgacatgcctcttcagcaaagattctctttactactgaagctggaataactacccaatcactcactatctcaactcagtttgttctcaatgcaacacttttatctgatatgtttcttgtttatttatcacaagagacataatttctttttcagaaatgtaggctctgtgggagcagggaaatatatataagatccaattacaactcaacaatagataagtcacttccatcattgaagatctgagtttcatcatctataaagtaagataatatttatcagatatggttatcatataatgtatttatataatactaaatatatatatatatacagtaatgtccagtagaaagtatgctgaacaattagtgttctgtaaacaaattttttaagtgcactattctgaaatataccggtctctcatccttctcattttattttttaaaatcattttattgagctataactcacacaccacaaaattcactcttttaaagtgcacaattcagtgatatatagtatattcacatagttatgcaactgtcaccactttcttttttcctttatttatttatttttttgagacagagtctcgctctgtcgccaggctggagtgcagcggcgcgatcttggctcactgcaacctccacctcctgggttcaagcaattctcctgcctcagtctcccgagcagctaggactacaggtgcgcactaccacacccagctcattttttttaaatatatattttcagtagagacgggatttcaccatattggccaggatggtcttgatctcctaacctcgtgatccacctgccttggcctcccaaagtgctgggattacaggtgtgagccactgcgcctggccaactgttaccactttctaatataaaacattttcgtcagcccaaaaaagaaaccccatactcattaggaatcactctcctttctccacgtccccaggccctactaatctactttctgtctgtattgattagactattctgaaaactttatgtaaatctcataatttaaaaaatttcataatttttaaatttttataagttgaaggtattaacaagttaataataaaatacttcttgagagctaactcagggttagctgctttatatttcttcatgctttagctcatataatcattataacagagaaggtagtttctattacaatctttctacagatgcaaatggaaaaactgaggcacacgagtttaagaaactcccagaactacacagttaaaaaatgtagaagtcaggattccaagtcgggcttttcagtcttcctgtgtttgccagctctcacctgagtattgtgttactagtagagggacgtgctcacagtcgcccctatgaggggtatttggatgcagataattaacatcatttcaatccacaaaaataggcttagtcctcaataagtaaggaatcaaggtgagggcactgcagagttagtattttgttgaagacaaattaataaatcttttttttttctttttgagacgagtcttgctctgtcacccaggctgcagtgcagtggctcaatctctgctcactgcaacctccgcctcccaggttcaagcgattctcctgcctcagcctcccgagtagctgggactacaggtgtgtgctactacacctggctaatttttttattttttagtagagacggggtttcaccgtgtcagccaggatggtctcgacatcctgaccttgtgatccacccgcctcagcctcccaaagtgctgggattacaggcgtgaaccaccgccgctggccaataaatcttaaaatattcttcctgctctcctttcttttgtctgttatttccctggatatctactgtgaaatactgtggtctcacatacaaaccaggaaaaatgagagggaggtgcattttatctcaaatacagaacttctaataaaacagagttattttaaatgtatagggggatcaaaatacataaacataaacacttgattatttgatttagcattacattcattgtattcattgcatgcattttattctgctggcaatcaaaattagttccagaagaaggtccggaatggcagttgacacattcccctgctcaatagccctgatatttataattatgatttgaatacattttactgggctagtaaatattaaagcaaatttttagaaatgatgaaaaaattaatttaagcattttttgtctctaaatttacaaacaacaaacatgcaattttctaagtagaataacacacaccagggagtaatgatatttgaaatgactgtgaattttggtctctggatgttcttggcttttggtcatatgattcactacaccttctaggcatgtaattatctcttaacacctcacatcctgtcatacagtatgccattccttaaatgagaattggtctcgagtatcattgtatatttagatcttaataattttaatagaaacatcaaccagtaatttctgaagggcaaaatatataaattttatcacttaaaatatatcttttctttaataaaatctagctcttaaaattctattcagacctagaatgatcctttaagatcatttaactcctataattaaattgcaaaatttgaaatatgttcaacttaaaattcaacctaaaactcaaagctgtattttaaagttcatgttgcacttgttttactgcatctgccagagaatgcaccacaaaatcctttatagatattcagatgaatctctctaccagaaatgaagaaggaacgctgctaatcttgggctttcattggtttgattaccatttcaactctaaatggctgcatgataattagtgggtgtggaataaccagtactgctcaagaagcaattgcctttactgaaaaacaaagtttcgaaagaagcacagtaaactccaagagacaatcaattcaatcttacacacctccctgccatagttttaaatggagcagatgtgctaaaagccagtgagaagacggttgatatttcttagggttcaaacagaaatagaatatccagcacttgactgcccatatttttcacaatgatttattgcagtaaatagtctacacgagcgtcccagttttggactttttccctatcagtcaggtttttaaagccttaaagtagagttaaattaaataaaagaagggatggcttttatctaaaa

SEQ ID NO: 2556 - DNA, 11431 bp, Homo sapiens
caacttttttttttactttttttcattttcagaaataacttgctttttcttttagctctgctgttgctgtgtttatctatattagtttttagatgtaacagtctattcaaatgtcataatatttgttagaattttctgttcttgcacagggtggactttctgtagacagtaggtctgtggtaaaaaataaatttaaaaacccctgaacttctaaatgggtgatatccttggcaaactaaagtaatcacatggctagatattgaatttttagaatattgaactgtactaaataagcagatttattacaaagaggttgtaaaggtagagttaggttctaatcttaactcctctgtggctttagctacatcactatgctggctcttcttcatgtttgtatctgtcatcttctctgtcatcatcatatattgttctccccagttgtgtttcatttgacttcatcacgcctgccaaccaggtccctaatgttatttttcagatgttttattctctgaaaaacgttgttgctccttcttttgtggattttttatataattttttcatccttttttttctagagctctaccagcttggcttttacttccccttttataatttttcttaaaaagatctttatttttatcaaagtaccatatgtacataattaaagttaggcatacagagggcttgccataaaaagtaacaactgatgccccaccctttcctattcctaatgttgctcaccctgtggcaaccctgttaactcttttgttttgtctggtagttttctccttatttctaaataatatgcttataatgttatgtattaccttatctattttagatattatctattgcctgcctgctatgatagaagaagattaatctcacatcaatcttcatcaccctgtccttatcatcaacaatacagttatgatttttagtttctctcgtctaaagtaaaccttctttgatcttttttacataatctatgaagaataatacctgtagtccatctagatttgtttgttgcaaattttatgcatagatcctctggtcactttctgatcattgatttgaaaaattaagttctatttatttttttccacactggcgaaagttctcagggaactcaaagatagttaaacattttaactatccctcttgatactctctgcttttgaatttaccaagcagaggagagagcaggagtctcaatttttagtggttccctattttcttatgctattcgatcccactcatgatttgtcttggaattggtctggctatctactatgaagagtggtatggtgtatgtgcacagatgtgcacatacacacttatgtgcacaaggcacgtactagtacatatttccaaactcatgcatgtaaaagagatgataaaggggacctggattaactcacagcctgaacttgagcttgttttcttgtgtacctttgttcctaatttttaaaaaatttcctttatcttgagaatgtcttcccgaggttttgcaatcagtgatctttgtagcagtgtcaacctaacctcctgcctcaaggattgtgtgtgtgtgttagtgtgttttattttttttaagatgaactctattttttacagcagttttaggtgcacagcaaaatcaagcagaaagcagagttctcatattccctctattcccacacacccacaggttacctgctattgacatcctacaccacagtgatacatttgttgcagtcaaggaacttatgttgacacatcattcacccagagtccatagttcaggttcactcttggtgtgccttgtgtgattttaggcaaatacataatggcatggatttaccattatagtagaacatacagagtaattccactgccataaaaatcctctattcaccacctgtttattcttccctccctttaactcctggcaaccactgatcttttcctgtctctatagttttgccttttccagaatgacatatagttggaatgatagagtatgtagccttttcagactggcttctttcacttagtaatatgcatctaaggttccaccatgtttttttcatggctggatagctcatttctttgtagcactgtatgatattccattgtctgaatgtaccactgtttatccgttcacctactgaaggacattttggttgtttctaaattacagcaattatgaataaagctgctataaacatccaagtgcaggtttttatgtggacataagttttaactcatttgggtaaatgagtgctattgctggatcctttggtaagagtatgtttagttttctaagacactgccaaactgtgttccaaagtagatatatcaaggatttttgcataggttgttcctacagcctccacttttttttctaattagactatactcttccttaggacttctcagctcagcaatctctcattacctcattgatttagtaactacctgccattatatgcattcatggcacatgtattgcttctttatagcacgtatcataagtttgtgtgtgtgttttttttttttttttttgagatggagttttgctcgttgcccaggctggagtgcagtggtgtgacctcggctcaccgcaacctacacctcccaggttcaagccattcttctgcctcagcctcccgagtagctgggattacaggcatgcgccaccacacccggctaattttgtatttttagtagagactgggtttctccatgttggtcaggttggtctcgaactcctgacctcgggtcatccatctgcctcagcctcccaaagtgctgggattacaggcatgagccatcgcgcctggcctgtgtgtaatatgttaatgtctagcttcctcattagtttgtaagctctatgaaagcatggatcatgtttcatttgttgctcagcattttacctctagcacttagcctggtgtctggcattttagcaagtatttattaaatatatgttaaatgagtgaatgaatgagtaaataaataaatcaataaattgtatcaatgttctttttttccatagtgattgataactatgttttgatttggcaagtttattttgcttggagaattttacctataagatagcagaaaagctgggcaaaatcacttgaaacttcatatcagaagagactagacacaaaagtttttcaaaccccattttttgtatatatgtgtctgtgtgtgtacatatgattgtgtatgtttaagtattaaaaatggtgtgttttcaagtgaattaatttgtgatagctattgacctggcaaggaaaacattaggtaactttttaaaaattgttattattaagcaagggacatttcttgacttctcttaaatgccatgaatgattaaatagtgaattagagagttctgtatcttttaaaaaattactacactaaaactttgcttgcattcttataggataaatgtatattgcacacaaaatcacatgtatgatttaaatcttagtgaagacttgcatgcagcttatttctgataatcatttgattactcctcagtccaaataaaaaaaaatctaggtagcaaggcatttattcacatcattcatttttgtgcaacaaaatagtcttgcagttgacagtgaacttcagaatgcaggttttcaactcagggcaataattattaacatgaatattcaccttatgaatattgactatatgaatatgcaagctattaatggagtcaaatgtctttgaaagtcacactctagggacacttgttgcaattcttcactctttatggctggattatatatgctttcccgtggcagtattgattacacagtgaagatttattctctttcaccattggagttacatagtcctagtgaagaggaagtggggcacatgcaagatgtaatgtgctgctttgcctcatctttatttctattttaagcttcaatgacctagactagagtattttacaagaaattttatgtgtgattaagagtgagtcttttcatgtttgtttaatgatgagaaacgattagggtttgagggagtgactgctacccagtatgtatttaaacatagccaaaagtagcagtcttatcatagaaatattttcatagacgtaatagcatgagaataagatgcatttgttgtcttctttgcttttggtttaatctttttttttttttttcttcttgtcttgcagtatccttccaaaacaaaaggcataacctaacacttttattgtgctttgagtacctctcctctggaccaggtcaaccatacaactctttcagtcatctggttaggatagaaaacttattttgccttagtgttaacacatctcagatgacaacggataaactgagcctttaatataataagtgcacaacattttgcagatatgtttaatcattgtcccttcaataggggtttggttttgattttgttctgatgctgctaccattttaaaaaatgcctttaggattgtttgggaactgtattcagaattaattttgtaagaaacatgagaaagctattcttatggtcacattagttttgagtctaggatatacttgagagcctgcaatagtaatcagagtttattgtttttgaaaaggagcaagtgatttgagtatgtacattctagtgtattaaagaatgaattcaatccttatattattttcataccttataatggagataagttagttactgatgtatagtctcttatgtattgtttatttcagcagctttattatttaaatataattgacatacagtaagctgcacatacttaatgtgtacagtttactaaactttgcgtatgtgaaaaccaccctcacaatcaagacagtgaacatattcatcaccctcaaaggggttatacctcttggttacctcccgtccctctcttccatccccaaactgagaattagtttgcatttttgtcagttttctggaagagttgccgtagaattgatgtttactagaacaccccagtaaagccatagtgttgggtcttctctcattgtttatcagttttatggatcttcaaagaagcaacttttggttttatttttctatattttgatatttcatgatttaaattttgacccattatttcttttagcttgcttactttgagtttcatttgcttttctttttctatttgcctaaggtgacagcgaaggtcattgatttgagtacttaagagcttattttataatataggcattcattgttagaaatttctccccaattactgctttttggtgtcccacaaatccttatattttgtgattttaattttacttagtttaaatattttctaatttctcttctgatttcttcttctaccgatcgtttacttagaagtgcattgtttattttccaattatttggggattttgtagaaatcttttggttttgatttctaaagactgctgtggtcagaaaatatactttgtatgacttgaatacttttacatttattgagactttgttttatggtaaatgttccatgtgcacttgacaaaaaatatgtagtcttctgttgttgggtcgagtcttgttcggggcctccatatccctgctgattttctgtctgcttgttctatcaattattgagagaagagcactgaagtctgactgttactgtggatttgtctgtttctccttgtagttttctgtttctgcttcgtgtattttgaagctctgttattacaggcataactgtttaggactgtatatcctcccgataattgacccctttgtcattatgaaatgaccctttttataccaggtgatttttttttttttttgctgtgaaatccactttgcctgatattaatacagccactctaaccttcttttgactagtgttagcatggtttatcttttatccttttatataacatgtctttcccccacccgctctggctgcttttaatatttgctctttatcacactggctttcagtaacttaagatgtgccttggtgtacttttcttcatatttcttgtgctggggttctttgggcttttgggaatcactggtttatatgttttttaatttttgtgggtatatagtatatatatatatatatatatatatatatatatatatatatattcacatgagatattttgatacaggcatacaatgtataataatcacattgggggaaatgggctaaccatcacctcaaacatcctttggtacaaacaatccaattatactcttttggtttttaaaaaatatacaataaacttgttgactgtagtcacttgattgtgctatcaaatactagatcttaattattcaatctaactttatttttgtaccaattaaccatccccacacctcactctccaacttcccagcctctggtaaacatcattctactgtctatctccatgagttcaattgttataatttttttagatcccacaaataagtgaaaacatgcaacgtttgcctttctgtgcctggcttttttttcacttaacatgtcctttagttccatctgtgctgttataaatgacaagatcttgttcttttttatggctggatagtactccattgtatatatgtaccacattttctttgttttttttttttttttttttttttttttttttttttttatggtgtctcattctgttgcctaagctggagtgcagtggcatgatctcagctaactgcaacctctgcctcccacgttcaagcgattctcctgcctcagcctcccaagtagctgggactataggcgcgtgccatcatacccagctaatttttgtatttttagtaaagatggggtttcaccatgttggccaggctggtcttgaactcctgacctcaggtaatccacccgcctcagcctcccaaaatgctgggattacaggcgtgagccactgtgcccagccaccacgttttctttatccattcatctgtttatggatacttaggttgcttccaaatcttggctgttatgaatagtgccacaataaacatgagagagcagatatctcttttaatatacttattttctttcttttgggtatatactcagctgtggcattgctggatcatatggtacttctatttttagtttcttgagaaactgctaaattattctccgtagcggttgtactgatttacattcccaccgacagtgtacgaggaatccctcttttccacatccttgccagcatttgttattgcctgtcttttggataaaagcaattttaactgggggtaacatgatacctctgtaattttgatttgcatttccgtgatcaatgatgttaagcaccttttcatatacctgtttgccatttgtatgtcttcttttgagaaaagtctattcagatcttttgtccattttaaaattggattattagatttttttctctatatagagttgtttgagctacttatatattctggttattaatcccttgtcagatgggtagtttgcaaatattttctcctatactgtgggttatctcttcactttgttgattgtttcctttgctgtgcagaagattttttaatttgatgtgatcttatgtgtccatttttggtttggttgcctgtgcttgtggaatattatgcaagtaatctttgcccggtccaatgtcctagaggaccttccccaatgttttcttgtaacagtttcataatttgaggtcttagatttaagtcttgaatccactttgatttcatttttgtatatggagagacacaggggtctagtttctttcttctgcatatggagatctagttttctcattacatttattgaagaaactgtcctttacccgatgtatgttcttggcacctttgttgaaaatgagttcactgtagatttatggacttatttctgtgttctctattccgttccattggtctctgtgtctgtttttatgccagtaccatgctgttttggttactatagctctatagtataattcgaagtcaggtaatctgatgctttcggttttgttctttttttctcagcatagctttggctattctgtatcttttgtggttctgtataacagttaccatttaaaaaaaatttctgtgaagaatgtcattggtattttgatagggatgcatcaaaaacaaaaacaaaagtaaaaaatgaaaacacaaaaaccagtttgtgacatggttaattaaagtgatcgggatttttacaattctctttcacttttctacccttctacctgagcatctggttaatcatggctgaacgttaaccaaccccttccaactttcttgcttagactccaggtataacctcttggattcgggtcaaaattgcttactcaataattatcttaacctcaatctgacagtctccttttattttgcttaatagttatttggcaattcctttactgaacttcattagtccttaaaaactgtgtacatatagcttctttcagtttccaaacatttttccttctaattattgtttctctggtcatgtgatgtatcttttccttgcctgttgtttattacaaaaatctctccagccttggtcaaaattctatccttctgggctcacataccacaggctccagctcaggcacatattgtatttttattaaaaatatagcatagatacagaattttggtactaacaagaacaatacagtttattacttacactcgaagagattgagagcatacttctcagtctctcttctaggttttgccttgtcacatgatgcttaaggtattttcacccttgattattggaaaaattcagcaaaaccttattagaatactttaaatatatataatacagtttggggattattttattagcataactttgtatgttctttaagctagaacattctcattggtcatgctggcagggaaaagagaagccagaagaaaattcaagtcactgttccgtaagaacaaatgttaacatttgggctggatggtcacatcaacatggattttgacagaaaatgtcctgtcaatttgatggattttacttgtgataaatatacttccagagagcttgcaacaaaccactcggttataaatgggtatttctgaagtaatcctttctgatttgttttcagttctagtccctccccaataaaactgtaccctagaatgatgtaattaaaacatatgagatgtagagactaggaaactttttagtaacatgttatacatgtgacctcattgtatactggttttccttgtcctgattccattcagtaggactcttaggcctgtggttctaccttcttactggaactggagggaagcttctgtttgaccaagctaggtcaaagaaaatgaatttttttgctgttggctgtctccagagtttatcttgaaatcatcaagtacctgagggattaagttaatatactcattttgcatgttgctggaactaaaattaggtagaagaaagcagaaactgggaagtttttatgtttgtttaaagatttattatgtattatgggtgtatctaatcttcttgtcatgtaatttaaataaataggataaatatttttaatgcaaatccaaactgaaaattcactttgcagagatcattaacatttatttcatgtcattgtccttctatagttttaaaatgcaaataccatgggaaaatcttctggtatatgctcatgagagtgcatttgttgcttactgactgttttatattttacagttggctagtcaagtgctgactaatgaacacaaagcctgtgtttgaaaataaatttaacagctttatacacaagctaagtttatgtaaagtgatctaggagacacatgacctttgtgctccatagcccttgctcaaattctgaaagtaaactatgtaaatgatctaacatgtcaggtcaaacagtttcagtggttttcagccaagggaactattgaatatgttgaggtgcttccctctactatgatgggtcatgcatcataccatagtactctgtttgctgtttaccttgtgaaggtgtatttgctgctggaaccatgatgctgcatacaggacagagaacattatatggttctgtttttacctcagtatgccttggtttcctaatcagaaaaacgggaataataataatagctacattacaggtttgttttaggaattaattaaatcagagaactaaaaacaatgcctggcacatagaaggtgctcagtgaatcataaatagtagtactaatagtagtgatgctctctctttaggtctagcttttcttttttctttttaatatacaaattataaattaacaatttccttttaggtattcatgtctacaatttggcatttaaagagactcttggccgggcacagtggctcatgcctgtaatcccagcactttgggaggccaaggagggcggatcacctggggtcaggagtttgagaccagtctggccaacatggtgaaagcctgtctctactaaaagtacaaaaaattagccgggcgtggtggtgggcgcctgtgatctcagctacttgggaggctgaggcaggagaattgcttgaacctgggaggtggaggttgcagtgagttgagattgcaccactgcactccaacctgggcagcagagcgagactccgtcttagaaaaaaaaaaagagagactctcattcattcattcgttccctccttctctcctctttctctcttcccttgtccctgtttccttcccttcctctactgtatttccttgacttgttgctgtctagctgcagcagtgtaggcaaaccaggcaggctctaatggctaaaaattggtttgtttgggctacatttaaaataattggatatgtagcaatttgaggtgggctttgagctaatgggtcttatgctgctgtgaagaagtaaacaacataaggccaatatacagaggccatctttaacccatttatgtaatatatacaaaactatataagacccacctcctgccttaggaaattcatacattctagtgagaaattatcgcactatgataaatgctaaaatcaaagtttgaactaagaccttgggagtaataaaaaattccacttttgtggtgtttccaggttttttcaagcatattgtagctcaggaagcactctacattgttggctactggcgactgacattgcatcataacttttaagttttaaaactgtgtcaccctttcaatatctgtgggttacgtgttcatattcagttatgtttgtagctttgagtctacatacagtctcatttctgcatttcatgtgaaagaaaatgccagtcttagcacattctcttatgctattaatggagaggggaagaagccattctagttccttcctaaaaaaagtgatcactgtttaaagctcaagtaggtgggtgcttgtgtatagttcatgaaatttgggatactcagagctcagtgaatacctg

SEQ ID NO: 2557 - DNA, 11049 bp, Homo sapiens
ggccagttcctgtatttaggcatgataaatacattgtgttttctttaatcttgtctctttttataagttcagatacatgaaaattaacaaggtttcatatccattaagtggtagagcttggttttaaccccgatctttctatggtacttccaataatgatatggacgattgcatgattttatgtgtgagcacatgtgtgtaaaacaggtttggatacatttaccgtcaactaaatggtatactaatcagtgatactcagatatttttcagtaagtttcagtttaggggggatttgtacatgtaaaatggctccaggagtctgtttgactaattaggccacctggggtctcatataatagttattttaggtttccactgagtcagtacccagttatacatgttgtttgacattggtcattttaatgaatacttgagccttaggaaactttatccattatggcaataattttatatatttactcttggccttgacatcattcccaggcagaagtagaagtggtcatcatcattttccttctaatgacttaaaccaagtcatttgctgttgaaactttaacagcaaataaaactagcggtgtgtgtgtgtgtgtgtgtgtgtgtgtgtgtgtgtgtgtgtgtgtgtatagagagagagacagactggaatccgttttgtttttcctatctctaaagtgcatgaattaaaaagatactaaacatacatctttgagtttatcagttcatcaggaacacatttttgaaaaccagaaggactctggataagtacaacttgttttggttataagaaacataactagccaggcacggtggctcatgcctgtaatcccagcaatttgggaggctgaggcaggcagatcacgaggtcaggagttcaagaccagcctgggcagcatggtgaaaccctgtctctactaaaaatacaaaaattagcctggcatggtggcacgtgcctgtaatcccagctactcaggaggctgaggcaggagaattgcttgaacctgggaggcggaggttgcagtgagccgagatcaccccactgcactccagcctcggcaacagagcgagactccatctcaaaaaaaaaaaagaaaagaaacataactaaaagtcatatatcttgttggcagtgaatcagtagaatcatgtcaacatataaaggactattttttactgtcatttttcagcacaagttttttttttgttttttttttgtttttttgtttgtttttattgatcattcttgggtgtttctcgtatagggggatttggcagggtcataggacaatagtggagggaaggtcagcagataaacaagtgaacaaaagtctctggttttcctaggcaaaggaccctgtggcctaccgcagtgtttgtgtccctgggtacttgagattagggagtggtgatgactcttaacgagcatgctgccttcaagcatctgtttaacaaagcccatcttgcaccgcccttaatccaattaaccctgagtggacacagcacatgtttcagagagcaccgggttgggggtaaggtcatagatcaacagcatcccaaggcagaagaatctttcttagtacagaacaaaatggagtctcccatgtccacttctttctacacagacacagcaacaatctgatttctctatcttttccccacatttcccccttttctactcgacaaaactgccatcgtcatcatggcccgttctcaatgagctgctgggtacacctcccagacggggtggcggccgggcagaggggctcctcacttcccagaaggggcggccgggcagaggtgccccccccacctcccagacggggcggctggccgggcaggggctgcccccccaacctccctcccgggaggggcggctggcccggcgggggctgtccccccgcccacctccctcctgggtggggcagctggccgggcgggggctgccccccccacctccctcctgggtggggcggctggccaggcgggggctgcccccccttcacctcccagacggggcggctgccgggcggagacgctcctcacttcccagatggggcggctgccgggcggaggggctcctcacttctcagacggggcggctgccgggcggaggggctcctcacttctcagacggggcggctgccgggcagaggggctcctcacttctcagacggggcggccgggcggaggggctcctcacctcccaaacggggttgcggccggacagaggcgctcctcacatcccagacggggcggcggggcagaggcactccccacatctcagacgatgggcggccgggcagagacgctcctcacttcctagacgggatggcggccgggaagaggcgctcctcacttcccagactgggcagccgggcagaggggctcctcacatctcagatgatgggcggccaggcagagacgctccttgcttcccagactgggtggcggccgggcagaggctgcaatctccgcactttgggaggccaaggcaggcggctgggaggtggaggttgtagctagccgagatcacgccactgcactcagcctgggcaacattgagcactgagtgaacgagactccgtctgcaatcccggcacctcgggaggccgaggctggcagatcactcgcggttaagagctggagaccagcccggccaacacagcgaaaccccgtctccaccaaaaaaatacgaaaaccagtcaggcgtggcggcgcgtgcctgcagtcgcaggcactcggcaggctgaggcaggagaatcaggcagggaggttgcagtgagccgagatggcagcagtacagtccagcttcggctcggcatctgagggagaccgtggggagagggacagggacagggacagggagagggagagggagaacaagtttttaaaataacttttttttaatttttattttatttgagttcattcctaaaactatatgtggtagtaaatttgtaaacaaagtcaggacttattttgctaagtcaccgcagtgagttccttacataaataaggaagacacctgtttattagtcacaaagttccaaccacatcttgttttgcacttctaagagatggaatacccccaatgagtttcctttgctaagcacagagaaggaaacaatgctgatttctagactttatagctaagcaacatttatgctttcagaaatgacctcagaatcctcctcaacacagcattctaggcagcatttatcaattgctttgagttgtaatgcaagccgaaacatacttatctcctccagagtttaccacttaaatggctcatcatgaatgagaattgcctttagtcatgactcagtgtgacattaagtagtttggacataaattatttggaatatgatagatagcctttatatgagaattgtacctgatatatataaattttgctagctgcattccatagaataagagaataaggtgactagatcttcaaggtactgaagttagaaaaactgattgaaatgaaactgtaagaaatgcctaagtggtacaatctatgatcatctagaactgtttctgctagtcaatgttagatactttatcatgtgattaactgaaaatgttctttaaaaaatgccacaactaaagaggcatgtggggctgggagcggtggctcacacctgtaatcccagcactttgggaggccaaggtaggtggatcacctgaggtcaggagtttgagaccagtctggccaacatggggataaccccgtctcttctaaaaattcaaaaagtagccaggcatggtggcgtggacctctaatcccagctacttgggaggctgaggcaggagaattacttgaacccaggaggcggaggtggtagtgagcagagattgcgccactacactccagcctgggcgacagagtgaaacactgtcgcaaaaaaagaaaaaattaaaaataaaaaaaaagacactgcaacggggtgcctttcaaatattagctgaaatgctagaggaatatatcagaggagagaaagctcacccctagaagaaaatgttaggtatggcttcatagagaaggttgcattaatttcaggccttgaaagatgggtaagatggtaggcagaaactggaacagggtccacattccagctgtacagactgtatagagtttcttgagccaggataatgaatctcaaggtatgttccctgaagacctagctgagttaagagtacctggtaagtccagctaaatcctctcccaacaccccttcctactggatttgggagctatccttatgcctcccattcttaccctgttcctcaatctgaatgttgattgtcagggaacttcagtataatccacgctattacttagcccaagtgggaatagtttgtagaaatgactatagccggttgaacatttccattccaaaaatatggattaagggccatgtttctttattgttagcattctcgctctgttgccaggctggagtgcaggggcgcgatctcggctcactgtaacctctgagtccctggttcaagcgattttcctgcctaagcctccggagtagctgggattacaggcacgcgccaccacgcctagttaatttttgtatttttagtagagacagggtttcaccatgttggctagggtggtctcaatctcttgacctcgtgatccgcgtgcctcggcctcccaaagtgctgggactacaggcgtgagccaccacgcccaatcaagaagagctttttaactagagattttaaaacaaatagactttaatttttagagaagttttacatttacagaaaacatgagcacatagtacagagttcttatatcccttctctacctttcagtttccctattattaatatcttgcattagtatggtacttctgttgcagttgatgaacaaatattgatatgttaacaaaagactatagtttatatttgggttcactctatatgttatacatatatgggttttgacaaatgtatgtcatgtatccaccattatagcattatacagaatagtttactgccctaaaaatcccctatgctctaccttttaatccctccttccctccccctaacccctggcaaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagctttgactgcatagaaaatgtccatccagtctctgtttctaaaacatgaaattctttaacgttcttaaggcaaacaatttttgtaaaacttttcaccactgatggggttgctcccccttaccacaccagatttaagaggatagtgaatatttatgtctataatagcatgtgaagaatgtggctggtgaaaataagtggaagaatatacatctcgggctgtttcttcagtttccgggcaggctgcaacacttttaacactgctagtgagaagaaaggtgagagagttagctttcctcttggcttggttgcagttaaagtggattcccgaatctcccattttctacattataaatattgagagggacataaatatagatatatggatatgtttgtttgtttttctccctcctgtacttaacaagtgtaaaatcctggaattttctttttccttacttatcacaagttttcttagtctcaatcctttgtagtatttaaccttttagataggagaggtaaataagcccacaccagataagagttacatcacagtagctataattaaggaccggcatggagacatttttaataatagacttgcagccgggcgcggtggctcacgcctgtaatcctagcactttgggaggccgaggtgggtggatcacgaggtcaggagatagagagcatcctggctaacacggtgaaacctcgtctctactaaaaatacaaaaaaaaaattagcccaccgtggtggcgggtgcctgtggtcccaactactcgggaagctgaggcagaagaacgaacccgggaagtggagcttgcagtgagccgagatcgtgccactgcactccagcctgggagacagcgagtctccgtctcaaaataataataataataatgaaataatagacttgctaaatctgaggttaaagtgaacatttttaataatcagtcaaggttaaaatatttgtttaatatggtagtcaatgaaaaaatgttctaaatgaaaacctggtactaaaattattatgtcttcaggttgcctagagaagctggtgaggcactagatattacactgtttctcctctttggaatcatatagttttgatttaattaacagagaaagtctgcatatacaataggggatagagtgtggattttacttctttaatggtttgacaagcagattgcaacaaacaaggtatttggaagcctgctagggtcccagaggccttataaatatgcagtgcacttctctgcatttccccgggtccctgaggtagagatttgatgaataaaattaaaaccaccagatctttttgtatagcttttagctatcactaatttaaactgagtaatgactattttacaggtataccttcagcagtttaaaaagcaaaggaagtgaaatgtgaatgtgttttgactttgtattaatttcctcttaaactgaaagattttctactttttgcatcatgatacgttttctttaaacctaatttcaagagtaaaactctttacgcccctgtaggattgttttatatttaatagtgctattgagactggcatgggacaaaacatgcagacaaagaaagtatttcttgaaaagtgatgtgtatttatatataaacacaacgttggaatagcatactccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgcaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgcagtggcgcgaaattggctcactgcaacctcggctcactgcaacctccgccacccaggttcaagcgattctcctgcctcagcctcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaa

SEQ ID NO: 2558 - DNA, 465237 bp, Homo sapiens
gttgtagtgtagcttggttttatttatgtccacaaatatttcaaaaaaattacaaaatactcaaatggagagaacacagaagtcacgatttctgggtgtctactgtttacactgtgttatctcatggcaaactactcatatatacatttagcttcaagatatatagaaacgtagcaaatccgagtgtgcacgctgcctctgccgcagtggagtgaagctcaacctcgaggacaccgaacaagatacggacacacacagaggagccaaaccaaaccccgaacaaagggaggaaaatccgaaggaaaccgagtggttgggcttcaaagacaccatgaaggtcagggcctcctaaacaaactgtagtttatctggtgagggtttcgggtcgagggttttttagatggaagaatctcagcgcttcgccttgggatatggggagaaaagcaaagctaacaagaatgccttcggacggctttcaagcacagacctcagaggactcgactcttctttggaaaaatggatgccaaaggaggagataaagaaggtttaactgaatggtagatgttgtgttctaccaaaaagaaagaaaaaccagaagccgagaaggtgggggcctggatgcaggagtctgggagcccagcaggaagaggcctcgctcagagccacgggaacaagcctgccatgagggcctgtccccaccccagaaggaaacgaatgccttcaagccaatgtggcctgaagtcccacgacaaaaggttcatgtcagctttgcctccctgtgaacaaactaaagttaaggcagaaatggaatgagagaaaaatgaaagaaaaaaaactagaaacattttcaacagacaaaacaagcctatcccaactgaaaccaaacacggtttttaagagaaactggaaatgtcgctatttgacgccagaacctgaatttgagccagtagctgctggtttctagatcaaactatcagcatctcttcctgctccctctgcggcctgggtcctggatggactttgtgtccgccgacccagtgtggtctctgtcctacaattcttgggatgggaccagcacaatggcagaagagacctccagtgtctgagagaaaaggatcggaagaggccacgtcctggcaggaagcagggccgacagagggcagacaccccagaacacccgccctcagcctgggagaaagtgcgttacggctgcagcctggaaacgagggcaggctctctccaggacggttccgctcagaagggcctggcctcctgagaagcagcccccacacagcatgctttctgaatgcactgtgggtgggactccagttcccacttccaggatgaagagtgggactcaaatggtttaccagtgcaatgtggggtcaccatgcagacctgcccctagggtaaaatacaggctgcccccaacacctgtcttaactccaggatctcccttgctcaaaagtggcctcaatctgtggcaagaaagatggggccgtcctcaccacaagatccaagtgacaatgcgcatgagaaggcagccttctaacacatccctttggcaggcatatgtcctgggtcacttgtgtgctgagttatttgtatggaatcattttcttagatgatgaaattttcggagtattaaaaaagacattcatccagaacaatcaagtgtgtgtacacagaaatctagaaggaaatctacaatggacacaggcccatgcgctttccatcccgtggaaacagaacagtgacactggagaacagaaagtgaacattcacctcctgcactccctgtgcaaaatggaagaggtctgatggagcagatgtctgtgctgctggcagagcacaggctaggagcagacacaagtgaaacgccaggcagaaaacagagtctgtaacatcgtccctgcaaaccctggatgctcgctgctgtgaccaggcctcggtccaagcctctgtccatgtggaacgcccctttgctccctttaattaaagggataattatatataactttttattaaaaaatcaactctgtattctgtcaatagttggtaggaattcacaattagtgacatggctggaaaaaatagatcacaatagtagtttatggaagaaaaaaaggctgttctaaaattatttatttacagacgtaaaaagccatgctgcagaactttctccaattatgaagatttcctacaatgtattaaaataaaagatttttttttttaaaaattatagctcttggattccaaattcctatgcccccgatctgcaagcctcgtgggctctggagcactcgtggcggagtgtgtcagtgtgtctgcacgcacagtgaagggtgtgaactggattctagcacctactgagaaatcaaggaaaagaaaactaaagccaaaccccaagattgcagggaagctttctggatgttcagtccagtccaggactcactaagtttctgggggactgtcatgcagggagatccaaaccagtctcaggaaatcctctcgacaaacgaacactactatgtggatacatttttagttgtgggtttttaaatatataaagaaatctttagaagatattctttttgcttttgcagctcctattttatgtaaaaagtcctgtttctccccccaagaactggggtttccacagccagcgttaacaaataaataacttataactgcttgtcaccttctttcttcagtcgactggaaagacaaaacaggaaagcgtatttagtctcaggcctaggcaggcagtcacgcaggctggaggcaaccccaaagacaacagccaggcaatccaaccccaagcccgcagcctcctgtgtagctgacctaccctcccaacacctcccttcctctgtttctcccatcaccatggttccacaatgtcccctccagggcccagcaggcagagggggaggagcctggccctgggcacacggggaggttgggagcctgggctcagataacccctccactccctcccagcaccccacctcacctgtaataatcttcctgacttggtaggtggccaccatgcatgtgggggtgtccatgcagccactgctgctccatggccagtctctgcagctcggccgactgggcatgcatggcctgcagctggtgggctgctgacatggggggtgggatggccccaggcaggtcacgggggtagggggtgcctgccgaacacaaaacaacctgcgctacagaaatagccagaggactggccaagaccagggcggcacaggcacagcaaacggcaaagagcacaggagaggtgccagttcggacacaggagccagcccctcccagactctgcagacagccagagggcagagcctctggggaggcaggaggtgcccttgggtgcctctgcctggacctgcctggcccctcctccaaggcctcagcccaagtgcttctccttcagagacctgccgtgagtcccctctgctactttcaccggctcttagcaaggctgatgcatttatgacccctaccccagacagcccccagagggcaggaggcttgttcccccacggaccccctgcatgcagggggagcgaacccacctgctcaatgcatgaatgaatgaatgagtaatgaatgaagacagcagaccagaccccaacccaaccctcacacggcctccccgcccctcctggaggggaagtcttaccgaaaactgggtggcgaagcatctcgtgctcgtgtgggggctgtccaagcagagggttggggagagtgccaggcgggtaggggaagcgagccaggtggggaccggcagtcagggggtcgaccagcgggtgaacggggcctgctgaacctaaggaaaggacaaaacgccagatggaggcggtgtgcagctcttcaatgtttgtcccccttggctggaatgaccgatgacttcctcctcacccaggatggctcctggtcaccagggctggatgcaccacctggctacaggtggccctgccccaaagtggctgcctccaccttcagcaagagctccagaggccgagagaagtgacgagcccaccgctgatgcaggcactccctcgtccgcttgtggagtgcccctaacaggcaatcccaggccagttttgtcgaggacccgggatcagcagggtccctctcgccggccacctgggcctgccctctgcctgtcaggtcacaggaacacacagccttgcgccagtgggtgttgggctggcaccccctgcccagggctgtctccctgctcttcactcgcagaacctaaaggaggccagcagagtgggtggcgcagaatggggacctggcacagcactgccctctcctctctgctggcacaaatcttgcgtctctcccttcagaacgttgccttgatctgacctcactgcaccacctcctgccctcacctcctatctcccagctccagccaacacaggcgctggcagggatttcagggttgccacctccagccatgctgccctggggtccctggaagattgggagcccccgctctgcctctgtggctgctcttgccccgatttcccacagcttgccctttcatctcctccatgtttctgctacctcctcagcggacctctcctgacggccttctcgaaaccgccatactgcccctgcgcccagctctcctgatcccctcttctggatttatttttttccagaacatatactttctgcctctcacaacgtggcacacgtctttcaactatctccccaaactggaaggtaaatgtggacaggggttctgccagcacctacaactgtgcctggcacattccaggggttcagtaaacacttgctgaatgaatgatgcatgaatgaacaaatgactacctgtcctcaacactgctcatactgaggcttgtaaggtctacaccaggtgccaacagagcttcagatatgaggacggcaatggtgagtgctctcccatgtcaggactgggtacaggggcaggggaggcgcctggtgcctccaagcaaggtggctccccgccctccctctgggccctgctctatcagtcatcctgccccacactggagggtggccagtgaggaagccctgcacgtaggctgtcccacaggacctgtactccaagtcccatggagcaggtgaacctgcctcctcgtaagcacagtagccaccccctgcgccatctcaccaggctgcagagggagtgaggatgccagctgggcctgcctctgcctcagagcagcctctccacagctggtcaatgagtggccttaaggagctcctacttccagggtggacaggactgagcagccctggccaggtgggtcagctcggaaaactcagccaaagccagcaggaggcctgcccagcctcgctcctcaagggaagaggactgtgcttttcattctccctcagccacccttgagtagcccagtgccttatctgtacgttccttggctccaaaggccacatgacactgctctgctgcccttaccctgccctgtgggcctaggccacttccctccatcccaggcacagggccaagaacccaggcttcacccgtgtgctgcagctgtctgaggccttgcagttctggagagctgcggggccgaggagagactgcgatacagcaaaaccatgacggtagtggatgctgagctcttctaagatctgccagggatgagggatctgttcagaaaagaacagtttccgctcctggatggtgactgtcactcatcaggctctgcacccctccccgtgcctctgtcccacctgccacgctggggcacgcaccttggtggagggggtcctgctggtggaggtggaggtgggagtgaatgtgagagtgctggtgatggtgcggagtcacgttgaacatctgcagtcgggccaggggatcgctggtcagcgatgccatgcgctctgcgtggatacgctcggctgccagtctgtcagggtagctcatctcgggccgcagctgggggcccgccagggccagtctctccctctccaaggggttcaggcccgggtggaaagaagcaaaagggtggggcccggcggtcggggggatggtgagggcgctgtgccgggcaaagtgctccatggggttggcggctgggtgcagggggtccagctctgggggcttcacctcgaagcccggcttcatcctctcccgcagctcccgctctcggatctcccgctctcggatctcccgctcccggagctcccgctcgcggatggtggggtcgacgttgtagaggccaggcatgtggtaggccagcagggggtccgtggggttaaggggcatgtagaaggggtggttgcggttggtgggcgacatgacgtggggccgggcgtactcgctcagagtccgaagggcaggtgtgtcgggcccgatgtaggggggcacagcagcaatggtggttggtggtggctcgaaggatggccgcatgtggccaggaccactgagctgtgggtcactgaggcgaccttcatgcgctgagctggacgccttctgcagaaggaaaagaaagcgtgaggggtcccccgagcgcctggggtctccgcttggtccacactgcggaggtgggcctggtcctgctcctggcctgctctgacaggccaacctggtccctccacggagacccggccctgccttggcctgacaccaggatgcagtccaggccccacagggtcgggctcacctgtgcccgcagctcccctcaggcccagatgggaatgtgtccctgtgagactaagctcatgcatgggttgtctacgtgtgagggttgtgtctgggagtgacagctggggggcatgggtgagtgagcccagcaggccaggaacctcactggcagtccctcatgccacttcctgggttggctgccctttcctccccgcgacagcagagagctggccaccaccacagcacccagcccacgagggggccacaaaggcagggcagctggagaggcccctcgcagcctgcttatcgcctgagtgctcaggtcttctctcaaggcgcccccttgtgcttctccccgactccttcaaattacttagaagttatgaacccaaaggctgcaggagaaggacaggccctttcctcgaaggccctccggtaggaggacgcacagtcactgctgggagtcagcctagacctgccatgcgcagttaccccggcagcttcggatgtgcagcacccgtcagaggtgtggagacagggtgtaaatagcacccaaccctctagctgccaggaggccgagtcaggcagccaagggcagagctcggtggcccagcgtggctcccaggcgcaggatggaccagcgccccccgtcacacctcgccaaccctggactcacagccgcccgctctgcctcgcgctcccgctctcgctcccgctcccgctccttctccttctccttctcccgctctcgctcctctcgggctttctgctcagcctcgcgcttggccttctcaatggcctcctccctcttcttggccagcttggacccggccagaggcatgaagtacaggtctgtccgggcacacgagttgtagccccggtccaggtgtttgtagaacctgagaaaagccacagatcttgctgggagctcctgccgagacccaccccggccctccctcccaccagaacttgcccccaccagcccacctgtgcctgacccgtcctggagccctaggaagcgtacctagctgactggctggcgtgactgggggtgtccaccacagtgggctccggggacgggctccttggtgggggaggggggctctcaggctcctcagcgtcgtccagagcctcctccttgatctggacggtggggagtgggcaggacgacccccccgctatgctgcctcctgaagccgccgcaccagagcagggtggctgggccgaggtgccaggtcccgccggtggggtagaggtggaggggcaggtcggaggggtgatgggaggagggcctccagggacaaaggggtgctgagcaaacgggggttggggggccacctggtggaggcctgtaggggggtgggaggcagggggcgggggcaggttctggctctgggtcagcccggggggctgggcgggcgaggagggcaatggctggctctgaggcatgagttgcaggggtggggggtgagccgacggggggtgatgtgtggacagggagctcaggggcttcagggctggagggggaggcaggttggcattcatggagaagggtgagggccccgagaggtggggagggtgcttgtgggcctgtggcgccggcagctgggggatgggagtggtaggcgggggcttgatgtggggcatggccaagggcgctggtggcaggggctgctcccgtggaggctgttgggactgcagcgctgactgagaggctggcagctgcagggaggtgtgagggtacgctgctgctggggaggtccccagaggggcctggccttgggaggcctggggagggaggccaaagggctgtggggggcctgggtgctgcagcaggggcccagcctgcaggctgtgagggccgggtgggccctgaccgtgcagtgggggctgggcatgagagggtgcagaaggctggcccgccgacccagtcagaggctgcagcgggggatgtggcgagggatgcggcgggggatgcggtgagggcggccgctgggggtgcaaggccggtgcctgttggatgtgggtgtggggaacaggcgctgtgggagcctgtggctggttaggggcctgggaggccgtgggggagccctgtgggggaactgcagtggcagagggcgtgggccctggcgtgggcagctgaggggtccctggaggagctgaggagggagctggggtgaccccagtgggagcctgcaaggctgggggctgggcctgcagcatctgctgctgggctgacgagtccgagtcactctcattgtcctgggggctggggatgctcggggacgtgctgcgattgtcctggtcgatgtctttggggtcactgctaccctcatcgttgacgctgcgactgtctgaactctctccctcaccttcagatggcgagttgggcctgctgatctcctggagtcagagaagggaaggatggaagtcccaggagggcagagccctgtctgctctgcaccaccagtgccggacacacagtaatgtttgtgcagatgaagcagcaagcttggctccgggaccacaggtcgtgccctgacccagccagtgtcaaaggccactccagccccaccctaggagacagggcacggccaccaactagggagaaccccggctgggggcttctgaagaagcattagctttactcagcaaggctcagcagcaaacctcacctgcgtttttgtcttcttggagctggtcctgtcagcctcctccgtatcagaggccaccttctcccgctggcgtttgttactcttaagaggggaagaggcttcctccttcaccttctgcaggggaaaagcccacaaggagcaatcaggccaagggagaccatcccatcagcctcagcaaggaaatgacggtttgcagacactttgctccctcattctgagttccatctccaggagcaaaaagctctagaagggtcaactggggccaagaaggaacacgtatctgggggtgggaatgagagccagccctctgcacctgtgggtttgcatcctcagattcaagcaaccatggactgaaaatgtaggcaggactgtgatggttacatctatactgaacgtgcacacaatgttttcttgtcattatctcctgaactagacagtggaaccactgtttaaactgcatttacattgcactgggcagtagaagtaacctagggatgatttagagtctacaggaggatgtgactggtcacatgcaaaccatgtgtcgatgtatatgagatttgagcacctgtggattttggtatcctgggcggtggaggctctggagccaatctctaatggataccaagggaggactgtacttggctctggagggagccgttctaaccactccccacactttctgagaacttgggaagcttgaggcagaggtggcccccaagagttggtgctcgagcccccttctctaggcccccagccttcggtctgcagcccctaggccaggacaatgctggtgtccagacaggctccatgaatgagctgcatcctcgtgtctgagggagctgatcacgaataccagcaaaccagttttaatgtgagggagggacagagtaggccctactatccccccagcacctgaccttggccgacttcttcactgtctctgctttactgtcattgctggaggtactggcagcgctgggggagttccggccgctggagcggatgtcttcattgatgggtgaggtgcgaccatcagggctggctggctgcttcttccgaccactgcgtagtgtcgacatctgcccacccaaaccgaagactggtgacaccagattcccagtccccatgtggacccacctgagcccaacccacaggcagaagcctgaaggcacaccctatcagcctctcagcaaatcccagaccttggcaaacaacaggccgccctgcctgtccctggctgcatgaaggtcggtgtggagctcagggaagaggtggggaaatcagtgggctcacgccagagggcggttctcaaacctaaagcactcatcccaagggactgtcctgaacaacgtgtgctggaaatgaaccacactttctgagcggcagaaagtcgcctggggccatctttaaagcaccctacaccctttctgtttattcctcataaccgtccattctcccaaccaaaccaaatgaaatcaaacacttgtggatttaatctgacaggacaggaagtgacccaaagagatgaagctgtcaagtaaagcagctcagctccccaagccgccaagcgcttcagcatgtttctgcaaagccatgagggctcagaagagatcaggagacaatggttctggctggttgacctgctcccttctgagtgagcgggggccgggctgccagcagcctcaacggcatacaaggggcagaggaaagtggatggtcccacccacctgccagaaggggccataagggaggctgaagggaaagaccctgtcagtaccctcagccccaaacctggaaaaagcctctcccaaagtccctggcacatttccaacctaggaaacaaagtctctttatgggaggagctatgcagtgagcagaaaaatgtatcggaagtttccaaaacgggatcaaacatttaaaaaaaatcacaaacacactaacacaaaagagcctgcaagtttaaaatagcagagatttgatacaatggaagtgacaccacaagcagcagccttggagagcaagaggggccttggagagcctgcactgagccagaagctaagagcttgctacaaaacccagagcaggatgccaccctggggcccctcgaaggagagaacagagaactcttcccagcccacaggcaagctaccgcctcgggcaaagcagctcccctccaggactttgtctggtaaacaagactttcgcttcctccccctgggaggctcaagcccccacacatcccaggaaactgaagaagttgccaggagccccatggccccaggggactcaccgagccccgactccgccgtgtcctcatgctatgcttcccactgagcccatcatcctcttccttgacgggtttgaacataaacggtggcgggtccacgggcttctcaatgggcgggagctcaccgtatttcttgaagtggatgcgacagtcggtgcaaagcaggatgttctcccggcctccgtggtgccaatctttggaggctgtgtgagggaagtggtgggggccaaccttggaaaccatccctctccctggggatgtctgggcagaggggcccttctgtgggctctacccaaacctgatgccaccagcaccatgcagccctgggccccaacaccccagggctagtgctgccctgctcccccaaggccaggagagggtttcaggggcatctgctgcccacttcaacttggggtgcccaggaaaagctggcagcaagctcctgggaactacagtgtcaaccccccaatcccactcaatctgtcctgcctaccagtcagtattccataccgactgccaagcagaggagtaaagtaaactaaacatttctaactttctcgaatcccgaagcacaatgcaaatgtcaaatcaagtactgtccctggcaggtttccagctggatgcatgaaatgttcagaacatggaagtgcttgtgcccccgccccgccccaggagcgtgacgaggccacttactggtggtgaagcagtggcggcaggcgtaccccttcagctcctgctcactgtcctcactgtcgaagtcatcttcactggctgaacttaggtccactgggcgtggcaggcacatagtgggggtgggggagacaccatcatgctcagccaaggctgggccggtggggtgggggggaggggggaacacctgtgacctctggcctactgcaggttctggccaccagtcagagcggctgggtgcacaggctgaggtaggacagtgtctgcaaaggaccacttcgagctcctcagtgtcagtcaccaggacagagggcctgtgtgtgaggcgccatacccaagggcctgccctgccactgatgcccgtaacgggtgagtctgaactgggacaagcgcgtccatgctgcctccctccctaatacgcccaggcaatcctgagaaattccaacttcaccgagcgcccccaacccgtcctgctaggtgatttctagtcgcctgcatgcgcaacaccggcgcccctcaggttcagcgtcccgggccaggacagagctataaggcacttttgctacaccccagttttttaggggtgagaaggtgtgggctccagcatcattagattgtacatcatactgggaccaaaaagaggatcttggtgaagcaggaggaaaaagaagaaagtgttaatctgatcttcttacaaccaaaagtgcaatgagaattcaagcaggacatcaagtacatcatctgtcaaatggaaaaccttcccaggacaaggccaaaaacatcccaggccaagacgtgtattttttgtaaaaacctaagatgatgttgagtttatgagaaatatttaaatgtacaaataatgttttaaagtctccctcctgaatccttgtcctgctccccgcccccaccatcggtctatgtttaggtcaggcttcacacatgcactggagcacgggtgcacaccccctcatgcttcccggagccatcagctcctacgggcccagagtgggacaggctgcccgtgaacagtctcccctccgcccactgtgatgccaagacccctactcacagaattcactggacgggggtctggagggtgtgttgacgggtgtggacgcggtgcgagtcttaatcctcctgaacacggcctgcctgcggtgcctacgatgggctcgggagctggctgcttcgggggtcttcttccaatagtaatagaaggtgatcagctccccctgcagaagagaagggctgactgtgggggagggcctggggcttttccgtgccccacgcaccctctctgccacagtggaaagctgggtgtttaacagctgtgccagagatgagaataaagaccagtcgctcctggagttgggagaggaactgggcttgcccaagaaacagccactgagctgcccgtggactgcatgaatggggcccgcctcctcagcccagcacagcttgacttccagacaccaagaacaagtacttgttgggtgtctgctatgtcagaccccaccgctgttgtacacatgggaggtacacatcatccacaatggacgaaaaggagagaagattcctgcccacgaggagcttacattctagctgtgtgtgcacgtgagtctgtgcatgtgtgtgaacacaacgatgctttctttacagtaatgccagtgaaatcacacaggtgtgagaaggaaatgcccggccagttagactcccccagaaacaaccaaccaaccaaagcaaactgcccaggtggtgaggaaccagggccaaacagaaggtggggaagaacagagaccgcatgctcaggaaactgctccacagcctccacctggctccatctgaaggcccacatctgacatgccggcacgacgtccagaggcaaggactgggcttggcaaagaaagactacaagaggacagacacacagtggtgctgatgcaaaggtgaaatatcacacaccacaaggtcaggcttcttttcatggcccagcagaaacaaaagcaagatacctttttggaaatatagcaaatgtaagctttttaaagaaagggcactttgggcacccccagccctcagggcgctgcaggctgccatctcaccctacacacaaaagacgatttcttaaacatcccaagataaagtctctttacctagaactgaaaaaaaaaaacaaaaaaaaaaaacaaaaaaaaaaaacccaaaaaacaaacacagccaagtgagagagcacagatcacttggtttccctctaattaaatcaacactgtagaaagtctattagcttggcgactagatgctgggagttgtcttggaggtacctgcaccctcactttgtctcatcaaacactgtcttgtgaatggaggaggcaaaaagagagaggggaaagtgagagagggggatggaaagactagtgttggaaggactaaaatagacaaaccaaacaaagacatgtagctgccacatgacaaactcacccatcagaccagatttcatccaaaacacccccagaggaaatggcctcagaacacagtgacaagagaggtgggcagattttaggtggtggggtggcttccgcaaggcaggggatgccgtgccttgagtacttgactgcccacagctgcatcttatgcctgggcatttttgtaagaagtgggaccacggctgcggtccctaaaggagggctggaatgccttgaaggagggctgactggcctataaagcccatcacatgtatctcctggagcactggacgtgtctcaacctccccaagcacttaacacttaacaaattactcctgatcaccaatacctagcagatgaagcataaccccaggccagcagggccagggagccatctcgggacaagcacactcatgtccctacacgtatgtgcatgtgcccacccctcggttccatgagatggtaactgaatgataaggagaaatgcagatactgccattggaatttctgactggctcctctcccccatgctagtctaggaatgcgagctacaactgtcccagcgggcatgagcatcctggcccctaaggtcatgatctgtgaacctcctagctcttttcacttcctgctttccagacttggaaatgcatttatctatactgatccttgggtgttggctagacggaaaagattcgtaaatcccactagggggttacaagatcactgctgacataaacgctgacttgtgtctggttttcctctgagaaaatatggaagagaaatcaaggcagggagcagtcacactccaaatgctctgtccaaggtcatgcttcatgagctcaaaagggcaactggtgctgtgataagtcacagctcaaattccagagcttgaaagaagaatgagaaaaaactcacagtggttccttctacttcctcagtccaagtcattttaggggctactgaatgataaaagcttgggatgtggccaggtgcggtggctcacgcctgtaatcctagcactttgggaggctgaggcaggcggatcacctgaggtcaggagattgagaccatcctggctaacatggtgaaaccctgtctctactaaaaaaaatacaaaaaattagctgggcctggtggcagatgcctgtatttccagctactcgggagtctgagacaggagaatggcgtgaacccgggaagcggagcttgcagtgagccgagatcgtgccactgcactccagcctgggcgacagagtgagactctgtctcaaagaaaaagaaaaaaaaaaaaaaaagcttgggatgtaagaagaaatgcaaagctatacgagacaaaagggaccaaaaacgggagagaaaaatcgagtgagaaggtggtacctgagcctctgccatgccttcaagtcttacctgaaggctgttaaaaagcagcaacctgacttttctaaatagcatttgtctataatgcaatattgctacacacagttataatcaattatttctatttatcaaatatatatgttttgaaatggctttaaaagatagtaacctgcagatcccaggttaagggaagaagccaggcgcagcagtttacgcctgtaataccagtactttgggaggctgaggcaggaggatcacttgaggccaggagttcaagaccagcctgggcaacatagtgagatttagtcccccacctcaaaaaaaaaaaaaattatctgggcatggtggtgtgcaccggcagtcccagctacttgggagatcaaggcaggaggattgcttgaggccaggagcttaagacaagcctgggccctacaggcccaatctctacaaaaaagtttaaaaaattagcccagtgtgctggtgtgtgcctgtaataataccagctattcaggaagctgagacaagaggatcacttgagcccaggaggctgaggctgcagtgagctacaaatgtgccaccgcactccagcctgggggacagggcgagaggccatctctttaaaaaaaataaaagaacacttaaaaacaagaagccagagttcagtgaggtaagaaactgccccatgccagacagaaaaaaggcttaactttcaaacctttgctcctggcttcactgatctctgccaacaagtgaaaaaaatcaagacccaaaagaaagaaatctaacattgaaatcaacatcaactttttgttgacacttaaagaagaagtagtccagaacagatttcaccatctgagtgccaaggatgaaaatgaccaggcaactggtttctcttcaaatcgaataaatctttcgccttttactaaaaaaaaaaaaaaaaaaaaaaaaaaaaagaagaaaagaaaatgaccaggcaggaaggactgtcctccacagcagtgaagtcacaggtggtaagaacggtaaacttacaattcaggaaggtgacagggtgaccagaactgtcatccactgctggtggaaatacagaatgctcaaaccacgatatctaccaaacaacccagcaattcttctcttatttacccaaaagaaaaaaaaaattctcacacacagactttcacggatacattcatagaaactattctatatatatatatttttttgagacggagtcttgctctgtctcccaggctggagtgcagtggcacgatctcggctcactgcaagctccgcctcccgggttcacgccattctcctgcctcggcctcccgagtagctgggactacaggagcccgccaccagcccggctaattttttttgtatttttagtagagacggggtttcactgtgtttgccaggatggtctcgatctcctgacctcgttatttgcctgcctcggcctcccaaagtgctgggattacaggtgtgagccaccgtgcccagccagaaactattcttaacagtccaaactggaaacaacctaaatgcccacaagcaggagaatggataaacaaataatggtatccccacattcactggactacaacttggcaattaaaaggcacagaccaccgacacatgcagcaacaccatgctgcatgaaagcaggcagacagggacggtgggtgctgcgtgagtccttcccagagatcacaaaaaccaaactagcggttgccgagagcctggagggtgggggacaagaaactaaaagaactcaggtaagcactccagggtgatgaaaatgctctgtaagttgaatgtggtgtcactgacacaaatgtatacagtggtcaaaactcatgaaactgtgtacttaaagtgggtgcatttttacggtattcataccatatatggcaggttacgtcaataaagctgaagaaaaacaacaacaaatccaggccgggttttattagctgcctctcaaccactgttatgcctatcaagggattcaacactggaatgaagcgagtctaggatcggaaatggcatattggtgactgcatgggtggcaaggtcttgagcacaaacaaaagaacatgtcggggaaagctctggttctacaaatagggagtgaagcagctagaggcctcgccaggaatgaagtcaattgaactttaatcaaacatgcatagtgtgtgctgcagagacccgctgcacataaattcagggaacaaaagctgttgcagaaatcaatagcttactgaaacattaacacaggcaatcattaatcaaaaggcagctccacaaaggcagccttgcaaattagctcctgattttgcctgcaagcaaacacagaggtataaaatgttgtcgacatgaatggcctataatgatcattttgctcctgatgctctcacctcatctcacaacaaggtctcacagtcaacatatcttatgtctcggtgctataattgcacacagcatgaggaactcaactggtttagtgcctgggcagaaatgggaaaggaagagggcgaagtcatctccaactgacagtgttcccggctgcagctcttgccaagagaagtgctcaaatccattgggctatatttagcagattctctctcctttcctttttcttttggcggtgggggggctaaatttttcccacaggtcatatgcaaaaagcctttggcaatgacaggagcttggctcctggacttaggagtctcttcccagcagaggtgtctttccaggctatacactaagatggagttaggaaaataagcaccattaggttcctttaatttcccacaaaaagaaaaacaaggggaagggagtgccacacatggaagagagagggaagaagtagtaagctgcttggcaccaggcaatctgggtgaagggccttaggagagaaggaaaaagctaaggatgcagagtcagctgactctgggcctagcggagggacagctcagcggcagccgctcctgccatccaggggcctgctgggctcaggccactttctcctcctcagccaccactttatttctgccccctccagggttaggctgcaagtctatcaagttcacacagacacaacgtaagacatcagcacaggtctttaagagctccctccgccgcctgggcaatctgggctggagcaacaggggccggggctgcctacctcctagaggctgcctgtacccatttcaggtattaatactggttctgctgttctggccaggcccagttctgctttatcttgggtaagtgataggcaacccgacccaggggccaagtgggtgcccctgtgtatgtgcatgtgtgcacagatgtgagcagggtctcctcccaggctttccaacaggccaacttacctgtgcgcatttggtaaactaaacactatccaccaacacaactgctatttaatttcccacaggcagtggaatgctacgggaagagaacctgtaacctgtcctgtgataagccacatgtcttctctctctttaggggcatgggggagtgaaagagtagaagagattgttgaagaagaaggcactggaagcattttgactataaaaggctcactcgtagcaagcatgcctgtttcaaacagtatggggcccagcttctcttctgcccgagcccagcatgaactgctcagacaggatcctctgagaagctgacatggaggcaggagaaggttaaatcaatggtttctgctgtcccatattagaagcataagggtacacccaagattgagtcccactttttttggtaattatatcattattaccacatcacccaagaagtctggacactcccctgaggaaggggagggagtgcaatagaagatgaggtctggagactcccacacacggtatccagggtgtctgcagcctgccacctaccatcaggtcgtgtgtgtgtgtgtgtgtgtgtgtgtgtgtgtgtgttttaaattaagccaaagaaggactcagtcctttgtaaataaccgtatgcgcaccccctttcgattcagttcacagagaacagtgagaatcttccactgtcacaacacagttttacgaccaacagcaaagaatgatgaggactgctggccttacggctatgttaaggaaggccctggaacaccagtttcctgcctccttgcccatgcagacagaggggagatacaggcaggcaggcatctaaaccagatccctgcaacgtcacatatgcccaggctctggccttgtgccactagtgagggtcagctgcagctcctttctttttcacaaacgaagtttccaatgggcaccctttctgggccatgcatcgcccactaaaaaggagggggcagtcggagagaagggggatgaggaggcaggcctggaagcttctcatggataacaggattataaacacaatttctttccgaagctatttcacaggtcttcgaagcccacctaccactgtcagctgagcagactgtagttacgtgatgggacaggagccaacaggggcagggctgctgagtgcacatccttgtacgcacctgaccccatcgcagagtcttagaagtaagcatttagaagaaatcattttaattctttaagacacaagattatctgttcctatggctaaacaaatattttaacatgaatacagaaggagcagctaaataatctctacacaatgccttaactctcggtgctaatgtgcaattagagtcagaatgttgttcccctgcttaaacttttgtttgaaaaaatgccccacagtgagcatctggctccttctttggtggtccacgtaaaggggatgaagaaatccaccccttccttactgaagtggagagatctaaaacttttttttaaggtatgttttttcagggagaaatcccagcaagcaacaaataataaaaaacaaggcctcaaattatgtagggcagagagggagaaagaagcatggtgtagagctgcttcctaaacccgggcccagagagtgacccaggccatgaggaaagagctgtggccctgagagccggtcccaggaagtctgcatgcgacgctgtcccctgaagagctgccctaactggagtgctccaacgctgctgccgagtgcagtcaggaacatttcctggcatggaatcctatgcgagtcattctttcctttccctccccaacgattcaagggctggatctgacaactgttcagaacatctgaggtgagaagccgggcactgggcagaaccagcagcgatattcaggagcagccaccttctacagatctttttccaggaggcaaccggttgtcttccagtaacaactctggtaattaaagcactgttctcctgggctccttcttttgttaaccaaccgaatcctctaatccctaaaggagcctggcactgtcagcgggctctgctgctaatcgttaaatatcacctctgtggtctctgagtgcagcagggagaatgatgatctgcttgaaggcacacgcagagaagtggaattctgaaatctcagcctcctacgttcaagaggccgaagggctctgatctaaaccgccacccacgaggaagcccacagtgaggaggcagctgcctccaggcaaggcagtccctcggtgccacctccagatcctcttctggggaaaggcaaagggaaaggagggaagtacgtgaaggtcttgtggctttaacttgtaaataggtggggccagtctaagacactcatgaagatgttccttacccaggcacctttttataacattttaaaaaatcagttaaaaaaaattttttttttaccactacatttaccactccatttgtacagtgcaaaggaactgcaatagctcaagatttctgccaacactgaacactgtaatgagatttcctaagctctgtgttgttctggtggatgaactcagccatttgctaatcccaccctggccccacacctccactcagacgtctggacctgaggtcctgccacagctcttccctgggccggccctcccatgctgcacacagaccaggtgagtcttcccaaagccccgctagtaccttgccacttcttctccaaacggtcaaaggttcctcagggcctaaggaacaaaggcccagctgcttgactacttcttctgagactttctctgtgttaccggaagacttttctaccatattcctttctaccatattcccccgcctcacggcctttggcttatgtcaaacacaatggccagttttctgttcctcagcactctcctgcctgctgggtgagcccctgagccccataccacccccacctcctcctctgtccaggccctgtagtcctcctcatcactcaggactcaattcatcacatttgctgccttcttctccatgaagccttcccttcacttcactcccccaccactggatggcatcatacaggtttcactcctacatcttttcattcccgcctctgtgctggcacagacaggcttccctgtgctgtaaccatacatgggcccacccaacttgccaaagtacgtgctatctcatctgtgagtaccccacaggtctaagacaacatcttgaataagtattcagtaaacatctgatgaaatgattatttctggagaattaaaattcacctgaaattaaaaggataaaacttttgagaaatggataccgaattgccactttcttattttgccatgtaaggtcattagaagtaactgcctcctgatctcatcattattttgtaaaagaaatgacattttatctccaaaaaagtaaacagaaaaagttctttgattacatttactgttaggaaaaatggctacatttatttcttatgggccagtgaaaacgcaatccacatgccgatgtttggaagtggctgctctgaaggtgagtatcatggaatggtggcttaggaagccactgaaaatgcttcctcactcagcagccactgaaaatgcttcctcgctcagcagccactgaaaatgcttcctcgctcagcagccactgaaaatgcttcctcgctcagcagccactgaaaatgcttcctcactcagcagccactgaaaatgcttcctcactcagcagccactgaaaatgtttcctcactcagcagccactgaaaatgcttcctcactcagcagccactgaaaatgcttcctcactcagcagccactgaaaatgtttcctcactcagcagccactgaaaatgcttcctcactcagcagccactgaaaatgcatcctcactcagcagctttatttacaaacaagcaaacaacattttactatgaaatctacaataactaagctaagccatatctttttatatcttaatatatatttatcttttacatatactttatcttcatctttatttatattttatcttcacagactcccaaatagataaaccttcattttccctgctttacaaatgaggcaactgaagcacagtgagatgaagccatgtggccaagctcagtttcaatgaagtctaacgcccttaaccttagactctgctgtgctgctgctctaaaacgtttgaccatcatggtttaaagcactaagaggaaatagccatctagatttttttaagtgaggggggcaaatttgggctatctttgatctctggaatctctggagttcaacgcaatagcatcttaatcttcatacctggaccttcgcagttatggctgaggagcacaaaatatccctgtgcctcctggtaataacaggatgccagccttcccagctcagggtagagcccccatcccagcacccatggactacagaactgcacctgcttgaagcaacttcaggggcacacaaatcagaagcacatttggtagccatgagtgaagatttagaattatgcacatgtctatagaaacgctttctgcttcctataccaagaacaacctctatgacgacatgagacagacgctgggagcctacaaccatgaaccctccccacctcactacctacttaccatacctcacaccacccaccagcttctgatacaggagaagccctctggcctacttttggctctaggcaacatatgtcccagaaatgtgccaataagtggccttcacctgcctcttgatccaaaagcagtgatgcctgagtctagataaggtagagtccctaaagagatacgggctctgcccaaaaaaagatgtttgcatacacctactatacaaagcatctttccaaactgcttccagctagaagtatctatttaaatcagtggttctgaactgcggctcaaaaccgtacaggtgttggagggatcccagggtgggtctgctgaacctctatgaccttgttgctacccactgcaagcagatctattaaaaaaaattatattcattgatcaagcaatagataactattggtttccttgtttgtttgtaaataaagctgctgagtgaggaagcactgacagtggcctaacttcaacttaattaaaaaataatagtaattaaaataatttaaaaataaataaataacagatttggaaaccactcatttgaaggcaaagattgaggccactgcaaaacagtctaaagctcaggctgaactgaaagactcccacgacatgaggggaatcaccccggcctctggcctggaagccctgggcagttccaacacaatttcacttacatggaacccacacacacaagggcccccttggaggcttgtatttctaaacctcttggaggtttatttcttgttttactgaactgtttgtttaaatataggatgtaaatattttaagtgtaataatgctaataccagaaaaatcttgttttctcggtagagcctcccaaaccctaagaattcatttgttgacatcacttttctttcccacaagctgaacacttcattatttcctgaattcattttattagagttcagaaacagggcaagtgggatttcactgccgttggttctatcgccacctcacctttcttgatgttttctaccagcaaagggggaggagacgaaagaaaaaacgaaagccataaaactgttaaaactaccattctctatctcgtaaacatttttctatttattggcctttcattatatgtgcaatcttattatccctgcacagcatcaaagtgacatccgtcagggtcaccttataaaatatacatcggcaatgtaacgtttaatgacgggagcgggacgaacgatgaaggatgagagagcgaggcctgccgcaggacgtttgaaagggatcatcagttatatctgtgcatttcccgaggtgataattgaatgacaggggctggagggaaatccatttttgagctcagaaaagatagttaggagaaaaatgtttttgtattggaagcatgtaatgactgccaggaaatgggaacagctactctaacaacacttctcttatattttatggtttttatggatgcacagcaaattatcatgtataatccatttctgcaagttgaattttaaaattgctcaatacaaagaaaggaaaagaaagggtacttaattttctcactgcattacctttaataaaaggagcggaaacaaaaattacacttcaaagcacaaaaacacaagtacagtaccgtaccctcttcaagatgtgaaatgtctcatctctttcacctgaattttggacttcacctaaggcaaacatcttagaaaaattcaggcaagcctgcaaaccaggccctggcttctctgtgctcttgtgtaaacgtgcaaccagagccctctagcaaagaagctccaggaaggaaggggagagactgcagctgtctttatgcaactgtattggctgaactgtgtcctccctcaaattcctacgttgaagctctaacccccagggcctctcaatgtgactttatttggagacaggctcttccaagaggtgattatgttaaaatgaggtcaagtgagccctaatccagtacgactggtgtccttataagaagagatgaggacacagacacccacagaaggaagaccacgggaagacacagggagaagatggcatctacagccaaggtgagaggcctcaggagaaccaaccctactgaactctggtcttggacttccaacttccagaactgtaagaaaataagttctgttgctgaagcaacccagtctacggtattctgtcatggcaaccacagcagactaatacataagcctaaggacagggcttcatggtgagcctcgaggaaaggagaggaaccagcagagaagtgaggcctgctgaatgaacctctaagccctgggctgtgagacggggctcatggagctgactgtcagcagtgaagatgcagtctgctgggggagaagaacaggtgccaaagggtagagtaatgtgggaaacagcaaaataattttctactttaagtggggccaaacctcgcagcttatcctagcagctctaaagggcaaatgccacacagttccctcacgacggctgcattctgacccaggagaaccagcccaactccagaacagctctcagatgctgtggatctaaagacagctggctcgcgtgaagggacacgggggaaggaagagaaccacaagatgggaaggaaaactgctgccagcagaacacaaaggaagaaccctccagagtctctgtgggcctgtttctgaccacttaattctggtcagtttccacaggcaagagcccagctccatggggctgggcccgccccgcacagcctcccatgaagctgcgaccggggaaaggagggtcatgcagcccatacttcacagacagacaaatgtgtgaggctctctgaccaccacagctctgtggttccaggggtttccaagccactgttctgggttcctcacatcaacagacacactgcagttgagaaaacacacacaacgggaaccaccaggggttcgggtgtaatttatgaaaacagccatggatctccgaatctgtgactgtgactgtgatatgggctccacggattctctcctggtccatatctaggtctcctcaaaggttctttacagagggcggctggctctcccttaagaggcccaggaagtgtgggactggcagcgccaccccatgcaggctgctatgcatgtggggcccacagggggcacgcgggggtcactgtctagagactctaggaaaccgctccctactccaaagggaatttgcaaagatgatggggctaactccccagaggagagccaggagctcccttttccatttaacacacaagttgaatgccagatggacctagatctctgcaacacgctgtgtagtggggaagcctgcggggctgggtgggatcacttcacctaatgcagcacgtatgccacaaactcaccacagcacaccttagcctgcatcaaatcctggccgctcctgttctggagacaaatcaccactgttgtcatgatgggtgacctcagtcaccccactccaacgcccacctcacggctgacatggcatgtggcaggaggaggtatgtcactgtgctcccagaacataccataaccccatccctcccacccatgcatgtttatgctgggattggtctgtgatgcaaaggtgcccttggccctctctcgggaagtaattttttccttcatgcccacatggcaaaaggcctgcctctcttggcatgagaatctctaacagcctcagagcaagccatgctgatgatgagctctgcgtcctcactgctcaagcctaggtcccagacacaactcccaaaagtcaacaggctttttttttttttttttaaacgaaacaaaacagagccttgctctgttgcccaggctggagtgcagtggcatggtctcagctcactgcaacctccacctcctgggtttaagtgattcttctccctcaacctcctgagcagctggaactataggcacgtgccaccgcacctggctaatttttgtatttttagtagggatggcgtttcaccatgttgaccaggctagtctcaaactcctgatctcgtgatccacctgccttggcctcctaaagtgctgggattacaggcgtgagccaccaagcctggcccatcaagagcttttttaaaagcttgattttccagctgcagaaagcttcagaaacttttcaacacaagtcaaaatcctcagcaatgaaggagaacagaaaggtagagatttctctttaaggtgacttcagacttgagcccatagcccaggagcccctctgctgatgaaggaaccaaagtcagggcagagaggggcgttccagagctggaccttggagtcctggtcctgaaagtgctcagcgctgctgtaacgtctgccagggcttgggagcctccatctcctaccacgttcggcttcttgagtccttccctgggtaaaagggaccaatggtttttcccacatgtcctgcctctgaccccaggatctccttgggtgcagacacctggaacgccttctcctggttgctgctggcccacccctccagctctatgtgctgtcatccacaccacctcatacacactttactgacccataggaagcgagtttccgatgcgcctgtttccatgattaccaactctctcactcagctgtgacctttttgtggctcatacatcactgagtcctgcaggatatcaagttatgtctataacatgattcccctcctccctttcctccgactggactctaaactgcaagtgaacaggggatgtggccactctaaaccttgtaacctgcgcaatcattagcagagtgcctgacacaagatgggtgctcgggaaacgctaacttgaactgagatctatcacagacacacagacatagaagaattatactgcaccagaaatacataaaacagaggagtcactaacagtcataaaagtgaaataactcagtttcagtgataagaaatttggaaatctttcagtgaaccatttcaaaattgagctaaacacacataggtggaaaattagttacgagaatcaaaattattcaaggtaattattatttcccttaatttatctgtacattaaagtaaaaaacaaaacaaaatgaaaacaaaacacaaagagtcccttgatccatttaattagttaaggttactctcaaaaatgaaaatgatttccccagccccggggacgcgccagtgtgaaatgagaacaagagtcttacagggagtgttcctgcacatacacgtatgcactaatgtgcgcttggaatttaccagaacacacgtgttttttgttttacaaatctatgatgaaaccacacaggccttggcttgacactgttccaggggctaagtcttaacctgaattaaccaagctgcactgtggtccaatgacactttggcactaaaagaataacttccatttttctgaggctgagcgttttctcatttcacgctgtgagaatcctctggacctgccttaagagcactcaggaaagtggttacagtcaaaatcttcctctaaggattagtaataacacaggaccaaagctcaaaagcaggagaaagtgagcaccaaattccttcagtgtgctggagcacatagagacttcctgcaggcagatagcaagaggctctgggattatgcctgcaagctagccatgctgctaggctcttaacaaaacagaacaaggacagcctgctgagctgtggcctgaagcaccagtaatgacagctctctgccaacggcagtggtcaacacttccaccagcttggctccagtgatctcaggtccacctttgtgcccacaagtatcccaatttcttcaggaccaggtggcactctcagctgcctccacatgaattaacgaaactcaattcgcagcttaggctttggctcagccacgtgcgcatgcgtgcgtgtgcatgagagagcgcgcatgctggggaagaatggagaaaaacaatgaacaaacattgactgtctagcctttttcaactggagttcttaaaatgaagtgactattaatattttctcaattctcctatgaacggaacataacaggtacctttctagatgcacaggcaagacgttactacgttacacacaatggatgcccggcttctgaggcttacctctctcagaactccgagtgagaacagctgccactggctgcacgaccttgagcaaattccctaacctctcttggcctctgtttcttcattttaaaaatggagaaaaaccaccacaggaaggttaaggaacctcctcgagactctccttatctagaaacctgggctgcctcgccacgagctccctcctttatagggttgtggtgaggatggaagtgccaaaaaggagccggcacacatgctcagtaagtgacaggattttttcttgaaaatccttttccatctgggaaaaggaccagaaactcagaactaagttcaccttaaaggactattttaattgactaagttaaaaaaaaaaaaaaagtctttcaaagaatggtttctgcaaccaacttccttcctctatcatgtttcccctagaacgacagtgccttatgtagtcaaagaataagagaatgttagagatggtgaatggtaatggtgtctgggcctagttcacaatctgaaagataagcgctggtcaaggagaagagtattctgtctgaagatctcagctgcaaccagcagaaccataaatgcccaacagcccactgaggccacctaagaagcctgtctccacccaggtccagcttctctcttacacaatcggcaacagaatgacgccacacaagatcattaaacatttcagcaggaataaaaacgaaaccaagagaatgcacctgccaatctatatcaggcaactatggggtttgtgagccgtccttgcactttaatgcagaattagctttgatgcacagattggaaaggtccagcttaagggacttagaacatcccattatttaattttatgacaccatcactccactcttaaatgtgtcgaagaacatacacttatgttacaatttatgcccaagggccaggtgcggtggctcatacctgtaatcccagcactttgggaggctgaggtgggtggatcacgaggtcaggagtttgagaccagcctgaccaacacggtgaaactttatctctactaaaaatacaaaaattagccgggtgtggtggcacgcacctgtactcccagctacttaggaggctgaggcaggagaatcgcttgagcccgggaggtgaaggttgcagtgagctgagattgcgccactgcactccagcctgggtgacaaagtgagactctgtctcaaaaaataaataaaataaaataaaataaaataaaataaaaatgtatgccaaactacaatgaattctattgccgaattttaaaaatattcacttatgataatgtggggctcactagagtgtcacaaactccagaatgaaaattagtggcttagattacaaactctcgtagtagaaaggtctaaagactctttagaattaagcttgaaagaatctgtgtttctgatgctgagaagagcatagggaacaggttgtacaatcaaccgcctcaccccaaagcctccttgggtccactgcttcctcaggtcggggtcttactgtttattccacatcgtggctgtccctctacccctctaggctgtgtgactgggaacatgtaagctgggatgcacggaggtccagtctctccctgagtcatgcgcatcctgttcctgctgccctagttttttcttgtgggatacaatgtcagttctgtaatctgtcccctctgtaggggtaaagagatgtgctgacgtgctcagaaaaggaacatgcttctctggatgccatgaggtactaaaacacctgtatcttaaaggggcattaataagaagagcagggatcctctcctgggaactcaagcaatcatttaaacagtgctctcatacagcagcaaataaagaggtaaatgagatctgcttaaggtaacagcaaaggtgagcggttgtatgctaactccagataggagtgatgaatatctgaactgatgaatatcacttaaaaagtcttgtcacatatgatctggatcagaaggctgtgacatcacaaccagatgctttgaaggcattttctctgctccctctagttacagacaattaacagttctgtacactcttactcatctgttccagaaggctactaataaagaggttgggctacttgtttttcactcccagctaaactttctgtctcctgctgtgggcaggaatggcagtggcatgtgaccagcgttcctgagtggcagagggcaacagctggccatcaacatgccagtcatgggcacagctctcagccgatgcaacaaccacattgacttcaaggacaatctaaaattgaactcaaggcagcacctaacaagtctctcgtgcttgcaccttccttctgggcccatctaaaagcagctctgcagggcgatttctgccagccacaggtcctgtgtcctccatcttccttccttggaattcctagcaagactgagtcaagcatggccttgggtctatgctgttctttatgggaagcaccgaggaaaatacatctcttgaattattctaattgtatcttagaatttaacatgttcactgtctaaaatcaaaatgagtttcacatataaatgggcaattgaattaataatatcaacacccatcacagtgtaacaaataacttgattattaacttctactgacagccccatgcttccttcctcaagagtttcagactgcccgtttgtgctttgtgcagctagagggttccgaactctcaagaggcctcagggaaagttgactctgtgccttaagcagaaatcacaactgatccaagggagaccctggatgcaactgcaaaaaactgaatggtagcaggggcaggctaccacggagttttaaatcctgccttacattaacacaaaggaaatacaggaattacccagatgccaaaaggaccctgaagagtatcagataatgatgtacttccagctcctggtgaccaaacaaaacaatgtaacaaaacacaaccaactgtggcctcagaacgcctgaccagctacccggagagcttttatttcttgaagggaagccttctaccaaacaaacaaacaaacaaacaagaaaacaccactttggcggatggatcactaggtcaggagatcgagactatcctggctaacatggtgaaaccccatctctactaaaaatacaaaaaaaaaaaaattagctggacgtggtggcgggcgcctgtagtcccagccactcgggagactgaggcaggagaatggcgtgaacccgggaggtggagcttgcagtgagtggagatcgcaccactgcactccaccctgggtgacacagcaagactccgtcttaaaaaaaaaaaaaaaaaaaaaaaaaatatatatatatatatatatatatatatattttttttttttttttttttttttttcttggttcacagcagtcaaaagaaccacaaaggagcagtagtttctaagcttccatgtaggtgaagacaaaaatttttataaatttcatgaatacttatatcccaactgttcaaaatatcaagatatttaagaaaacttgtaggactacagttaactattctctcctccaaatttttctttagaatcagagagaccaaaaataaaaaaattaaaaaattaccattgctcctatataaatcataagaataaaatagagccaagagaacttcttaggaacccctctcatcccaagccaagagattcttcccacattgggcattatcaataatgagaacattcctgagatcctatgagcttgtgtggccctgtctcataaagacagtaaagccacacaaataagggtttccactccctgggcctgagctctgaaacccagccaagacagaatcccaaacagccagagagcttcctttctgaaggcagtgaactgaacatacattatttaagatgaatatctagaactcttacaaatgaaaaagaaaaggacaatccattgaaaaataagcaaaagacttacacaggcccttcatgaaaaagaaacacaaacagccaataaactcattataggatgcccaatatgattagtaaccagggaaatacaaactcctcaaatgcccaaattctttgtgttggattttcaagtaaagtttacctcaaagagttaacacagaagacaaaggttttgaaatctactatatattctctcaggggaaaagctgcaactttgggtgcagaagtagtgtgaggaaaggaaagaggataaaaatatgacttgaaaggacttcacaaatagaaaaaagacggataaagggaacgtactcaaatggattcaacactatctcattcaaaatcccagctggttagtttgtggaacaagacaagctgattttaaaaattttaaagaagaataaagtgccactaatcaagacactcttgaaaaacaagaaaaaggtaggggacctgctaagtcaactatcaacaattatcctaaagctagacagtgaagcactggaatagacagagagaccaacagaacaaaacagcttagaaacagattcacactcttatggaaatttcactttgacatagctggcaacacaaatcagtggagaaaaggctggacttctccagagatgacactgggacacctggtgatgtattacagaaacaagtaaatctggtctctttctttatgctacacaatcaccaaacccacggactaagaacttaaatacgaaaagcaaaattataaaacttttagaaaacagtaagtataggagactgcctaaatgaccaagagagatttctaacaaataaaagctcaaagtataaaggctgatacatttaaggagagaggataaaatcgttaaaattaacaacatattaatctttaaccaatcataaaaagtgtgaaaagataagccacaagccagaaggtatttgcaacacacattatttaagatgagtatctagaactcttacaaatctagaaaaagacaatcaaattgaaaagtaagcaaaagatttatataggcccttcataaagaggaaacacaaatagccaataaactcattaaaggatgctcaatatgactggaaaccagggaaatacaaattaaaatcactcagacatttcaagtttataatgttggtaagcattttaaggtctgattctatcaagtgttggctaggatgtgaagttactggaattcttacatacagctggaaaaacaacaatctgcttttcttggtaaaatagcagatacgcatacctgtaactcaaaaattgtcttaactataccctaaagaattcgtgtgcatgtgtgccagttgatgtgtgcaagaaagtttacagcagaactgtatgcaacagcaaaacactggaaccaactgaaatgtccatcaacagcagaaaagagaaggaaaagacgctctattcatacaaggctgtgaagtaccacaggatgcagagctgcctctcgggataaaggggaatgaaaacagcaaggtgcaggacatttttcctccatgactccattcataggaagttcaaagacatgcaaaactaatatactgtgtagcaatacacatatatgaggcaagccataaggaaaaggaggggggttatagcagaatacccagtctagtggttatctttgcgtggaaaggacaggggattgcaccggagaggaaacagtctgtgcaatctttttttttttttgagacggagtctcactctgtcgcccaggctggactgcggactgcagtggcgcaatctcggctcactgcaagctccgcttcccgggttcacgccattctcctgcctcagcctcctgagtagctgggactacaggcgcccgccaccgcgcccggctaattttttgtatttttagtagagacggggtttcaccttgttagccaggatggtctcgatctcctgacctcatgatccgcccgccttggcctcccaaagtgctgggattacaggcgtgagccaccgcgcccggcccagtctgtgcaatcttaagctgcgtggtggcgacagttcaccgtgtggctgtttttataccatacacaaatgctatattcttttgtaactcttcaatatttaactaaaaaaaatttaaaccagaagattgtcaaatatattccaattctgcatttaaagaaaggtttctcttctctacagataatttggaaatgatatgcaagtgcttccttgctcattagacagctaggtaaggggtttaatgacttctcttccacctgacctcacttttcccactgccacctgcccgcccactctaaaggtgctgtccgagctccacagcacacccactgcagggatactcccacttgggagcacacttctgtgtccctgctcttcaaacccaaatgacctcccttctctttcttaggatcactgttttcctgagtattgtattatctttaggaaagtacagtgcttatgaaatgacacttcttagaaagacatgtgtcagctgggaagggtgacatgaaatcttcaaaattatcaaaatcagtctaaaataagcagagctgtgcttctagataaggccgaaaatgactactccataggtgtcaacagtctccaaatataatctacagcacaagtagcctcaggggtatgaagaatatgtctgtgaactcatgtcaacccactctcatgtctgtgtaaaacctgaaaaactaaatacatacacgggaggtactaaaaccttcatccccagcatccactggcgtgtgacgtcaacgccttgttctttattcacggccatttcagaaacctctgtgccaccccgtccatttacttctagatttctgctgctgtgcggctcagtggatgcccctactttagggaatcccagcaggcgcaccctagcacgaaaagccaaggtcactgtgcctcttgtttacaacaacacaaaaaaggtcttaggcaagacccccctaccgccacacatgctaacaaaaaaccatgaggaaggggtggaattctctttggtaacccatgctttgcagtcaatttgaggttcatgttgggaggagaagtcggggagccaccacggaaggtcgcatggagggaacctcaccacttccctctataaatgaagccccaactgtagtatgcgaataaaacaatccgtcagctaagtgcacgttgttttgtatacattaatagttttccatttgtgaggagaaatcagggcagcaatgacgaccctgtctcttaaacgcatccacttctgcaaacagttcatcacctccaaccaccaatggccaaagagtatctcccctaggatcctgttcaatctctctgtggacctgtcaagacacaaagccaaactagactgaatttctctggcaggagtgaaaatacatcacgggttaagaacaagagtagttagacagtgaggatgttaacataaggaggtgggcatgtaccagaaaaaggaaaaccaataccagacacctaaaatccaagacctagaaacagtcatcctgtgacctgaagcagagccatgtgccacaaccaaccacgccacatctgaacccagaggcatcctgtgacacatctgacaagaacgacggcatacagaagagcagagaccccactccagacagctacactcatgtacagagaggcctttggcacatcttctggccagtcgtcaccccaccccaggtagggaagctgcttatttggagagtggaaaaaacaaacctggcatgcatggttcagcgccctggtagttttgggagctagctgctctttttgatcctcttctccagggtaggctcttcccctgcccactaatctatgtcccatagtccgaactgtatcaataactataggtaatattttgaacccatctctctttcttcagaacttggggaaggaagaaggggcactaatttatcagcctcattcagagacccaaacaaatagtgaagacagagccccagaaacctaagtccaaaattctcccaactaattcctttctatctagtaaatattttaaaactatttttaaaaaatcatatttatccagttaaaaactatgtacattttgaatccattcttccataaaacaaacatacatctcaaaaccagctatacaagagggaactcctgatcttcacttctccctcctaaacttacctccccatcttaacaagcagcacttcccctacccagtggctctgtgccagcggggggtcctccctgacgctgtcctctctgatttgccacttctgattcaacaccaaatctcaccaatcctgccttccaaaatattatctcaaaaaaacaaaacaaaacaaaaaaaactttacttctctctgcctcaactgccaccaccctcatccaatctcggggtcaccttccatgatcacactgactcctacctggcgctcagtttccactccccttgacctactacaacccaaattccacactgtgtcttaaaaataacaaaataaacaggaaaactgatgttacttccctgtttgagattccttatcaacttgtcacattctcagcacaaaactctagcaaggtgttcaacagcatggactttaaagccagactgcctgagagtaaatcccagctatggtatttccaagttgtacatacttgggtaagttacacagcctcctatctatgtggtcaatgaaccgatgtatgtaaagcactgagaacagtgcctggcacctgagaggccctcaggacatcctattactgccatggagcacacaaggtccccatgacctgacctctccccatcactgttacttcacccctctccattctcctttttgctccacacactccagctacacttactttttcagcttcccctgagttccaagcctatccttctccagggcctctgtacaggctgatcccttggcctggggggctcttctgattctatccttccctcctcatctctggggtcataactgaaatatcttcagatattcctttcttaagttaggtccccctgttatgatttctcataatactcagcagatttccattattgcacttatgagaatttataattatatatctaattattcacctaatctgtcttcttcatagaattaaaattctagaggccgggcatggtggctcacgcctgtaattccagcactttggaaggccgagacaggtggatcgcctgaggtcaggagtcctacaccagcctggccaaccctgtctctactaaataatataaaaattggctgggcatggtagcaggtgcctgtgataccagctactcgggaggatgaggcatgagaatcgtttgaacttgggaggcagaggctgcagtgagccaagatcgcgctattgcactccagcctggacagcagagtgagactctgcctcagaaaaaataaataaataaaattctagaaaccagggaacatgtcttttgtttattgctgcatttctcacaactcacacaatgttcagcattctacagatcttcagtaaatatctgtaagatgaatgagtataaagaaatctaataacaacttgacttaccttgtaaagaaataacctaaaaagccatgtacatgctcaagaggtttcaggttaatgactcattcttgagaccaaaaaatgtcacagagggcatttgtaagaaatagaaataaacaaaatacacaattgaaaaaataaaaaaaggtgaatctaacaaaatccttttttaaaaaaatccttttatgcttatatttttacctaacctggaaaatgaatatctctatctatatatctctctgtctatccatctatctatctagataaaaacaaacttagccaaaactttttcctctcccctgggtctcattcttcattcctagctttctaaaaattcagcaaagacaaaacatttgccttttcctatcaaccataaacacccactttgaacacagccagtatctacccccacccctccatctaggagctttaattatggccctgaagtacgcataactcacactagcagtagagtccatctatgagggacgtggaggccctcaagagatatggtcagcatctgttacgccagcacaccagagcaaacatctgctgcaaggttgtgctgaaaacatttctatcaagtgggccatcctgtctggaagattaccagccctggagggatgtttgcgagcaaagtttcagctcttcgtgaagcagccctctgaccaaagcaagcgatacagagtgctgcagagaacacgatgtgcattctctgggggcattttcaagggtttccatttcatagaaaatgaaaggattctaaaccatgtagagacggtggaaaatatagttggatactacccaatgaagatgtgcaccaaaataccatgatgaagtttatcctgaaagtaggagaaggagaatgtggtgggcttactcatgagaaggaatagcaaggtgctcagattggacttctgcagggattcgtccccaagttcccaaagactcaacctaccaagaaggaggctactttgccagaaactgtcctacactttatagtacttgatcttacctttccagatgtttctgtgaattttttagtctagtgcaccatcagttcaccaactgctctaggaagatccaaatacaacagttcttatttccgcctccatcaagggtaataaatgccaagtaagatgcagtatcctatttagcgtggcctgtgtgactgggggcccaaagccaggaaccatagcatccacatcatctgggcctttctgattggaccgtagcatgacaaagagcagtggcttaggggaccctcctttctcttgctgactcaatctaaactgctctgggtgagcactccccctttccaagtcctgtttaattctactcataaaatggggttggttttctaacagctcaaggtgttttaagaataatacacagtgttcataaagcataatgggcatctcccaacaaatggacccaagcgcaggcaaggtccatttctggttatttctgttatcaatattatttgaaaagcataggtaagataaaatagcaaccctcaactctgatgcatccagaactgggcaactacataatacagagacaatttacatgaatgaaagtttaatggcatcaaatcaactatggattactagtatccaggtaaaagtaaaaactatatagagttgaaaatgttgctaagaaaatatattaacatataaaaataccttttaaaacttccttcattttttgtttataatttgaagggcaattagaagcttcagatgataggagctcaaggcccacgattttgccatgaaggctggccacctccaatctccacctggggacttaaaacactgcaaaatcctatacaccataacccaagaaaaatccctgatttctccactaagggctcctgagaccagaaagacaagatgaaggatggtgacctatactttgggaaaaccaaattagctgccatttcttgacattctataatcccaactttcaatttctaatgcaggtggctctaactgcacaggtaggacagagctgaaatccaatgtaaacagacacaattcatcttgcacacaacactatacagagctttccccattattaaaaagcttcaccaaaatcttgattggaagtatgctaaacatactgcccacaattccaaattaaacaattttgagaaatatttcttgcttttcagattctcaaaatatttgaagttcgacaactacatacaggcaagatcattctgaccatcaactactcaattaattctcactactgtcctgggaagcagataatattatcaccattttatagatgagaaaactaaagcacagagagatgaaataatttgtccaaggacagcgggagtggaaaaggaattcacacacatttccgttttccagtaatttaacttaagaaaggagctactgcagagaacaaacttatcagtcatggaatcccacatcactcagtgctggagagggggaatgagcaacaaaaaagtgacaaatcataaggtctgagtcccaactctcagccagagtcacccaattgcttcagaagactgttaccccaaggaaataagaaaaaaatacgttaacttgctctgtaaaccataaaatccactactagtatatatatatattatatctccatgaagcacttaccacagttacacttggtttttgtttgcatttcttagcaggtgattaatactttaaggggagagaaactgtattactcatttttatatcctcagcatctatctaaaatgtctttcccatagaaactcaaacgtctgttgagtggttgagtgagtaaataaatgtaaataaaataaaaaagaaaacatattttaagggccaaacagcccaaaggcattccatgagggaagtttgttactaaactttcagataaggtgtctagtatttcctgtaataagatattgtatattccccttctcctgcccacagaataaatcaagtacaaagaaactaaaaataataataccaaagaatgagcaatttccgggtcgggtgcagtggctcatgcttgtaatctgagcactttgggaagccgaggcgggtggatcacaaggtcaggagttcaagaccggcctcgccaatatggtgaaaccccatctctactaaaaatataaaaaattagccgggcgtggtggcacacgcctgtagtcccagctactcgggaggctgaggcaggagaatagcttgaacccgggaggcagaggttgcagtgagctgagatcacgccactacactccagcctgagcaacagagtgaggctctgtctcaaaaaaaaaaaaaaaagaatgaacaatttcctctttggtcttgtctgcataaaaaaggaacctctcctgctcagctatgcaggcacctggagacatttgaagctggaggtaggaaaaaaaaaaggtgaaggtgagcttgacctagaagggcaactgtgaacaaggtgctttgaggaagcaatgtcaaacctgtgtggacctttttgtaaacaggttaatttcctaaattcttttgtgggaatataagacatccgtgtttctaaaacgggagaggagaggaaacaaaaaccaaaaccaaaaccaccaccatgcactgaaggcctgcagtgggggcacaggaggaagtatgagaggttccatgcctgagttgtgatgtttgcagagaattagccagtgagagtgcccaaggaacacgggagcacaaatctgagaaggaacactcgaacgaggaccaattctattattattattctgctctgtaaggcataggtgacaccacccctctctctgtgcttaaaggacagccattccattaactacccaccttgaatggattccagagaaagactttgttccccaagaaatattagcaaaagccttcaagccagggctaagagccttagtgacaagtgagaaggcacagaacaactgagcagagatcatctcttgaaaacctatgctaattatcctgtttctaccatcaggaaagtgggaggggggaagggctgctgtgctatcacttggggtccattctggggtcaaatttgaatcccagcttctagagctgaattcaatgtggagtttgttgtccatgccaaaattcaaaggctgatcaagttgaagaacgtgacatggacataatgtgaagtacatgaaaactcacatacaaagtacctgccctcctggaaccagtccccagttatcacagagccgagaggaaaccagtcccctattatcaaatcctcttactcttgactagagtgatggaatttgggaagaatgcagcagacttctaaagactgctcagctacaagcaggatcttcatctccttttcagctgtggataacaacggaagcagtcagccgtctaataaatcaagtttaattttaacagcatgaagtattgcccgctttgtaattatacttccaaaggtaaaacccaactcgaattaacttaaaaaaattgttattgaggtaaaattcacataacataaaattaatcattttaaagtttacaattcagaggcagttaatacatctacaatgcgtgcagccctcagatctaattccaaaacgctttcatcatcccccaaaggagacccctccccctcattaagcagtcaaagtgaactttttccacaatggcattctttgtgatatatcatgctttctccacagtatcagtttattcactttcaacagcatctttgcattttaaaggtaagggaaaactcaaaggaccatgagaactaacactcacaaatgtgctttccagtctaccacgtgactgtatacacatctggtgagacagttatctcaggcaaaatgtactgtgtgtcttccctgggaggagaaacaggagctgattctaatggaatgtttactatgtgacagatactgagtcagaaacagcacagcagctaagactgggtgctctgcaaccacactgcccaagttccagttccaattcagtgtgaactctgtgttctttgggcaagtcatcataatctctctgcctcctttctcttcacacgtattgtgatggcaacaccaccacttgcctcatggagatgctatgaaggttaagtaagttcaagtgcttagaacagtgcctagtgcataataagagctcaatcactgctgccttattcgactttcactacgactctgagggaggttctatttgtgcccccatttcattactgaggaacttaaattttacagcatctaagagacttaccccaaacccccagagaataagtgggatagctgggatttgaactcaattctgagttctgttggcttagcaaccattctgtaaaatgtaccaaggaacaaaacctttctgatcccagttaccaaactcatgttgagcaaaatcacactcacacaggaaaaaaaaaaaaaaacacatgaaactgtcaccaaaatggcaataacccaactgtgctacagttttatttcctgctggcttctcagttctctaagccttgaggatccacgcgccttagaccattattacctcctcccccatatgcagtaagttcctgactcttctgatctttcctgttcttactgggcaccatcccccaagaccttctgctatttgtactttctgatttcaggctctttattctctgatacacactgttgccagaataatcttcaaaaagattgactgcaactttcaactttaattcaatcatacaaatatttcttgagcatctaggtgcaaggcaccatgatgaagataatgtgagtaagacagtccttgccttcaggagctcaatccaaaaagggaggtgtaagatagaatttcataagacaatgcagagccagagaaaggccctaagagaggcatgatgttctacaggggtattcaaaggacagagttatatcctcctcagattagagaaagattaatgaaggaaattaagtttaaaaatgtagagcatttccacatggagtaacagaagggcaggcattctgggcagaacactgcaggaagaaatggcagacaggaagcctgagtgtttggcaagggccagaggtgcagaaagaaaagcagtagggaaggggcttggagaagctgatttggaccacagtataaaaggtcttgactctcaggcaagggggttagtactgagtgtggctgatgaaatctccatagctttgctctcctgtgtgctttgctcagggttggttctcaccatctccccatcactcaaggcctagttcaagtctcagcttcttcctgacgtgtgtcttgaccgccccagtgtaaaataagatcctcttctattaacaacgaccatctctacaatttatttggcaattaatcacgtagtgcttctaacatctgttatcagtcttaaatgatttttcctttttcttattatttatcatgcgtatttatgttttgactccccagtgaagtattcactgaactctagtgtgggggaggagtcttccccaactctggaagatcaccagaaaatacgcagcctaaaaacagattttgtcaggtgactctgatgaccagttgggtatgcaatccactacacccatggaatctggcacagggccttgctatacatcgaaaaatttgctatttttacaggtatctgtgattttcacttcatatctcaacaacaaacaggtgcatcaatgtgcgcggccactaggagtacatgagagtacctgcttttcaacaacctcacttctacttagaactgataaacttttttgtaaatataacgggtgtgaagtaatatgtgtattttaatttgcatttccctgttagtgaggctgcaaaactttgcagacttttcagattttctcagctaaaactacctgttctcatctttcacccatttttctattgaactgcttgtgtctattatagatttctacaagttcttcatgcattctagatactaatccagttatgttataaatatcttctctcagtctgtcacttttttctcactttatggtttcctataaaacacagactttttaagtcttaatatagataaatatattatcatttactttttgagttgtactttttgtactatttcttataaacccttccctactcagggaacattaaaatgttctattttcttacagttttaaagtcttgtttttcctggctttaacttatctgaaagttacaatcttattttattttgttcccatatgccagctaagcccattggtcccaaaccatttactgaataattggttagttccccacggatatcacatagttctgcccccattacactgacgtctctattttgcatcaataccaccaggtcttaattactctaactttacaagtcttatctcatttgtataaagcctatcttccttgtttcttactcaattttcttgctattcttggacctttattctaccacacaaatcagtctgctggttccacaaaaaaatcctgttaaagttttgattgaaatgatatagcaatgagagagtaaggggatctttataatgcagagtactttttccattaacatcggcgcatcatctctccatttatctacgtcttttttttaggtcttttaatattttattatgtctttttttaaaaaaaaaaataaagaatttgcatatcatttgttgtacttactgctaggaatcttataaactataagtttctgtagccactgtgaacagcatttttttttttaagagacagagtctcactatgtcattcaggtgggactccaactcctgggcctaagtgatcttcctgcctcagtctcctgagtagctgcaactacaaggtcatcccactgcacccggctcagtatttttaatatattacattttctactttgttggtggtggtccataggaatactaccaattttttaaaaatctttaaactgtaaaatttttctatattttcatttgctccactaattaagtgtctacatttttaatataaatatatcacctacaaatcagttttgtctcttcctttccattcctgtgtcatatgtgtgtgtgtgtgtgtgtgtgtgtgtgtgtgtacatatatattatagtttgacaaagtcatgctctgttacccagactggagtgcagaggtatgatcatagctcactataacttgaacccctgggctcaagcaatcctcccacctcagcctcccaagtagtgggactacaggcgcatgccaccatggccggctaatatttttattttttgtagaaatgaggtctttctatgttacccaggttggtcttgaaattttggcctcaagtgatcctccctctttggcctcccaaagcactgagattataggagtgagtcacctcacctggccatatatttatatacttttctataaacacacatatatagggtctttgtccaattgtgtcatatagaaatctgagtgaagagtctaatattagtgatgacagtaggcaaccttattttgctctttattttcagtgaaggactgacagtttcaccattaaatatgatgcataggggctacatgagtagctcacgcctaaagtcccagaactttgggaggctgaggcaagaggatcacttgagtccaggagttaaagaccaccctgggtaacatggtgaaacaccatctcaaaaaaaaaaaaaaaaaaaaaaacccaaaaattatccaggcgtgatggcgtgcacctgtagtcccaactactcagaagactgaagcgggagcatcactggagcccaggaggttgaggctgcagtgagccatgactgcaccactgcactccagcctgggtgacacagtgagactctgtctcaaaaaaaaaaaaaaaaaaaccatatatatatatatatatatatatatatatatatgtcacttaatagtttttgggagttattcttttttgcattaagcacatgtcctgtcattcctagtcttctataagtcatcgttacaaagaacactgcatttcacccactgaattttatgcaactatgaaaacaaatgcacttgtttctcagtgagttatattacgtagcaaactgcattttcaaagacggccaagacagtatctcccacctcacataatctttaatgtgaccttgtaactccccatcaaaagatggggtcttccagagcccaaggtgggagaatcgcttgaacccgggaggtggagtttgcagtgagccgagatcctgccactgcacgccagcctgcgcaacagagtgagaacctgtcactaaataaataaataaacaaataaatatcgggtctataactgggtgcagtggctcatgcctataatcccagcactttgggaggttgagacaagaggatcacttgaacccagaaattcgaggccagcctgggcaacagagagagccctcatttctacaaaaaataaaaatattagccaggcatggcatcatgcacctgcagtcccagctactcgggaggctgaggtgggaggactgcttaagcctgggaggtcgaggctgcagtgagccgtgatgtaccactgcactccagcctaaacgacatctaaaccctatccaaaaagaaaaaaaaaaagcctactttcccttcccttgaatgtgaattggacttagtgactgctttgtaaacaatacaacacagtgtaagtgatgctgtgtaaatttattttattttattttatttttttgagacagagtcttgctctgtcgccaggctggagtgcagtggcatgatctcggctcactgcaacctccacctcaaccttcaggttcaagtgattcttctgcctcagcctcccgagtagctggggctacaggcgtgcgccaccacacagcaaatttttgtacttttagtagagacgaggtttcaccatgttggccaggatggtctcaatctcttgacctcgtgatccacctgcctcgacctcccaaagtgctgggattacaggagtgagccgctgcgcccggccaacgctgtgtaacttctaaggctaggtcagaaatggccacagaacgcagccaaccatcatgctgtgggaagcccaagccaaatgcagtggccaagtataggtacgccaggtttccatcccagtcgagctcagcctcagagtcaccatcacagccaggtggcagaaatgtgagtaaagaagatcacagctgtttatgtcacacacagccatttgtgtcttcccagctgaggccccagaaatcacggcacaaagataagacacccttactgccccattcaaaattcctgaaccatggaatccataaacagaacaaaaaggttggatgggttgatatggtatgtcatgcaacggtggacagctggaacacaagactagagtctctcatggtaactatctttgcattcccgggataactcctacttgctcaccatgtagtactttttatacattgctgggttcagttcggtaatattccacttaagacgtttatgttttgcttggtgaagggagagattggcctacaaaaaatgtttccttcttagatcgtatttatatggttttgagatcaaggttaaacttagccttttaaaaaaagttgtgaagcttgccttcttttcctagcctctgagaaatagcttaaagatttgttaattaaatatcaggtatattcacctgtaaaactgcctggggggcgctggtgctgggaaaggggtattcaaaccaatgatccagtttctttcgcttttttttgagatggagtctcgctctgtttcccaggctggagtgcagtggcgcgatctcagctcactgcaacctctgcctcccgggttcaagtgattcttctgcctcagcctccctggtagctgggactacaggcgcgcaccaccacacccagctaatttttgtatttttagtagagacggggtttcaccatgttggcctggctggttgcaaattcctgaccccgtgatctgcccatctcggcctcccaaagtgctgggattacaggcatgagccaccgcgcccggccaatgatccagtctctttaataattattagcatatttggaatctctattcttgagtcaattttaagaattttgttgtctcttttgaaatttcctatcataaaacttttcacagtagcccttacatgtgtgggtttgtgtatttaaaattctctcctgcactggctctttgtttctaatactgtttacttgtccttcttttttacaagatcagccttgctgtattatattcatattttctttttttttttttttcctgcttctcgggttcaagtgattctcctgtctcagcctcctgaatagctgggattataggcgcccaccaccacacccagctaatttttgtatttttagtagaggcagggtttcaccatgctggccaggctagtctcaaactcctgacctcaagtgatcctctggccttggcctcccaaagtgctgggattacgagcgtgagccacagcccccagcctatattgctattttcacataatcagcttttgatttaatgtggatcatctcattttttcctcccatttcattaatatctgctattacctttatgtttccttgttaaaaattgctttcttttgtggttattctttttctatttttcttaataaaatcttagctttttttttttttttttttttttgagatgggagtctcactctgtcaccaggctggagtgcagtggtgccatctcggctcactgcaacctccatctcgcgggtttaagtgattctcctgccttagccacctgagtagctgggattacaggcacgcgtcaccacgtccagctaattttcgtatttttagtagagacggggtttcaccatgttggccaggatggtctccatctcttgacttcgtgatccgcccgcctcggcctcccagtgtgctgggattataggcctgagccgctgcacccagcttttttttaaaaaaaatagaggccgggtgcggtggctcacgcttgtaatcccagcactttcagaggctgaggtgggtgaatcacaaggtcaggagattgagaccacggtgaaaccccgtctctattaaaaatataaaaaattagccaggcgtggtggcgggcgcctgtagtcccaggtactcggagaggctgaggcaggagaatggcatgaacccaggaggcggagcttgcagtgagccgagatcgcaccactacactcctgcctcggcgacatagtgagactctgtctcaaaaaaaaaacaaacaaacaaaaaaaagagatggagtctcactatgttcagactggtctcaaactcctggcctcaaatgatcctcttgcctcagcctcccaaagtgctgagactacaggttcgtgagcctggccaaaatcttagcttttaaatttcaaatcaccctacgtttttaaaagcagagtgtcccacagattctaatctgagattactctcccacagtaattgttgactaaactacttcctgattaacagtgagacagagaagaagagtccttgggcaatcaaaaaccatagtaaaatcacagcagggtcgacaacccatacagctccttacaagggtgggctaggtggcagcagactggtgccaaccgtgtcagggcgaggtggaaggctgctctgggtgaggtgatatggaggacccagagcacagtcctgaaagcttggctcctcaccccaccctccttgagaatgacaattagccctagacagtcaccaaaatattgccaaagctggagagatgaagcccctggtccctgtgccacttctctgactctggataaaccaactgactatatgtcggttttctgagtttgctttttggggcgtgggggagggtgagggagtggcagaggtgttgtttgaagtatcataaagttttcgaagaaaaaggagactgcaggctaagttaaaacactgaaagaatagtaagtgatggtcaagagtgagaagggagcatggctctgctggtagcggtatgccaatataatctctcaggaggatgcaaggcactggctaccaaaggccttaaaaatgcacacactacttgaaataaatatttctaggaatgaatcttaaggaaataactgcccccagataagacaaagtcactcattaagaaatttttttgcagcagtaaccacccccgaaaaataccccagaaactgaaaataaatgatcaaaactagaagttggttaataacatgatatcttttaaaaatgcaaccatcaaaaatgactccatagatacatgcgttaagcaaaagatcaatacagataagttttaaatagtcataaaataaaaataaaattaaaaattaggttatagaactgaatgaggccatttctgtttaaaatatttattgatatatgcctagaaacagtcggaagaatatgggccaaaacgttaattagtggccatctcttagtgatggaattactgatttttctttttattttcgagacggagtctcactctgttgccaggctggagtgcagtggtgcgatctcggctcactgcaacctccaacttcctggttcaagcgattctcctgcctcattttcctgagtagctgggactacatgcacacgccaccacgcccagctaatttttgtatttttagtagagagagtttcaccatgttggccaggatggtcttgatctcctgacctcatgatctacccgcctcagcctcccaaagtgctgggattacaggtgtgagccaccgcagccggcctgattttaattttctactgtaaatttttctgtgttttcaagggggaaaaaaattactaaaaacagaccccttccctttccccctaacaactacaaagccaaacttaaatgtactatgatttttaactgcagcagtaggattctgagtgagtcaatccaccagattaatatttttttaaatcgagacagggtctcactctgtttcccaggctggagcgcagtggtgtgatcccggatcactacggcctcaacctcctgggttcaaatgactacaggtgtgtggcactacacctggctaatttttttatttttatttttttgtagagacagggtctcacgatgttgcccagactggtctcgaactcctgggctcaaccgatcctccctccttggcctccagaagtgctaagattataggcatgatgctgtccccagtcagattaatattttcaagagaagaaagcagtaatgcaacttttttactttttaaggtgcatttttaggaataaaggggcaacaggtccgcaacttactctcaaatggttcatgtggggggaaaaccacacacgcacacacacaaaaggagggttaaataatgtgataagatgttaatatttggagaatctgggtaaagaatatatgggaatgctttatactcttcttgcaaattctttaagtttgaaattattttaaaccaaatggttttttaaaaaattatgcatagaataacccaaactttctgaaagtcaagggttacacacaaaataaatttgtgtgtatctgtatgtgtttttgggagagggagaatagttcagaataattagaacacgttgagaatttagaattctcttccatttagtccagtgaggatcttaaaaaacctaagaagtactacgtacatatataattttagaccgcattttcagcccaggcaagagtcagagctcatacaactttgtggagggtgaaaagaaccctgccacaaatgtgctacagagcccgcatcatctccacaacaaaacacccgacacccgaggttcaaaaatctacttcatcaaagatcaagaataactctggttagaactgttaaatcagtggaaagttaatgaacatggaggatgaagtccagaaagtgctgtctgcagtgtttggggcaggcattcgcattaggaaaccctctgtggtacaggctctctcagtggccaactatttggtgatctgcacatttttagcatagaaccttgaaatgatacagctgtgctggtcattacggaattctctttttgtgtgacagaattgtgacaggctcccaggacctaaacccagaaggaagcaggaccatattgctgcctagagaaggggatggagcagattccaggacaccgatgaaacagaagcttccatcacagtgctttctgctaccttatgagacagttcgcatctcaacagctctaggatacaaaggaagcacatacatttatactttataaggtggccaaggaatcctactgtgaacaaagaatgtctaagataataaaattccactttttttttctataaaaagcaaatcttgtcccagatgcaagcacttgcaacagaagctctgtgggggaagcctacctctcaaggccctagttcttggctcatccccaccccatgacctggacaagacctgtgagggtgccatttttagtatcaccgtgcctcagtttctccacctgtgcatgtggaatgatactggcagcccccgtagacttatggggatgactgctgagctgatgtctataaaatgttcttaatggcaagggcgaaagagctataaatacaaggtcaaagcagcatttaaaacctttttaaagctgcagccacttctttcttttgaaacagagaaccacagggaggatcaaaggcgtgctgctgttaactgcggctctcaaggccttgccctccacctggcagaaaccctagagaggtctaccatgatttttaccttgactaacaaaatctcaagacaagttgtacaatggtttcctggaacattctgagtaaagaaatgggaaaccaatacagcttacctagcttgttaccttctatgaacgctggcattaaaagtaaaaggcagccttgggaggaagaaatgcaaacacagagggagaacatagcttccccttgtctctctctgccacaaaagcctggccaaagtgactctactaggttgaagcagcctgcataataaaacgcttaaccttggctaagttaacctcctcagccattaaaaaaagggagggtgggggaagggctagcaaaatcaagcttacgggaaataaacctaatcaaagccgagtagtaacaaagggcaccagaaacatttctactgtatcacatcccacaggctggccaagagcccggaattttcattacaactttcaaagagagcaagaggaggagggaaaaagatttcacaaaagcattatcaaggccccaacccaggatgccctgctgtacaaccaaaatttgtaagaggtcagcctttcagggagtcaaaaacccagcatgtggaaactggcaggccttttatatagtgggaggggttcttaaaacgactactgtttcgcactgaagtctctgagcttcacagatcattaaaggtttctgaaccacagagaaaggagggcagagttaaggaaataaatcaaaagttcctctgggacgcacaaatgcctacttggaacaggctttcagcatgaatatcctccacattaaacaacagggaggacttttcaaaataaaagcagaaaagagattcattttgttacaagcaatgcactttttccttttggtgtaaaggttatgtgtgctataaaaaatgactcctgccgtgagtgctgcggggaggtggaggctgggcttggggcaggaggtggtggtggtcaaagaaaacaagtagaagtgaatacaacgcctgagaatgctgtgtttgggggtcccccaaacaagtctaaatgtcccgcaatgatttgggggtaggatgtgaggtaggagaatggtatcagaaaggaatttcttctacatttattccttgccatccttgcccaagaactgaaatcatttccccacagccagaaagaactgtcttctttgtgggtgtgcaacacacacagttgcagatctggggaaaagagactgtgccgttttgaaggcagagcctcacacttcttaaggaaatatcagttgtctcaaaaccagcagagggagtacaacgtttgagaagaggaatggccaacccgattgctgaggattcatgtttagccccgacaatggttgtaaagctgagctatctaccataacttctgcccttgctctcctgtcacccagcaatagtaaacagaaagaaaagctatactacctactcagatggaattagcttgttctaacaaccgcatgaggcagcagagagaaaaggagaactgtccacacttctgtcgggacacagttcctgtgagcagcactgttttggggagaggaatagaagcagggggaaggctcaatgaaaagcagaaagtccaatttggactgacagcaaatcccaaagcaatgattttaccttaaaatccagggctcctaggccagtctgtgaacagctcatttccagaatttttgtttatgagagggcaaaatggagaactctgtctttcaagcttttctttcaacagatgatttgaaacaaaagcagcacactcatgaaggcgtatgtctgctaaatggttgctatcttaatctttagccacagtttatcaaaacatgtaggaatgggttgagaaattaactggtgctaagattatcagcatggacaagttcctggggagggcctggcgacatgatcaaagctaatggtccctctcccaggagcaaagagcctactatttcatgcatgatgatgttgggctctggcactggaaatctttgctcaggtccattctaagtgtcgaaatggtgtaattaatggttagcctgggtatgcactattcaatcaggcaattttttttttttttttttttttttttttactaaatccgaacattaatgctttctcattgtgggaaatgagagctgggataaagacatgctcaactcaacagaacaaacacaacctatatgtgactttatgttagtctaggaactgtgcactgatgcacacccaggaggcactaagttaacacacatgcatgcatacctgcctgcctgctgggtaaggagggctgggcaggggaggggggccgccctggctgggggacacggctggggccattgttgccactttctcctctttgtagacatcaatttttacaaagggccgaatgataaaggtccacaagacctcacccagaacggctgttgcaggaagcagaggcctgagcagcctatagccagaagcccaggcagggggtgtgccaactacacaggcccacatgaagagcctccatgaggaagacgttatggcaagaatcctctaagtctccaagggacgagatcagaacaatgtatggaaggtgaagtgatacagatttcagcttaataaaaggaaggcggcccgaaaaatggaactgttcaaaaccacaatggcttcatttaatgggttcgatgtccccagtctgcaggaatgctgtagaagattcaggtagtgagaaatacctcaacagacaagaaagctacttcaaggacttccttcggcaaggcctttcaaacaagttttaacattgaaaacacccatccttcaaagagcttgaagccccaagtgtccatcttccaggatgcacaagactccccaagccttcatcctcccattactatttaatatccacactacattgttcggcacttggtttccctccagtatgcaccgtggcagccagtaagacacccccagggagcacaaccgcagctcactatttttctccccatgctcaataagttcagtaagtgcttgatgattgactagcatcaggaataaactaggagcattttacattcacactatctagttaaacattccaaatgacagatttccagaaaaatgttgcaacaaatgtaagtatttatagacatgcctggtaaggtatgtagcatttggagaaataataactagaacagagtactgtacaaaagaaaatggtacacttttgtatgagtctaagatatattggacaaatgggtattcctattggtaaacatggacatcttaataaaaatacaaaattactacataaagaagcattacatccttcaactcatctggtggccataaaatggagagaggcacatggacttttctcctgagtcacctgatagatttacaagatcaaaagaaataagggcttcaagtctttttttttttttttttaaagagatggggtcttgctagcttgctcgggctgaactaaagatatcctcctgcctcagcctcccaggtagttggaactatagtaggagtatctaccctgccctgctagaacttcaagttttgatgggcaaatccaccccagaggacaggacaaatgccagtattctggttaatagccccagatgagccagcttcccacccatctcccgtaaggtggcagacacataagggaagccaccttggacctttcaggtcaacccatctaccaggtgatactacagagtgagctttggatacatgacatggaaacaaatggccagctgagtcccacctaaattcctgatctacaaaattattaaaactataatatttatagttttaagccagtaaattacatatactaaaaggttttggtttttagaaatttatttaaaagttttagggtttttctttttaggctcacattatccaaaacgtgtagtttgcccccagttcactggctctgtgctttactttgcgaaactagccatctatacagattcatcgggcctatttcctttagaacttaatcctattgttccacaaattacagattctcgccaaatgaaaacacctccctcgacaacttaaggccacaaacctctgacataattcaatgtgtgtcattagcacatttccaaaacagagcacttgtgggaagaagaaccaagttctgatcttagaagccctgtgcctaagtcaataaccaccaaatcccaaaggtgctggacagatgctgctccggccccgaaaataatcaaacacacaaaagttactattaatatttcttgccaaacaacaatcaaaaaaatccaactcctgcacatgggaacaaagcgacaatggcagcagctgcaaatacataagcgaagcatcactgaagaaagtctccagcttaatattgctcccgacaccctctgtggtggttcactcatacagcaaagacacgggataaaaaattccacagactgttttcaagataataaaatggcatatgatgatgactcactaacagactaaaaggaaaaaatatccgtcaacagtcataggaagcttacaaagctgcagagatctggcaccactaaagctcctccacctcccctggctctcacctccagtacacacatgtatgtgggacatacaaagtgtgtgtgttcatgtgcacaccctttagggattaatttgaagccaagttgcaattggctaatggcttactctactgcttaagacagtattttattcttgactggctcaataaacctgctgagaaaaataaacaatggatttcaatcttataaataatctagaacacagaaccgctgcgcaaacaggagagttgatttactgcgcacaataaacagaacaggaaggaccagtgtggcagagtgaaccccaagtcctagacccattgtcctgggacagtagagttcacaggggttttctgtctattacacaaagtctaaggcctgggatatccaggtttcaaactggtcttaaaaagagcatttcaaagcagatcaggtggagaagctttggtggtgccagatctccgaagctttgtaagcttcctatgactgttgatggatttttttttcctttggtctgttagattttgctcacactgaagagcaaaagatgaggaaaatgttcgtttaaaaacaatgaagagttttcacgtcttaggaccattaattatctacccatgattacaatgtatttcgaacctattatttatacatgcgtgaacacacacacacatacttcattttaagcaaataaaaagtaagggctgttacaggactctaagggtgccataaagaggtattaaaatgaggtccctgcccagaaggctttatattctatataaatacatatatgcattcatgcacacatgtgtgcagagtaaaaatgcatggaaaagaggaatcagagtcaagtccaagaataaaataaaataaattttaattttgttttttgttgttgttgttgtttttgagactactctgttgcccaggctggagcatagcagcgtgatcttggctcactgcagcctcgacctcctgggctcaagtgatcctcccacctcagcctcccgagtagctgtaactacaggtgcgtgtcaccatacccagctaattttttgtattttttgtagagatggggtttcaccatgttgcctaggctagacttgaactcctgggctcaagtgatcctcccacctcaacctcccaaagtgctgggattacagacatgagccactgtacctgcccaatcttaatttgaagagggtggaacaaaacccaactctgctgagatgaaatgggccctttgtgtaacagcaaccagcctggggaggagcagaggcagccccagcaagaccgttagaaatgagggaactttagcagggcaccatggctcatgcctgtgatcccagcactttgggaggccaaggtgggtgtatcatctgaggtcgggagttcaagaccagcctggccaacacagtgaaacctcatctctactaaaaatacaaaattagccaggcatggtggcgcatgcctataatcccagccattcgggaggaagagggaggagaattgcttgaacccgggagacggaggctgtggtgagctgagattgtgccattgcactccagcctgggcaacaagagtgaaactccatctcaaaaaaaaaaaaaaaaaagaaatgaggggactcagatacctttcagagaagacccctggcccacctggccccttcactaggggccatgaaggtaagcacccttattcacctcagacatcccatcctagacagcacaggcctggggttaccaaaagctcccccaaaatcccaactttgtcaactgggatagtttagatatttcaatagtcggccgggcgtggtggctcacacctgtaatcccagcactttgggaggcagaggcgggcgaatcatgaggtcaagagatcaagagcatgctggccaacatggtgaaaccccatctctactaaaactctactaaaaatacaaaactcagctgggcatggtggcgcatgcctgtagtcctagctacttgggaggctgaggcaggagaatcacttgaacccgggaggtggaggttgcggtgagctgagatcgcgccactgcactccagcctgggcaacagagggagattccgtctctaaataaataaataacatttcaatagtcaaatcctggggattatgataccacaattgagaggattcagaagaaggatttaagacacttgagcagaacaaagaattatatttccaaagtgggggggtcggtggggggaagaaacatgggccattaatactgaaacttaattaaaaaattcaacatctcggaaaacttagcttaatggaattctggtatcccaaaggaaggttgctcctgtttgcttttcctatttacctaacacaattaatggttttcaaattatacatgacaggaaaaaaaaaatcttactgggagtagggggatgcctttcccatgctgagcagctgggactgagactgaggttaatgctttgctttacttttcaaaacaatactattaatttttactctattttcctaagtattactcaagggtatagtttcaaataagattaaaaatgaactagttattcaaggattataatttcagatacattttgaaacttagttttaatgtcggtttcctaacagactagatagatatatttttaaaatatcagcaaactagttttcaaagtcagaatagatcttacaaggctaaaaaagaatctatgatataaaatataagctccaagtggataaatccattgactgttaaccacagcaaccacaacttgtaagtctttctaaagaccaattcaaaccttccatttgttttactagctaataaaatggtgcagactatttaggcttcaaagtcataaatgtctccatctaaaagtcatccaggtaaccaagacacagccaaatcataagaaatataggttagcaaataccaacagcaaataaatccctgcaagcaacattttgttcaataacactttaaaagccccaagcatacttcatttgagtgcagtttctataagtaatacatttcaaataattaaagcattctcatgccatccccactagttttcatatgtaggataacgccaaggtcaggctgtttacactgagaacggcaactgtccaaggcccttggtttaaaaagtcacccaattttttaatacctccttttctttccaacaccagcaccaaaagtctcttacgtacttcacttacacaagggaatatcagccagtctctcatagattaccctcacgaaaactggaccactgcccaggcaaatatccctatagttcagactatcacaattaatagattcgagcctcggctccattttaatgggaacaaactctcagcacaggaatagctataggatcacagtacttactgccaaaatgcagtgcctgtttctactggcaatcactttggcctcaaatggaaaattccaactgtttatatctatgtgagcacaaattattaagaaaaacagtatggcacataaatgtctttcctcttacccatcttgccagcccctcaaataacttatatttctttttcatacataaggaatgccaataaaagaaagcaatgcccgaaaacactgtggtattaaacctttatgactatgtaaacttcagttaacaagagaaggccatccttccacataaaaaggcttattaaaaactgaaatagaatctggcaaggtctaactagactgcatgccacaaggtaaagagaacaagagcttttgtatcaagtaagacaggagttacaatcatgtttctagaaaaacatgggagtgggaattgagaagaaaactatattgagaagtcctggctcacggtcaggcgcggtggctcacacctgtaatcccagcactttgggaggccaaggcgggcggatcacaaggtcaggagatcgagaccatcctggttaacatggtgaaaaccccgtctctactaaaaacacaaaaaattagccaggcgtggtggcgggcgcctgtagtcccagctactcgggaggctgaggcaggagaatggcgtgaacctgggaggcggagcttgcagtgagccgagactgcataactgcactccagcctgggcgacagagcgagactccatctccaaaaaaaaaaaaaaaagaaaagaaaagaaaagaaaagaaatcctattattgacaatggaaataagccctgatacttttctgtttgaaatattttgcaataattagaaaaacaaaatcaagccctaatagtgaaactttacaattttaacagaataaagacagtatcattttaagaatgatatactatgcaggctcagaattctgcaagtctgcattactgtaaatagcggtgcttcctaaactttacagtactttggaatcctctggggggtccgttaaaatgcagattctggctcaagagacaaggacagggcctgagaatcttccattttaaccagtgatgagagtgctggcctgaggagcacactgtgagcagtgaggatagacaacgtttgtagaagagggacaaggtttaaaaacagagatcttctaatgtactggtatgtggccgtgacacatttgcacattctcagtagcatcaaccgactaaggaagtccatactttgttatgcaacattagattaagcattaatgaggctaggaaaattgtttatttaaggttataacctgaaattaaataaaacttcaggctggaagctcatattgaatactagaatcatttttaacctcttaatattaacagaaacctgattactcagtcttaaagccctttctcaatagcatttattctctgctgcaggaatatggtctatgcaaatgacattttgcctgaagaaaaaagtacagttaatggccagtagttacgtacgtatttaatagaattcattcccagaaatgtggctaagaaaggtggttgattttcatgttatttattaaattaaaaatttaaatctctaatacctttcatcccattacttaaagttaaaaacgtcaaaactggctgccctttcactgggcccttggtgccaaacagtgacacatttccaatagagaaaatgaagatagaaggcaggcttcccttcccattaactttgaactttcaagtccctatctgtcttcctacaagactaaattataagaagagcctcctctttggtcccatcctatacatacttcggtagcacagccctcacttctcttcttaaaagccttaaatgggtcccatccccacactcacccatacacattctttggagggaattcaaggtcccccaaaatctaccctgcagctataatttgggcccaagttctactgcatccgcttatgcaacctcctttccaaccatgctcatgtacttgctgggcacgttttacaatttcctgtctccgtgcctttgttcatagtatttcctatggctggaaagttgcttttcctctaccctcccaacctgggcctgtcaaaaatgaatccttccttcaaagcccagttcaaacaccgcccctccaattagctttccaggagcctctgtgctcactttgtggggcctgaacctccacccaccagggccctcagcacattctaccaagtatggcaggtatgtaaatgtcgtgctggctccctgcagggcagggatggcaccttgcttctctttatagataccctacccattgcagtgctcagtgggcacccagaactttaaaaaattgaactatacacaaaatttagttctgataatgggaagtgaatgaaaatgagtttccagtgtagtaagtgtcaatgcaccaccaactgggattacaaatgacacaagcttaatcttcactgggctaggtgctcaaaaataaaaagaaagagacgagaaagacagccaaagcatgtcccctttcaccttccatctccctccaggggctaacactttgggaacacctcttggctaccaagctggggtagatcacattgtcttctcaccaatcttagttgcaccagagacaagcaacggcaggtcactgaggaagcgctcctggactacgacccagtgccagctgaatttgtctaagtaataggagacacagctataaacaaaggccaggattcaagggacaatcatccaggtgccagacacaaaaagtctttggttcaaataactgatatgtcctcagagaagagatatgtcaccactgcttgaataattatctcatgattttgaagaaaactgcaatgtatagacaaatcaaacaaaaaattatttttggatcatccacgattttgtgttattcctaacatggattcacctttaggtaattaagattctctattaggcctcctactttttcaggcattaccttaacatcaaagctcatgtaccatccatctacccaacaataagtggcagggctcaaagcagaatcaagaggcctagttctccactgtcctcccaaaagttcagacaccgggcgctctgtgacttatacaaatatactaacacttaagactctgatgtggtttatgacaaacagtggcttgacagagaagaggtatacagccaaggtgaatctaaaatgctccacccgtattcctgactacatttcacctactaattatatactttataagcatattgaggggaggtaaatggttatagagaaacagagaatgggaaaaagtataataaactacaggatatttgcacaaccatgacactaaaagatttgacttgtagttattctcttgggtaccctgaggttaacacgtaatacccattcaactaagcctctataaacagttgggttttccgcaatcacagccactattcccacttcagtgggcagcagtgttcagagaaaagccagatttagctcttgtgcaataaacaccagaaaccaaaagagctaggaaagctgtttacgtctatgcccaccaggaacccttctctgctataaccgcatgaatgaactggtaagaatgaggtctcaacaaagcttcaagacggacgttgttaactagttgctgccctccaagtttttggcaagacagattaatgaaaaacaggtaacttatttttatacaggctcagtatatttacaagcagaaaggaattctgtacttttcaaagcatttagctaccaccttatgtagtatttaaggtagacaggaagaacaatcatttccaagtatttctatgcactctttacaaacattatctcatttaaattctcaaaataatcaaaagggtaggaattatcaccccattttacaaacgcagaaattaaaggacagaggggatgaataatctgcctaaggttccagagcaagtaagtagcagagaaggcaagaatcatcacttcgttctcaggcactgcagcaagtaacgacgtacaggcattttataacgaccacagcacctacacaattctcatgcagagaaacaccattttacagaaaataacttcccagtgttgtcaagatttgacctgagctttccaatgaacagctcaaggcagactgcacaattaaaaagagatcatcaagtactatagttaccagtaaggccaagaatagaacacaggtctgctgacccttgcaccaatgcccaatcaggcatgttcttttggatgctgacacccttctcaagttccaagtcacttgcgaataacaaagaaatgagttaataattctggtagacagaagaaaatgtaagccaggcatggtagcgtgcacctgtaatcccagctattcaggggaggatcacttgagcccaggagtttgagaccagccagggcaacagagttagatcttgtctcattaaaaaagagagagagagaaagagagagagaatgtgaaaagtatctatattagagggatttgctatcaaaaggggcatgactataagaattctacccagcaagttctgaatcaacaacactggtacatgcaaatctcatcttctgcagcaaaaagtaaaaaatgacctctgccctcccctccctgtgggctgtgaatgattagcttggctatgttgataactagagaaaataagaaaacacaagatgagtgcctctcccagctcattataatacttacagatttaccctactaccaaactcctccagtgcaatgcaaaagacagcaaggacactatgaatatttagcaaatgtcaggcataataaatcctccattgctgcaaacaactctctcattagttccaatgatggtgactgatgaagactttggaaataggaaaactgctgggtgctagagaagggagaagagctacagcgtgggaaactgtgaaggcggaggagtgatggggaaaggtctcagcaaagaggctagtggaaaagacaaccagagaactagctcaaaaggttggtgtactgagaatgcctctgaaggagaaaaaaggctatttatttacggagtcacacatcatcaataagaagggaaaatcaagagcaaaaagaaaaacatagtagaagaacttaactaggttaaaggttactcacatctgcttccactacggagataaaacactaagtaaaattaccgagcatttccaaatgccagatggtagaatttagatttaatgcttaatcttccaattatgaatttattttttaaaactgaaagataaaataattgtcaagatagttctgtatcaaattcttcatggtttgcaacttttagcagagcagagacagagaacttgagaggctacaatctgagcgatcaggagaaatctactcactgatctcttttttactcagccaaaccaaacttcctacactcgggcaaaggcattttaatttttaatcatatcaaacttcaagtcactgaaatccccagaaaacttaaaatatgtatctcaatattccatattaaataactctaccctgttctgggaagggtaagaaataagttgattatatagattggcatcataatacatcttagtttaatgttcataaacaggtttctctctctctgttttttaccattctcaatatgatccatcctagcatatgagatgcgtaatacttaaatttaattgtcattgactgatgcaaatcatccatttatatatacaagactatacttgaaatcacaaaacccttcttccccatgagttatcactgtccttgaggtactatacagtaagtgtccagaaaaacagctcatttttaaaaagacagaattaaacaagaggaaatcagtaaacaacatccaattaaaaaattaagccaaaaaacccaaattatccgcatacttttatagtagatattcttgcatccatctcccacctccactccctaaaaaagcagctcaatgtctaggcagattaaacatggatcactcctcccaaagtcctgaagagtgtttctggttaatgagtcctcccttcgccttcagacagtggagtggctgctccaactccatcccatctgccctatcccgtggcctagccagagggaagactctctccccatctgcctctacaccaccagggaaggagatgaggagggaggcaaccacagggaaatgagaatgaatcccttccccgcattctcttcatataatttcactctgtattttcctcagcaaatccttctacctcacgtttatcgggcacatttgtcagctctgacccccagctttgtgaaatactaagtagttttttgtaaagctccatttaagcaatttataagatccccttgtacatctgtccagtggaaagtgcaaactctcagggatagaatattaaagagttaaaactcctcttcaaaacagagcaacattgaaaaatggaaaaaatcccccagaactcaaagtataataagccacaaacctctggtttggttgatgatttctgccaattaccaaattcaaactagtgataaaatgctatttcctattccagccactatgtttaaaatttgatgttaactctccaacaatccttcccccacaactaaccctctgttcccaaagacctttctgttctcagagttacaacagaagtctatgttctccaggcggataagcataatctgtcactttactatctaaaaattatgaactcaaattaaaagtcaagggagtaaaacggagagaattctggaggccagcccgagtctgagcacagcgcagggttaaaggaaaccatttcataagatcaaatgtggagaggcagcaggagcaaagaggaaaaaatcaagttacataaagtccaattgtactcactgtttccttattgggaagcagctcctttctaattctgaagaagttcttcccgtactgcctgagtcccttaacgaagcgtttctgtgataaaaagaaacaaatgggatgtaaaaaccaaaaacaaaacaggatgtcagcaaagcaaagatatctacaatcagcagaataacaaccacaaaaaaagtctcggctagggaatactgccgaggctcggagagtatgtcagcagctcagctgggacccactggccagggcaggccccagctaccttcatcagaaccccaatcccacccaccacgcagggcagcgcgtttaagagaaggacgtcctgcgtctgaggctaagaagcaatctgtccccctcttccaccaggcacacattctggtgcacgaaggtataaatatgctccatgttttaataaaacacaactgctttcccacctgagaaccaagcttcccagaagtgtcgagcagaaaggggaaacagaaccaaacccggtgactcttctccagaagggaaccctagggggttaaaaggccgctttccttaatccaaagaatttgccaggaggcaccggaaggcaccagtatcacagaagcccaccgggaacacgaaagccagcgggcctgccccaccgtccgtcattaaaagccactccgagacaccagagaataaccagcaccccttccgccctcccgacgccactcgccgcccccatccattttcgcagcagactcgtccctaaccccagcccggagactttcactttgtcccatgcctcccgagcacccctccccgccccggtgggggcagctcctggctccgagcccccacctcggggctcccagcctggtcccgggcggccgaccccagcagccacaggtaagcgcccggggtccggggcggcaagaggccgtcgcctgtcactgggctccggctccacaaagcgcagggcggaggcggccgcgggtggctcggcgtgtgaccgcggcggggccgcgcggcgcggggcccggggggcgcggggctggggccgccgctgacgggggaggaggcaggagcgcggcgcgcagagcccggcgcggccgcgggcggctgcaaaaggcggcctggattgccgccgccctcctgtccgccagccggggccccgcgccccggccccggccccgcccccggcccgacccccaccccgaggccggagcctccagggcacccggcgctggaatctgtgtcctccttccggacaggagaacatcaaggcggtaaagcacagaaacttcctccctaccgcagcaagcgtggggagagggcgcccacagggctggggcccttcccaggctgctgggtctccagcccacgttccggatggacgaagtcggctgcgccccggccgcacgccctccgccccaaccccgcctcagctgcgaaacggggggctggccccgacgccccccgcggtcccttccggcccgcgattgtgggcggcctctccctggcggcccaggcattagcctgcacttccccggccgccgcttcacaactaaatcaccgcggaagcttcccagccaataaatcacctgcccaccgggcagagggtccctcccactccctgtgtttgagacccgccaggcggattcagtgaagggccagacttagccttttaagaccagtctgcaacctcctactccagtagtggaggctttgcgtttttgaatttcacccttgctgagatatgactcatcattgtcaattttcaatataattcatacagttcgaagggaaaatctctcaaggcacaagaaagcagcaagctctcctctagtgtgaggagtgacctttgttacttgacaaaagtatcgtttatatgatcaacaggcatcctacgctgtgtgcacacagcatatcaccgggagagacggcacggaaagatggccctgccctcaaggagctgcagtctgcccaggaaggcagacaggtaaacaaaccagtcctagggcctgcaagaaaagcagcagaggaacaaagggtggtgggtgaagctaggaagaggaagcaacttactctgcttgctgatgtcttagaggaagtgacaaggaagagtgtgagcctgccaggtgggctccagcagggcttccagcagaagtcagccaggaaaaggcacagggaacattctgggaactgcaaggaggacagggtgtgcagaatggagtgccagcagataagacgaaagaggcaggcaaggatccggttgcagagagcccttcaggccgcacggaagagttcctaattgtaggctggcagaaaggctgaagctggagctttccatgaaaagactggatgaggactgtgccagtggcagtgtggcctaagtgtagattagggacagaccagttaaagaggctgctgacacagttcaggtatgagatgaggacctcaactactggcacactccacctcagtaatcagaattcctgccgcttaatccattcttcaagtattcaggtatttactgagcacctagctgagaggggtctaggaagataataaaggttgccatggacctttactgaactgtgattcatttttgcacgtaagataagtatgtgtgaagtcattacagaacattctgagatgtcatctggccaagcataaagaagtgaggtgcagctcatcagtgcagcaagggacccaagaaggctagactgcagtggtctgtagtagttcagaatgccttcgccaaggcagtgacatcagcgagatcacaaggggtgggcaactattgcaggggtgggaggtggcttggtgaccgggccctccgtgaaggtcagaggtggagaatgggaggtgggttacaggggacagtctacacagacttggggcgggcaatctggagtgagccaggctgtggaacgccaggaccatgcaatcggaacgtgggcttgataccaagtgacatctaacaggtccagtaaaagaggcctacacaataaaggcagcatgtgagaaaggctgactctggaacatcagggtaaggtggcagagttggacaaacaaattcagatcctgtttcttccatttattgtgatgcaatcctttgaacatcatccattcaaccaatagttactaagtacctactatatgccaggagcctcatatatattaattcgaaatctttacaacctaagaagaagtacaattattatccccattttacagacaaggaagctgaggcacagataggtaactagatcaactcctcagagacaaagccagaattcaaacttaagccccctcaaatcctcagagccacactctgtaaaatgcaggcaggcgtctacagtggtaactattttctgttaccattttctatgagtctgtactttcctcttctcgggtccaatgtcaaatcataaagtcctcagtattcttcctaagaagtgtctttcagccgggcgcggtggctcatgcctgtaatcctagcactttgggaggctgaggcgggcagaccacaaggccaggagatcgagaccatcctggctaacacagtgaaaccccgtctctactaaaaatacaaaaaattagctgggcatggtggtgggcgcctgtagtcccagctactggggaggctgaggcaggagaatggcgtcaacccgggaggcgcagcttgcagtgagccgaaattgcgccactgcactccagcctgggcgacagagactctgtctcaaaaaaaaaaaaaaaaaaagtgtctttcaacgccctcctttcctgctcatgctagtggcagtcccaggccagacctttatctctctttcctaataactaggctattaaccatctcccccatccagccatttaaaagcctctgccaaggaatttttcccaactatagatttcatcctgagtcccactttatctggcccttagcccctacctaagaacagcatggtggtctctgcaggacagtgtttacactccttagccctgaattcaaggccctccaggatcctggccctgcccacctttccagccagatgtccagtaatgccaactggcccacactgggggacctctgtctcaactccagaatctgggtaaggcatctccacgttcacctcaaaatctctcctactcccaaatgaaaccagatgtccagttactctctcattagtttatttatttgtataaggcctgcttacccaaaaagtccataaactcttaaaataattacatcttacacctagtgcctccatataacactaggcagttgatgctcaccacattttttgtctcctttaaaaattatttatttattaacgatgaggtctcactatattgcccaggctggtctcaaactcctggcctcaagcaatcctcccgctttgacctcccaaagtgttgagattacaggtgtgagtcaccgcacccggacaagtgaaaccaaccatgagatgctgagggcctgggctagggtggtcacagtggaaatggactgttgaaagccagaaggtccattttgaactctcctaacagagctgacctcttgctccatgatgccaaactctcctagttttgctcataccacttggcctaattctctactcaacctctaaatgctggagtctccccaaagctttgtcctagggctttctgctatatatatcctctccccatatgatctccactgttcccttggctctaaatatctttcgagattgtcactggtatttctaagactaaatctatggtccaagtccactgggaacactcaacttgaacgtttcacaggtatctcaaactaattacttccagaaataggaatttgacatctggtggtgaacacagacctaccacagctgtcaatgtatgtcaatataatgctatcaagagcaaaagcacccttggccccactttaaaaaaaaaaaaaaaaaaaaaaggaagtaaaagcttcatgtggcctgtactgttacttctctatggaaagccacaaggcctcaaaaccagcaaaacatctgcttctcagagaccagcctttagcttgtggtttaccagaaatgtagagtagccctgaaaatcgaaacaaagacgaccactcacagtagtcaatgattggaaggggtcacacgtgaaagagacttctgttgcggctgtctcctttccctctataaattcatcgctcttcaaatgaagaccccgaagtttttaagactttaacaattaacactattgacttataaatcaacaggccctataagcctctaaatgcaagttcatggagacagtctgtttcttaagagtcttctagttgttgagctgaaattcggcatttccagtgctgaaattcaaggtctcatgaattatttctgtgtccattagtttttctatcactcccagtgtatagatattagaatagcaggatgccaagggtaaaggaggaaggaaatatagaaggcaagtcactgacttggccactgctgccagcgctgggcagctctgctgtttatgctccccagctcatagcctgcccactctcagacgcacgaactgagcgtcttgagatgttggcacttgtttctctggtgtgttcatgcccaaccaacccaactaggtgctgctccttggaaacataaaacaagtccttttctgtttgtgtacccccatagccaggtgagatccaaatataaataaatatttatggcaaggagattgttgctttgtgttacaacttacgtttatgattttgtgctctaatttttagataaactgctatagttttccactattgagctgaatttcgtatcaccatcaaaagttacctacctacaagtccctagtagagaaaatttaacttctggctttaaaaaagtaagttacctgaacccagcattactagccttgggttttaatagaacctggaaagctctgttttgcattttcgctacagtggaaagaacgcaaggttcagacttggaagccatgtgatctagtctgctcctatgttccaaaaaggaaattctgacatggctgtttagacctagccactttagaaacagctatattggaataaaaataacaataacataaaaataaaaataaccacgtcaaaatgcattaaattaatgtgttcaaaagttcctcatgctattgcttgagcccaccccctgtcatagtcccccaagccttgtgcctcagcctcactggtctgcctagatactggtcctcacctctccacctttgggatggcacgtggacctggtgcaagtagcatcaccattaacctactgatgagtacaaacggcattgatttttacatgcgtcatggtatgagaaaggcagggaaacaccaccctagaacaataaaaatggtgaacactgagcgctataacgtgccagccactgtcttaaaggctctaatgcactagctcatttaatcatcacaacaaccttatgaggcagaggctactgctattcccatcttttaggtgggaaaagtaaccatgtatcactaaatccttgaaccaggctgggagggtcaagggggaccagtgtaaaaaattgggaagcctcagagctgtggtgggcctaggaatggagccgagggtgcagacaagggatgtgatgatgtggctgctgcctgtgtttgcatcccaagatattgtttcccaaaaattctatgtgtggatagagaatactgggctgagagtaaaccctgaaagggtaaggtgtgcaaattcccctcatctacacatgaaactcccagcacatctcattctggcgtcatcccaggtgctggacctgacccctatctgcagtagcaagagagcagaagacaggggctaagctacaaaaatggctaaaagatacctctgcattaacccctggctgagagctttcaaaattaactccctctggtgaattttaactagtgtatcacagtcagaaactcaccatgacttctgaaaagggacatctactcagtcctcttacataactgtttggaaaacactgtaggtattaaaatgattcccactgtgaaaatggctccttctgttttaccctgatttctgcacaaaattttatgttaataatttattggttcacaggggacagaaaagcaggcagatctgctagtaagcaaactacagctcccccgaggagacacacaggcagtgggtaagaggaacagacccatggctccactgaagacacagagcagcagacgaaaaagacatgtcctaaatgttaaatggtaaggaggggtagggtgaaaaaagggaacatggatgccaggcagaagaaataaaagcctttccaaacatttgtattacatgatgctggctctcactgataaaccactggatgagaactgtacttcatccatatcatcctgttggttgcagatcccgtcaccccatatctaaaacatatttccttctggagctttactgttgatactgctttgagatgtatcatttggttttggttttacatatttaacattttaatgaaagggtgacttgagtaaggcactactttttcaataaatagcaacagaaccaatttgcctgggaggagacctgccagcaagccatgaggggcatttccaaaatttccagtataggctgctcccaatttctgcctccactttaaaaacactttgcacttactagtgttattccaggagagccagttaatagtttaatgaaactagttagagtttaaaggcagcaaatgggataatttaaaataatcatcccatttttattgatggttctcaaatctctctccagatctgacattttgccctagctcagacttgtacctacactttctattcagactaacgtcctccatagttttaggacatcaccatcccaacttgggcactgacagcccacaggccacatcctcctcaagtagcaactcatgaacccagagaactgactgaaatagttcagtgtttcttgagctccccaaggccttcaggcttctgtgcagagtggaagtggtagtggtagtggcacaagtatgctaattgccacagtacactctccaaggtaagtgtaaccgggcccattctacagataaactaaaggttaggtaaattaaatctcctggcccatccacatctaatcatcatcagggccaggattcaagtccagttctaacaacaaaagccatgccaatggtaacagagtgcgtgtgagctgctaagtacttctgtgtattaactcatgccattaaagtccgtagatgccatagggtgacccagagccacactgggtaggcccctccaggcattcctttgtcttccaaataccaactgaggtgcaggcttattacccttacgttactactggcacaagtaaaacttcttcctgcatataccttaagacgggggtctccagtccccagggtacaaaccactaccagcctgttaggaactgggccacaaagcaggaagtgagcggcaggcaagtgagcaaagcttcatctgtatttacagatgctccccctggcttgcattaccgcctgagctctacctcctgtcacatcagcagcggcattagattttcataggaccacgaatcctattgtgaactgcgcatgtgagggatctgggttgcgtgcttcttttgagaatctaatgtctgatgatctgtcactgttttccatcaccctcaggtgggactgtccagttgcaggaaaacaagctcagggctcctactgattctacattatagggagttgtataattaattcattacatattacaatgtaataataatagaaataaagtgcacaataaatgtaatgcgcttgaatcatcctgaaaccatccttcccctcagcccatggaaaagctgtcttccacaaagctggtccctggttccaaaaaggttggggacctctgctgtataccactgtagtcttataaacactgtttacttaattaacctaaacatttaaaatgtttcctttcttcaataataaattaaccttagcttactgtaacttttttcactttataaagtttaaaattaacctcatgggcctagcacctcaaatctcccccgcttctctctccccaagccagcttgccctctcttagctccctgtggccctatttctgtcagctgcagcagagttctagaagaagtgcctggcgtgctctctgtccattcccactccttccatcagtcaccatgccctctagattcattcttcacttcatggagtttcctgttcggcatgctcctcggtttttgcaagggctctgccaactacagggccacgtcatgccagtgactgcactggtctcctccctggcctcagtgtgtctccacacccctccccccaacattccagttctgggcattctgtatattaatgtgttctcttatttgaagacctgtgacaattcctagtacgtccaaactatcggtctgctagttagttaacagcctccacaattgggttcccaatcacctacaccaccatgtagtgaagttagttactgcagtaccccatcctgattcctttccctgggtttttaccaatgcctttctctcttacccaatctagaatgtcccctcttcacttctgcttattcaaacacatcaactcaactaacattcattgagccctcattctagtgaacacactgtgcaaagagcacagcacgaggcactgagtgaacaaggagcacagcacgaggcactgagtgaacaaggagcacagcacgaggcactgtgcgaagcatgttccagtttcaactctatccctacacagagtccgctctgctctctctcccttctctgaaaaacaacaattcctgtttatgactagaattaataagcacttctgccattaaaaggtctatagatcttccaccaaattgtggattcctttccagcaagaggtgagtatttcatgtcttgtgtaatcttcagagtgcctggcaaactgtaaccaagcaatatgataactgttgggtggctgcatgggtattgtttttggtcctagagttctccctgaaacataatacatgtttggtaggatggaaacaaaatttctaatcaatgttagatttgtttctttttttccaagaagaatggagaagtaaatcatattttaaaatgggattgattacttggactctcagtgcagaaaacactgttttatatctattcatctcagaggaataaagggtgtgatacttcttaaggtacttcttaagatactttaaaggaaagtttacatatatatacacatatacatatacatatacccaaacttaaactcttgaaataaaagcacatgtcggagattatatgctgtatgctggatatccatgaggaaaattttcccacaaacaacctggcatggttcagtaactaaataactacatcccccgtactggtaactagccctatctcaggactactgtgttcctgggtgcaagatgggtgtctaggcctccaccatcttcaaagcctcaatttctatgtccctggttctcttaacaatggaacagtcgtaaagcagggtagcctcttggtcctacaaagagacaagaggaggactcaactatttccaaaaagacatcttgtcttgcatgctatgttttgtcaactgtcttaaatacctttaatatctaataacaccacttccacttggttctccctctctggacatgtgtctttgaaataaatcctagtttcagcacacacaaaaaagacctgtttcccaggctagtcccagaagattctatggtaattacaacaggatcccaaatccaagccctctgagtaacagtccattcatttcttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccattcatttctaaaagaagtcctctctagggtcaaatatggcagctgtttagctgacacagaggagtaataccaaagagttctcttttctgtttcctttcttttcctctttttcctaatcttccaaaggccaaagagaatgagaaggagcacttgggaaggtagatctaatataatcctgcctggctgttctaccctcctcagttcatgagtatcatgataatggacagctcctggtttaaatcattgttttattccatcaccccaccactagcaacccccagttaagattagctatagaaacataacacaaagggtgactgaagcgccaggtctttcagtgtgtgaggccagcaagagtccaacagcccctcaatgtcccagctgactcttctgatgatatgctcagaaatgtctacagaagctgagcagctgccagctcaacacaccctgccacacctgcgctatcggtggaatcagagaatgagaaagctagaaagaagctttagagaactacgctggttgaaaccctcatattactgatgaggaccataaatcatttaactgaaattaaaccaacaaatcaaaccacacatacccacaaaatctttacatttgtgacaaactatattttctagaggtggccactccaatacagattccatcccacatgctctaacaatgtgataatgacactccttcattgacaggtgggtctctctgttctctcctcctgagcctgggtagacctttgtaactgtcttgaccaacagaatgtgacagaatgataccaggtgacttctaagactacatcatacaaagcaacacagcttctgctgggctctccctctctggacacgtgtctttgaagccctgagctgccagattaaacagtccggcttgcctaaagtcaccacgctggagagaccatcagggatggagaggtgctacagaaaccctagctattctagtccccagccatttgagtcttcctagcccagactcataagtgaagaaaccttcaagatgattccaatacctcctatcacttgactgcaacctcgtgaaagcctaagccagacctgcacggtggagccattcctaaattctggtcccacagaaactgtgaaagataataaatgatcatcattgctttacattgggctaatttttattatcaggggtaacgtgttacatagcgataggcaactaatacaagattcattactaaaaccactaaaaactttaacctgttagtcactattaatttaagcaaacaaataagcaatcttccaatgatgcttccccaatttgcatgcctctctataaccttactctgccttcattttaaggcctagctcttatcaccatatgtgatatgattagataacacgatataggctacgttactgaatatatgaggaaagggcctttgttttgttcactattatatccccagcacctagaacagcacttgacaacatatagcaggtgcttgacaaccactggttcagtacaagaatgtatctggagatgattgggcttagtgttcctccaaggctatttgacctctcatcacctgttctccagtttgactcaacgtctcttaatatatattcactgcactgttaagtttctaactctctaactactactgacaaaaccattagatgttcttcgttcaaacccactagaggaactacaccatcccctccgtgatgccagctcagcatccagagtagagccagtgatttcctttgtcaacacacctgcatgccaaaaacccttcccaggaggtctcaaatatcaaataaaagttactccatttttcattcaaagaccatgtgcccaatgggaaaatgacctcatgttgtggtttaaacagcaactgcacccactagcacagcccattgagctatcctatatatacatctctgtcagtgcccctctgggtctagataattacactgagtacactgaagtcctttcattattgcaggcccaacaaaaagtactgccactgggtgaatatcagaaagcatgcatcaatgcactttcaagtcaaatgagaactggctagttaagcagcagcattaacagatgtagagattgtgccagccaaatgcctcttgccaattatggccacacagctacgcccaaattaaaaataacccaacacggccaggtgcactggctcatgcctgtaatcccagcactttgggaggctgaggcaggcagatcacgaggtcaggagtttgagaccagcctggtcaacatggtgaaaccccaactctactaaaaatacaaaaattagccaggcgtggtggcgtgtgcctgtgatctcagctccttgggaggctgaggcaggagaattgcttgaacccgggagacagaggttgcaatgagctgagattgtgccactgcactccaacctgggcgacagagcgagactcaatctcaaataaataaataaaaaataaataaaataacccaacactcataacagaatccaaatgggcatgggaggctccttctctccctacaatatcaccctacagtcgctacataaatgcccctgtaaagtggctcctaagttatgtcattaaaatgttcacctttccttggcaaagtagatctcaacacaggaggaaagagaaataagctaaaaaaagaaatgtggattgtctagaagttacaagggaacaaaaaagtagaaatcctccgtgagaggattttgcaaaaactgtaattaaaggaatctagaccagtggttgcccgatagaaatataagccaaaaatgtaagttttactcttctagtaaccatactttaaaaagaaacaggtaaaattaatttaaatgttttatttaactaaaaagatcaaaaatattatcatttcaacatgtaatcaatataaaagttagtaatgaaatattttacattctttttcttcctgctcagtctttgaaatcagtgtgtattttacactgaccgtgcatctacacttgggccagcacattgcagatgctcaacagccacaagagaccagtggttaccacattggaaagcacaggtctagaataatcctaacttctttttttgtaaaatactgaaacatccaaagcactccaagttttctattagggaggcaaaataactatactgttagaatcatgggcaacgatatcataaattcctaaaataaaaccacatagggccgttatttcaaattacataaaacttgtcttctagaagaattcgaccaaatgccaaagttcttaagatctgccccacttcccaaacaagggaaactgaagacctcgaccagcaccagggccttccgtcagctcctgatacaggaggggctcctggattttgtttccccttcttgacaatacaacatgggactgggttcctcatttgactcggttcatttaaagaatgatctcaaagaagaaaggaaaatcaatgacccctttaggaaatgtagtccagggtgggggtggaggaagcatttcaatgacaaaagccaaacctcagtcataatgcagatccctgtctaacaggtgatcattgttttttttttctattacaggcactctggtctcccgcctaccccatgcaggatggctatccccatgcagaatggctgtgactttcaagagagtcccccaagggagggtcccaagatcaggggctggtaatgggccccaccacaaggctacgctgctggcttttgtttggaacaatagcgctcccatgatacctcactcttgctgacaatattggtaatacgggagcatgaacacagctgtgtgtaaattacacacacaaacagattagatctgtatatttataaggaatacaaacatactaatagctcatttacatacacagctggatacaatgggctgcatgcagaggggagtttgagttccaaagtatttctctaaaattttacaaaaagaaatgctcagattactgctaacccaggctgagacttctgctccccccacccccatgcagtatgtcccccgaaatagagtccttttcatcctcgtttgtgatatttgagatgctatgaaggagaaacctcaacaagtgctgttagatttcacttttattattatttattattatttttagagacagggtcttgctctgccacctaggctacagtggtatgatcacagttcactgtaacgtggagcttccgggctcaaatgatcctcctggctcggcctcccaagtaggtcagactacaggtatgtgtcagttaccatgcccagctaattttaaaaatatttttttgtagagacggggttctcactatgttgcccaggcttggtcttgaactcttgatttcaagcaatcctgctgcctcagcctcccaaagagttgggattatggcatgagccactgtgcccagccagatctcactcctgtaggaaaaaaatcaatataggataattttcagttaaaaagatgtatatacatacgaagagggagacctactaaaacatctgttacaacagcatatagtaaggcagaatctttgcattttcaaaatgttttcataaactttatttgttagagcaatttcaggttcacagcaaaacggaacagaaggtatagggatttcccatatagatgggtctctggatttttcagctaattttgaaaaatagggaaaagagcaatcagcattttgtgctcactacagtaaaccaggaacacaggcatcaggagagctgggctctgattcaaaggcctgattctagcaaggcctcacagtttacttccggctagccatgaacactctctgcgcctgaggttttcgtggaaagacagcatcacaagtactcaaatgtagcgtttaaaagtactaacttttaaaatgttgaatgttccagtaaaacagttaaagaaaaaaaaaggtaataatccaactaagtaaaaatattaacttatacatatctggatagatgataagctcattacaggccctaattttattatttaaaatgtttacaacaaaactctctaattgatattctccctctctctctctttttgccttgatatggtttctataaactcttggtttaaaaaagaaaaaaggtccatttctgaggcttgggtttactgtacttacagttccaccagtaaatcgtctcccagtctgggctggagaagcgctggccacggtttgattgctccagccccaggttgccaggcaacccacacaagggggaagtctgagaaccgctgacagatagccaagtggctgaaacaacagacttctctctgtcaaaaatgtgtttgagagagccacttgcccacctctgctctctgctaaacactacatgattgtaaaatcaaaatcaaaaggccactgtaataaaaacacacttcctgctcaattactaattgttctaaagctgtggggaggcccagatcctacagtgtatggcaacagaaatgcgatactgtaaatgagataaagccagcagcatgcaagaaacctgatctaaatgcatctccgtagcttcaagtcaggagagctggtgtgtggaggaatcaactgcctaagaaaacaccaggaagaaaataatgaatgtcaagatgttaaagaaacaaaccaatcaataactacgaagctagaggtcaagactacttagtaataaaaccaagaacattctccattgttttgaaacacaatctggaggcaatgaaagttttctccctcagatggaaaggaggagcaagaaaggtcaatgacccttgggaaccacaccccctggcggttccaggtggattccctgatacttgactgtaaatgggattacaggaaatagtagcatccttaggataatgcaggacaataacaggtctgagagtctaatgcaacatttaaaatacctatggtgtgagctgggcacagtggctcacgcctgtaatcccagcactttgggaggccgaggtgggtggatcacctgaggtcaaaagtttgagaccagcctggccaacacagtgaaaccccgtctacactaaaaatacaaaaaattagctgggcatggtggcaaacgcctgtaatcccagctactggggaggctgaggcaggagaattgcttcaacccgggaggcagaggttgcagtgagctgagatcgcgccattacactccagcctgggcaacaagagtgaaactccctctcaaacaaacaaaaacaaaatatctatggtgcatgtaccaagccagtaacattgtgcccaacaccaactctatgcagcatccttccatgaaaccactgtattgaaactgtcatcttggactctggaaactatttgtagtatgtggaaggggccagcactgagtgcacagttctttatctcttctgtgccatggaccctttggcagtctggtaaagcctgactccttctaaaaatggtttatggccaggcacggctcatgcctgtaatcctagcactttgggaggccgaggcaggcggacatgaggttaggagatcgagaccatcctggccaatatggtgaaaccctgtctctactaaaaatacaaacaattagctgggcgtggtggcgcatgcctgtaatcccagctactcaggaggctgaggcaggagaatcacttgaaccagggagtcagaggtcgcagtaagccgagatcatgccactgaactccagcctggcgacagagcgagactccacctaaaaaaaaaaaaaaaaaggctgggcacggtggctcctgtctgtaatcccagcactttgggaggccgaggctggcggatcacctaacgtcgagtttgagactagcctggccaacatggtgaaacctcgtctctactaaaaatacaaaaaaaaaaaaaaattagctgggcatggtggtacatgcctgtagtcccacctacttggggaggctgaggcaggagaatcgcttgaacccaggaggcggaagttgcagtgaaccaagaccatgccactgcactccagcctcggtgacagagggagactccatctcaaaaaaaaaaaatagaaagtatgccagagtaatataactgctctatgaacacactaaataacaagagctagcagagggttttctttagctcatgcaggttttttgtttttcgggggggtgggggggctgttttgctttattatgtgacctcagatgataaacccttggagggcaaggacagcaagtttttcatcattcaatttccagtgcaatatgcagcccggtttcctgccccaagctcctaagctagccctcgtcacaccactagcccagctcctatgggggcgtgggtttccttgactctcccagtgcccagaagtgggcctggcatataagatgtgtaagaccatagtccgcaaaatgggatgtatggacacaaaagacatttttttcctatgttctctttccaacaatccatcagcctgagaaggcacacgctcctgtgaggggatgcagcctctcttcttctatccccaccactgcccccctctcacttcacaaaggcagcctcctctcccccgctcccatctggaaggctaccaggcagcactgccccaggggcactgaacaaggggacaatttaaaacattgacactggtgctgacacagtgcctagctctgaggtcaggatgagaaagactccacaagtcagacattttctgattctctgctttcaacaaaacacaaggaggtcctagtggaagtgtcatctgatagattgcggaaagtcatatctgacgacaaattatacttttggcattattatggaaagaattcaaataactgagtgacactgtaacaaaactatcattcccatctacttactcacataaacaaggtttctgggcacttacgtgtttaaaaaaaccatacaatttatttccaataaatgttaagcaaaaatgaaaattatatcaacatttacattatttcgttgttttcatcaactgtgctctaataattataatttgaaaaaacatttcttctatacttaagagctttattattaaaggaaataaccatatgcccgatttcaatacacacactttttgttgcagggaagtactaaaggtcaatcggacactggactttcaaacataaaatgtatcatcttagtataaagtccctggggaagtagaatggaaataaaaattaaagggggaaaaggataagatgcaacattggactgcttttaaaaaatgaacttgtcgggcatggtggctcacacctgtaatcccatcactttgggaggcttaggtgggcagattacctgaggtcaggagttcaagaccagcctggccaccatggcgaaatcctgtctctactaaacatacaaaaattagccaggcatagtggcgcacgcctgtaatcccagctactcaggaggctgaagcagaattgctggaacctgggaagcagacgttgcacagtggaccaagatggtgccgccactgcagtccagcccaagtgacagagcaagactccatcttaaaaaaaaaaaaaaaaaaagcttattttaaaaatagatgatagttcttgctcctcctttcatcatgtgatgtgcctgctcctacttcgttttctaccataagtaaaagctccctgaggcctccccagaagccacacagacgccagcaccgtgcttgtacagcctgcagaattgtgggccaattaaacctcttttctttataaatcacccaatctctggtgtttctttatagcaatgcaagaatggcctaattcggaaaattggtgccaggagtagggtactgctataaagacacctgaaaatatggaagcagctttgcaacggggtaatggacagatgttagaagagtttgcagggctcagaagaagacaggaagatgagggaaagtttggaacttcttaaaagactggttaaatggttgtgaccaaaatactgacagtgatacggacagtgaagaccaggctgagaaggtctcagatggaaatgaggacattattgggcactggagcaaaagtcacccttgtgatgtcctagcaaaaaagatggctgtgttgtgtttctgccctaggtatctgttgaagtttgaatttgagagtgatgacctagggtatctggtggaagaaatctctaagcagcaaagtattcaagatgtgacctggctgcttctactagcttaactcaaatgtggggacaaagaaatgacttgaagttggaatttatacttaaaagggaagcagagcaaagaagtttggaacatttgcaccctggcaatgtggcaaagaaagaaaagcttttggttgggcgtggtggctcacgcctgtaatcccagcactttgagaggccgcggcgggtggatcatgaggtcaggagttcaagaccagcctggccaacatggtgaaaccccatctctactaaagatacaaaaaattagcccggcatgatggcacacacctgtaatcccagctacctgggaggctgaggcaggaggatcacctgaacccaagaggcagaggttgcagtgagcacctctgcactctagcctgagtgacaggtgagactcagtctcaaaaaaagaaaaaaaaaaaaaaaaaaaagaaagaaaagctttctcaggagagaaattcaggcaggctgtaaagcaatcacttgctagagatatttgtgtaactaaaagggagccaagcgctgatatccaagacaatgagggaaaggccttaaaggaatttcaaagaccttcccagcagcccctcccatcataggatgagaaacctaagaggaaagaatagttttcagggccaggcatggggttttgctgccctctgcagctttgggacactgcttcccacatgcccctgtgactacatccttggctcaaagggcctctgatacagctcaggctgctgcttcagagggtacaagccataggctgtggcagcttccaggtggtgttaagtctgcaggtgtacagagtgcaagagtgatggaggcttggcagcctctgccaagatttcagaggatgtatcaggtgcccaggccagaagcctgctgcagagatggagccctcacacagatactctactagggcagtgtagaggggaaatgtggggttggagggcccacacagagtccccactggggcaccacctagtggagctgtgggaaggggccattgtcttccagacccaagaatggtagatccatcagcagcttgcactgtatgcctggaaaagctgcaggcattcaactccaatttgctgaaccctgcaaagccacagaagtggaagtgcccaagaccttgggagcctgcccctcatcagtttgcccaggctgtggcaaatggagtcaagggctattttggagctttaagatttaatgattgccctgctgggtttaggacttgcattgggctcaatgcctctttcttttgactgatttctaccttttggaatgggaatgtttatccaatgcctatacccgcattgtatcttggaagtaaataacttgtttttgattttacaggctcataggtggaagggacttgccttgtctcagataagacttaggacttttgagtttatactggaatgaggtaagactttgggggactatcgataacggataatttgtaatgtgagaaggacatgtggtttgcgggaagccaggaatggaattatataatttgaatatttgtctcctcccaaatttcatgttgaaatgtaatccccaatgtcggagatggggcctggtggaaggttactggatcacgtgggtggatttctcatgaatggtttaagcaccatcctctgggtgctgtgcttgcaatagtgagtgagttcttgcaagatctggttgtttaaaagtgtgtagcagccccacccccttgctccttcttccaccatgtgatgtggtgttcccgcttcagcttccgccataagtaaaagctccctgaggcctccccaggaagtgcgtagatgttggtgtcatgcttgtacagcctatagaactgtgcgccaattaaacctcttttctttatttaaaaaaaaaaaaaaagataatgggtataaatcactatggtatttaaaattcacttgtaatatttaaaagagtgaggggacaattttatttttaaatgtcaatgtttgtaattttggaagttacatccttatcataaaaaaagtcaatttaaatttgggagtgggtatgcgctttcaggcaaaattcttttaggggcttcatagggataaaatatttttcttagctttgtatctacctaaaggaagacccagaaattctttggggtaccaagcatgcttccacatctcagctatatttagtctggttttacctaacagaaacaaactagggtcactgaaaacactttcttgaaccaagacaggttgcaccatggaagatcttgccgtatgtaactgctgttccaccaaggtacagacttttcttcactggaattccaaagctgactatagctctgttcaaggacagtaaaaagcacaaattcttcagtgtgccaattaaagtgcttggcaccttccattctgtcacttcagcctggactctcacatacccacaccacacccaagcatctggactcttttttacttattttatttttcagccatcatctacacatgtagatgggccagccccaacacccagtggttgaagacaataatcttcataagcaggaaattacagaggtgatcttggttctgaaccaactgcagaagaagacagatagacaatcgtctccatcagcaaccacctgcggcaggaaccccacctttttttttttatgttcggggatacatgggcagaacgtgcaggtttgttacatagtttacacgtaccatggtggtttgctgcacccatcaacccatcatctacattaggtatttttcctaatgctatccctcccctacccgcccccaccccccaacaggccctggtgtgtgatgttcccctccctgtgtccatgtgttctcactgttcaactcccacttacgagtgagaacatgtggtgtttggttttctgtccttgtgttagttttcacagtgtcgacggtctttacaatttggcatgtttttgcagtggctggcgcctgttgttcctttccatgtttagtgcttccttcaggagctcttgtaaggcaggcctagtggtgacaaaatctctcagcatttgcttgtctgtaaaggattttatttctctttcgcttatgaagcttagtttggctggatatgaaattctgggttgaaaattcttttaagaatgttgaatattggcccccacggtcttctggcttgtagggtttctgcagagatccgctgatagtctgatatgggcttccctttgtgggtaacccgacctttctctctggctgccctaaacattttttctttcatttcaaccttggtgaatctgaagattacgtgtcttggggttactcttctcatctgatatgggcttccctttgtgggtaacctgacctttctctctggctgcccttaacattttttctttcatttcaaccttggtgaatctgaagattatgtgtcttggggttgctcttctcgaggagtatctttgtggtggtctctgtatttcctgaatttgaatgctggcctgtcttgctaagttggggaaattctcctggttaatatcccgaagagtgttttccaacttggttccattctctgtgtcactttcaggcacaccaatcaaacgtaggtttggtcttttcatagtcccatatttcttggaggctttgttcatttcttttcttttcttttttttagagtctcgctctgtcacccaggctggagtgctgtggcgccatctcggctcactgcaagctccgcctccgggttcacgccattctcctgcctcagcctcccgagtagctgggactacaggcgcccactgccacaccgggctaattttttttttttgtatttttagtagagacggggtttcaccatgttaggcaggatggtctcaatctcctgacctcgtgatccgcccgcctcggcctcccaaagtgctgggattataggcgtgagccactgtgccgggcctgttcatttcttttcgttcttttttctctaatcttgtcttcacgctttacttcattaagctgatcttcaatctctgataccctttcttctgcttgatcaattcggctattgatacttgtgtatgcttcacaaagttctcctgctgttttttttttcagctccatcagatcatttatgttcttctctaaactggttattctagttagcagttcctctaaccttttttcaaggttcttagcttcctcgcattgggttagaacatgctcctttagctcggaggagtttgttattacccactttctgaagcctacttctgtcaatttgtcaaactcattctccatccagttttgttcccttgctggcaaggagctgtactcctttgaaggagaagaggcgttctggtttttggaattttcagactttttgccttgttttttcctcatcttcgtggatgtgtctacctttggtctttgatgttggtgaccttcagatggggtttctgtgtggacatcctttgtgttgatgttgatggtattcctttctgtttattagttttccttctaacagtcaggcccctctgctgcaggtctgctggagttttctggaggtccacttcagaacctgtttgcctgggtatcaccagcagaggctgcagaacagcaaaggttgctgcctgaggaaccccacttttatgcagaggtaaaatctaccaagcatgtggattctgaggtttcgtttcagctccagtggaggctgtgctgtgttgaccgtgtatgcaatggacacagaagaatgagtgtgcggcacttgcctgcgtctgccaccccacctccagatccaactcgagccaggctctgcctgcttctccgaatacatcctgcactctctgtgtctcctcacagggtagttctgctgtctggggagccgatattgggtgtgatgatctgacttggattcctgagtactccactcaccactgctgcggctctgaacaaattcccttactatctcatgcctatgtcatgtcgtgctcctctgtgtttccatctttctgtgtgccccatggaacttccccattctgcccagcactatgttctgggcatccaagtccaccactgccattagaacatcatcttcttgaggtggggagttcctgtccagggccacctggaggcctctgcacacgacaggcatttaataaatgtttcttcgatgacgtttcctattatcagtatctgggcctttcagagccagaaggggactatttaattattattactctcatttcttagtgagaggaccaatgactctcccaaggtacagcaactggtccaaggcacagactcaaccagaaagcaggtttaccaacacttttgtcttctcagcataaatattctaaagaaaataattactattgggtgcattttccacagatagatgaagagttatctgaaaaaagtagaagtgagggaagggaataaaaagggggaaaaaaaaaggccaggcgcagtggctcacgcctgtaatcccagtactttgggaggccgaggcgggtggatcacgaagtcaggagttggagaccagcctggccaacatggtgaaactccatctctactaaaaacataaaaattagctgggcatggtggctaataggaaacgtcattgaagaaacatttattaaatgcctgccgtgtgcagaggcctccagatggccctggcgcacatctgtaatcccagctacttgggaggctgaggcagtagaatctcttgaacccgggaggcgcaggttgcactgagccgagatcacgccactgcactccagcctcggtgacagagcaagactccatctcaaacaatcaatcaaacaaacaaacaaataaacaaacaaaaaaaaaaaaggaagaagaaccagaatttcttgtttttgaaaaatcaaactgaagaatgactggacacgatgtcagcaccactcacacaggaaacctcacgcatgaaacctcacacaacagcactgcagctctttcgcttggttaacttggggacagccctgagacatgagatcggcctttacagccttcttcccaggctggtggaagatcaggctgctctgaatccaggccggctggaattggcggggcctctcaacacagtcaagaatggctaacggcaggcagaaacattttgtggcctaataaaggatcaaagaaatgttccttacaaagaggaaatgaattatccacacatcaagctccttcatgtcttctgtttgtttgttttaggccctccagcctgtttggataaaacatgttacactgagaaagcatcaaagaaaacgaaacaacagtgacatttaaagggaactccgccggctagacagagccccattttgggttcagctccaacttctccctgttctgtctctcctggccatggggagtattcacccacagctgacataagattatcagcaaaggttttaacaagaaccagacctttctcttctaatctttcccccaatccaaaatgtcatgaaaaaacttcaaagaatcttgttagaatttaaaaatattctactattgtgtaactcatgctgaaaaatgcacatctaggtatgaaaaacgcacagattgctctgtcaaagaccactacgtgactgcacttccatagcagagatcccatctttcctttcagctaaatttaatctgttctaaactctgaaagttattgagtcctaaagacatttatttagcaggtcctaacaatgagcagtttataggcaattgtgaaacatgaccacaaagattattggatgggggtcagtaatttgaattgctagaaaaatatagatcactcttgactgacatgaatgatcagtggtatcatttacccagaattactcaagagagaatagtaacatggaatgagaagctgcttctaccctgaaggagtcacttttatagctatacaacttctaccctactcagtctgtgtgtggcaaaactagtttatcctcctcatggcatctacctgaattcatcttatttaagttaatttgcttatttgtctgtggtccctattagaatgcaaatcccatgagaacagtacctccacggttatttctattcccagagttgagaaggtgcctcgtacacagtcagtactcattgttgagtgactgaggagacaaacagcaggaatatattctacagccaacacttgaatctgcgatcttagtctacatagtcttccattcacaaaactctatcttctcgtacctttcctccaccttcaacctctccatgttaatgcacttcggctccatttaccagttaacgatttagtgatcccactgagaagccaggagctccaacagccaccgagaagcacagcacccagcagagctgcgtgtggaggcaacgctcacctccctctccatgggacctaaatgaccagcatagcacacgcttccttccttcccagcccttcctgtattcccagcccagtccagactagacgtccttctgaccagaagctcaccttagcaaatcccaactgatgcctcgcacgacgtcccctagagacctactgtcctctcacacgcagttctccaaaaggcctcataccccaacccccgagccctgctgcagctttctcactttcagatccacacagaatcccttttaacccctccagttatagggccagaagttgttttgtcaacagtagcaatcctgtctcaccgtctcatcaaccatgcccatccgggttcccccatcacagtgtcaaccacttgccaaacccatctccttcttatcctgtgaccagcaccaaagtctcttcctagctagctaagtctcttcctccatcctacctttcgacagcactctcaggaacgtggaaaaggttgcccacggcccttctaatagtctgtgtctaccattcttggtgctctttattccagcctagccatctaccggtagccatacctaagatgtgaaactacagattttccctatttactgcacagctaccatgacccccacaacatccctcttcttgactgtgtccctcaactcctctaccacttctgtactggttccccatgttctctatgcagcctggggcttaactatccattatgtcaacaatgcagtcaatactcactacctcagctgggcgcggtggctcacacctgtaatcccagcactttgggaggctgaggcgggtggatcacttgaggtcaggagttggagactagcctggccaacatggcgaaaccccgtctctactaaaaatacaaaaattagctggggtgtggtggcacatgcctataatcccagctactcaggaagctgaggcaggagaacagcttgaacccggaaggcagaggttgcagtgagctgagattgtgccactgcactgcggcctgggtgacagagcaaaattccatctcaaaaaagaacaaaaaaaatactccttgcctcaacatcccgacctcccaccaattttctagcccaatcttccacccactttggctgcatattagtgtcctaacatcctgggacactggaaacttgtaccccagatgaattaaattggacccaagtttctgctctgtgtgtctgaagttcctcatgtgactccagcgtgctaatagtgtgaagtgctgctgtacaccgacagctctcaacgtctctcactaggggcatagtcctgatccagtccagtagttctcagggcctggatgcccatgtcccaccctagggattctgctctgacttgctggggtacaggccagcattggggcattttcaagttctcccgatgactctaacgcacagccaagtttacaagacgtcctcagcccacctccactcttccaatgctactgccagactggtcttcaagggcagctccagtcctatccttccccacacattcaaaaatatataatttttcctcgtttcctgttgaattaaacataaacttctcagtcaaaagtggaaggctctgaattagctacctcacatcctcccccacccataagcttcatccaaactgggcaacaacttgctactaaccaaccactcaaattcttttagcccttgttctccaattaactaacctctgtcaactctgcccggtgaaatcctatccatccttcaaggtcctctcaaataagcctcctctacagcacccttcctgatctccctgtccaagagcagggagcaagctgctcacctcagcaggccctgtgagccccagaacaccatctgaagcaaaagaggcactcaaaacaaattttcaattgtgtggctgctgtcccctctctagattctgtggtgataaatccaactcaagcactcatttacacccactacccaaatcagtcaaggataccacagtgggatggcatgtcacctgccatactgccaagcagttaccaaggttggtggtaactcctgcagagatcttagcagtgaaagaacaaatgctgtttgtttaaagtcactgatacgctcccttccttttgtacacagaaatcaataatgttttttctaagtcttgtttccaaaaaactaagccaaataaaaaaaaagtcacttgaataatagaagaacaaactaacaatgataggaacagaagattcaactagaggaagaattatgagagcaaacagtggatacaacggtctcaaacatccagcagagccctgcacacaagagtaggaatggaaacgcagtagaattaaattcagtataagatgaaaaataaagaccttcctttttccatgtatatttttaaggtaaatttaattatccagaaacagacaaaaatgtttgctcttcaccttcaagaatccaccaccccttttgtgaagatactcaggctcagtagagtgcacccgtacacatgcccatcttcgtaacggaatgcctgagtgcctaagatgttcaaaccagtggagagtagcatggcgtgatgctcatggactcctctaaatgtgtgagcaaccggattacacatctcagagtgtggcctaaaagcaagataaatctacgtggatcatttgaatgttttacagatatttaaaaagagagggagagagaggaagggaatgtgagctgattatgaagtcagagaatttaatgagggagacaagctaccaaggtcagattgctctggggtcataaacttggaaagtgactatgaagctgacaaagaagttgggttgtctcaaaggacgatctgaaaataattttctacttttgttattgctaaaggactggagaatttcatttccatggactgaactgagcagtaggatcccaaaaatccagagcccaccccactctttaagctgctctgagaattggaacagctctgcctgatgaaatcaagacttcaacgtgggagagatcaccacagatcaaagctccaggtcttctctaggcaaagctcctttatttcttagattaatgttaggtgggtttttggtcgaggtcaaccagtttcccaaacctttgcttatcaagatctccttaggccgggcatggcggctcacacctgtaatcccagcactctaggaggccaaggtgggcagatcatttgaggttaggagttcaagaccagcctggctaacatggtgaaaccctgtctctactaaaaatacaaaaattagccgggtgtggtgacacacacctgtagtcccagctactggggaggctgaagtgggaggatcacttgaacccgggaggcagaggttgcagtgagctgagatcacaccattgcactggtccagcctgggcaacagagcaagactctgtctcaaaaaaaaatttttttttaattcattttctaaaattctcttttaaaattggataaccaagcttacttagctctgtcaccctaattaattagaggccctatctgaaaaaagaaaatgagtaatatttaggatgaacatgtctgtttggaaaacagtttattagcaaatgtgtgacacctccacagattttaatattaaacagtggctcccagagaagactccaagctgctgttgaggggagcacaagggacagaagagcacagagcatggctgcagtgatgggccatccttcctcccactctggtggagtctatggtactcattagcctgcatctctgtagcctaggagatttggtttcattactgtcaatggcaaagcttagaaaaataaaagtatgatcaaaacttacaaatcagcttcaagggagatcccagaactttcagtaacaaaaggacactgtgtgtgtgtgtacgcacacatgcatgtgtacacgtgtgttttcaaatttcttaaacaggaatgactctgttagctttagataaatcatgtggccaatttttcacctgggaagtgaaaggatggggcaggcagcagaccaagatgggcttaatcctgacctcctgtcaaacacagctgccagcacctcagaattttccccttccctttccttctccttttcctataattttttagattaaaaaaaaaaacttaagacttgctgggtgtggtggctcacgcctgtaatgccagcactttgggaggccgaggcaggtggatcacaaggtcagaagttcgagaccagcctggccaacatggtgaaacctcatctctactaaaaatacaaaaattggctgggcgtggtggtgtgaggatgtaatcccagctacttggaaggctggggcgggaggatcgcttgaacctgggaggtggaggttgcagtgagccaagatcgcaccactgtactccagcctgggcgacagggtaagactctgtttcaaacaaacaaacaaacaaacaacaaaaaaaaacccccacaaaactgaagactcaagaaggggagtggggagatcatactttcttgaggccacacaggtggcagccaatctgagtactgatacccacacctctgactctcaggccagttttctctccacaaaccaccaggcctgtttttcctgcttctgcccaccaacccaccccaaaaatgagttttccatataggaaagagaagagcctggcttatcttcttcaggaggtaactgtgccttccccagagagctcaggtgccaggacgtcagcagccctcagacagcagagccaggagggacacggggcagtggtgacgaagctgttcagggcaactctgggcatcctcctattttcagaataacaatcttcctggtgttcttagcagcatgattcctttttttattattattttttattttttagagacagggtatcgctctgtcacccaggctggagtgcagtggcgagatcacaagggagcacgattcctgaactgggggaacagtgctgagttgtatgggaaggtgtgttagaacagccagattcacctgtgctgcccactgagctctttccttctccatcactcattctcccataatagaacatctcaaccacacgtatcatcagtacacatcaggtgatgttggcaatgaacgagtttttttaattggaatttagaaaataaaaccacaaactggaaggagttggttgctccttccaaagcaagctactgagaggaaaagaacagggacacatccagttaattaattctccctagacggtggcagctcaagagctcagccaaagaggtcactgcactgaagcaatgtgaggtttctcttctgttccacccactcaaatgatattttcttattatcaatcctgctccaggtgctgggccaggttctgtgaatacaaaaagaattaaactacaaccctgccctcaagacttcctagttttgtgtggaggcacctaaatgaacttgtcaaaccaacctggtgcagcagggcctgcaaaatgcagtgacgtcccggccttcatcagtcatgggccactcctcattctaaagtgcctcgtgagcaccctaacctctcagaagaacgagtgttggggaaagaagaatatcagaacactactagggaacattaagcttggcccagcattctagttagtcagtgcacgtagcatccatcctccagacattaagaataatcaccacaggcctagagcaagcaaatgccggccgacaagggaagctggcctcttctgtcaaacagcagtattagagggactctcccctgagctgagtctcaaagccagggtatttgactcaagaaaggaagatttttgagatgactcttttcattaggtgttataattcagagcatgacatctacagttttaagttttccacagtgttcacttcctgaattaaaatttgtcaggacaggctgataacaagagtaatgactgctccaagatagaggtagagcaggtacacttttctttccaggtattttcttgctcctactcaggaaaaacagctcctctcacaaatgctgaatttatagtaaacttatgtagtaaatattgtctaaaccagttacaaaacaaaaacgcttcaatcttgacacaatgagcagctgcagaagtcagaggaatgcatgactcagagtcctacataactgaagccgtaaaaacactgttatgagagatacaatgttaggagaaaacagaacagccctcaagaattcctcattaatttgataatgtaatttaactgtgaggtacaaaataggagtgaacatctctggtctaagatcctggtggccttccgacttcatcttctccatccactccggggcatctttgctcttcctggaacacactcaggcatgctcccacctcagggcctttgcactgtttccttggcccagaattctcttcccctatgtatctgcaaggctagcttcctcactttttaaggtctttactcaaaagtgaactctccatggctaccttaagaaaaagttcaacccctctacctggtatttcctatcactttcctgcttttaattttttcaggactaacacactatacatgtcacttagcaagactgttttaatctatcctccttccccactacaatctcaactccatgaaggcagagaattttgtctgttttgttcactgctgtatcacctggcagagtgtcaatgctctaccaatatttccagaatgaaagaatgaatgaatttcaactagtgagctaaaatcagaactgaatgagaaacttggtaagtaggaaggaatcattctatcttcatgttcacacagtcaacaatcacaggaagagccaaaccgacaccaaactcctctgcaaggaatgcagagccagacagacagatcctgaggccccatgctcaggtggtgaggccaatatcaggcactgtctttctccccttataaccaccaaacacatgctgcttcctgatagctcagtactttgcctcataaatgtggaaaacacactagaattcacctatataaaggtacttcggaaaaatgtcttaaggcaagtgcaaaaacaaaatcaaatctaagtgtcaattagttgcatgcagggtgttaggaaaagaataacaaaacactactagagaagatacaaaataggctggcactctagtgaagatggcaattagggggctaccaaggccatcactacttctacctaagggagacttacttacttactttatatatttatttatttatttttttgagacagagtcttgctctgtcacccagactggagtgcagtggcacaatcttggctcaatgcatcctctgcttcctggggaggtgattctcctgcctcagccttccatgtagctgagattacaagcacgcaccaccacgcccagctaatttttgtatttttagtagagacggtgtttcgctatgttggccaggctggtcctgaactcctgacctcacttgatctccctgcctccgcctcccaaagtgctgggattacaagcatgagcctctgcgcctagcctaagggagactttagatttaagacagaagtatgccaggagagaggaggtagctttaaatgaatgacttcctctcatggtagggttctcatttttcacttcctgtttccttctcccaacattcaattccagttaccaatgtaatatgtctcacctgtgaaaatgtaagactccaatgtcactatacgtagaatgttctaagcacacgcattaaaactgactccaattctgttgctaagaaactgcacaagaaaagggttttccatcctcttcgtttataaaataaccactgtctatgggagaacaaatgcaatctctcaagtccccttgtgccttgttctcattttttaaatgaacagagaaagatgatagagagtggctgaaagtgtatgctatctccatttttttacatgcccttgaaaatgagatggaaacatggcttcaataacccactgctctagtatttattaatctttcaagctgaagactccccccattactccccttactccccgctcaagcaaaaatgaaaaatataccgtcaaaagtactcttcgatttaaaaagattatcccaagcagccaggagtaatttaaggtgtgcttatattcaatgtggggttactttccaggtctctgtatagccctgatgtctaaacacagacgtgtgcgcatgcgcgcacacacacatatacatacacacacacggccctaaagaacagcacaaggtatgctggcttttatttttttaatctaaaagtagggctggggatgatggacttaaaaaaagtaccggttaaagacactaagaaaagaataatcttgttaaacacaaagagcaaaatgggcatactaacttctttgaccacagcataaagaggaagcctagaaagtagtgagccgtggatgtgaatggaaaggtcacagctgaatctgtacatttatcccagaggcgacttctactgacatgaactactgaaatacatttttgaaatatctcttcccttctaataaaatgcttgtcctatttcatttactaaagggttttaaaaatacatttctctttagagcttgttaaacagtagaatctttctgcaaactaattgacagaactgactgccttacaccaacttttctgtgcatataattgatttttaatttgctgtctcatttccgaaaggacttgacaataaactccattctatccatactattgacttctttaagcaagggtttggttcaaaggccgatgggaattaaccataggaaaaatagtccaattttattaatagttggaacttcaggcaaatctcacttgaatctacatttttcttttttaatattaagggctaattctcactataggtcacattaagaatacataatatggagtaatatgtacatacgtgtaatatatcaacatttctatttctcttatttttcctactctcatatatacaaatttagttcttcataagaaacagtaccactgtcatttaaaactggaggaagggtggttagtagagaggagaatctactgtgattcaatttaaaatgtactaagtacctactatgtgatgcagtagatacattgtatctatattttgggttaatggcaaaggttccaaatgaattgtaaaaattttcaagttataatttctttagaaagataatttcaatgttctgactcaactcacatgtatgcaaacctgtacacatacgtaagttgacaatgacataaaaccacgtacgtacataaacaaagaccagaagagagcaagaagccagcaaatgagacgatgaagccagacactgtgagacgacgtgttagtggtgaggttttaaattccctttaatgattttaggatgttgttctaacaataaaaaaaacaatctgcacaaaaccctaaaaagaataagaaagtgaaaaggttcgtactagatgacctacaagactctcctatcatcatttttgaatgactacataaaatggtcaacaactctggaaattttaccattcctaaaataaatataactaacccttcccctatattgtggatgtaaaattttaaaacaaaatcaccaagattattagtatctgaaatccacgtaaccataactacaagctctgagagcctctctccctctttgtcattgtcctccttgctgttttcacctccacaacctcctgctgctattggatcttaacggggattttgctgtgaattccattttcctcagctgccatgcaaacagtaaataaaattcattgtatttttgccccactaagcagccccgtcttctggcacattcagatgcctagcttgaaaagagtgaacaatgaaaacaatgttttctcaagcagacattccaaaaagggcataacaaaggcatctggagatgctgctggggaaagacaccctgcaaatagttgtgtgtattctgtgtaagtaattccttgaccggccgcacgggttcactggattacaaatatttagaaaattactttgccatctcatgtcaattttgaaagaaggattttcatttatatttatgatagactgagctttaaattgaaggaagatttagatgttttaaaatttatgagcttgtaaataaatccatgtacatggccaattaaggtttatcactaccacagattaactatttttggataaaaatttcagagcttatttgtatctagattgttcacctcaatgtattacatcaaaattgatataaaatatttaatgggtagtgtatttcaagataaaagctatagttacccaagatgaaataaaaacaccctgtagtaacatggtaagcaacagaaccttcactttgtgcaacacctggattgttgcggaaagcgaattcaacatgaaaataattttaaaaaccaaaacgcagctaagtggataggaagcaaagagtgagatgcacagctcactggagcacccaatcttacaatcttgcaagtcaaaccaaactccacaaggaaaatgcaggccctgaattttaaaaagaattcaattagcatccccagtatttccataatcaacagctgaatgctaattaagagcacagcatcaagcggcaacggaatcccagtgcaataagcaccaacacaacagcagcaaatgctaccttcagctcgcatgcataaataaacagaattaataaccacccaagcatggaagggtgacttaatctgtttcgattaggtgcagttcagcctggggcctttatgttatatttgaatgtgttcatcatgtttaattaaaaacctaataatctaagatttgttttgtttgggtttttttttttaatgttttaatctctatttcctcctctttatcttcctaagttctaccaatctggatgacttcctgaaaaggaacagtatttttagcataatatatgtgaaattgattaaccatcaatgtaactctcagaggcagaaggcagccatttactttggctccacccttacccataccttggtatttaaagcttcacaaactgacctagcatttcttccaaaatgcttctctgatcaaaccaagtttacttagcctgaaagacatgacccaggtgttgctcacagacactcggcaaaagcaaaattaatttgcagtatccggtacagaatttgacagaaactggcacattttggcttcagttcaagatttgaagtgtctcagccccaaagcaacttcaattaggaacatcatacacgcacactgtcagagaaataaactgagagtttgagatgaaaggcctcctattgtgtgattctgaggtctaagatctccagaattcatgattatctgaaagacctaggaaaaagaggtcaggtgataggaggaggaggaagaggagaaggaggagtaggaagaacaagaagaaagagtttaatgtgtgagctttttccaaaagtacttttattattattattttttttggagacagagtcttgctctgttgcccaggctggagtgcagtgccatgatcacggctcactgcagcctctaacccctggactcaagcgattctccaacctcagcctcccaagtaactgggactacaggcacatggcaccatgttcagctattttattatgtttttaatttttttgtggagacaaggtcttgctgtgttgaccaggctccaaaagtaaaatttttaaggttggtttctgaggcatgtaaaagtttttctctttaatgtgctgattcataactattaactattaaaagttttaaaatgctggattgaagacactcaattatagtgaagaactttttaaaaggattaccttgaacaaagagtcatcaatattcttcaagcctctcatatggagagaaactatcttcatcattaagtccttacccttaataagtttacaaactcggaggacaatcaactcagaaataagaccgcaaggaatgaagagctggggatcagaagtcagcacgaggaggcagaggatgaactgccaagcgagtgacgcgcagaggggagacagtgcgaagagggagcactggccgcgggatgggccaggaaccgagctgagactggagaacgagtagggtctgcactggcatgagaggttagtttcttcatagagcagcaggcctgccaggcccaggaggtgcagaggcccagcctgtccgctgcacagcagggaactcacaccttcaggtgcttatttcaccaaccctctcacagagcagctgcttcaaagtattcatgtaaaaatgccaagggaaacccgttcatcaagactgttgtagtcagatcagacactgggtagttagaacaaattaatatgccagcggcagcgaagtttagtaataagtagccaggcattgtggcttgcctgtagtcccagctgctcagaggctgatgtgggaggatcacttgagcccaacagtttgagtccagcctggacaacatagcaagacccccatctcttaaaaaatagtaatgataataataaaaataataattagaatgttccaagtatatagaaaactgggaggaaaaaagggggaggtaggcccatgtatttatgttagctggaacacatttgttttgcttattcctgtgattcctgaggtgagaaaatgtggtaaatttaacagaagggggccacatgaacacagcaggtgttttttcacagccaaagccaggcgagggtaaagaggggactgccttgttgccacataaatctcttcaaagatttgatttggatccattcaccagaagcttccttcaacctctcaattattcagtcagtctctcttcttcactgctgaggttttcaaagtgaagcttcacttcctacacataagggaaccatttgatcctgaggctctacaagggctggatggctgccaagacatttttcaaaccaagaagcaaacatgataaaaatgaccccaaacggatacggatgtatacagttaaggatcattattccatactcaaaatattcaccactttggagtcctgttttgtttttcaaaataaaccaggctctttctgatgtgcaaaacttccctctcagctcacagcgacaaatcctcaagcagcagcaatggggagacaatcaacagctgcctgatgttacaagcaggcgctgcaggaaaaggaaagcagctttctcttcagcaggaagagaggactttggctgtgtatttttaaaattccagagggaatgaaaggtcacaagagaaatgaaagaagggagagaggagagccatggctagcgaggggctgggaggcatgagtgaggagtggggagggtgggagacaccaagaagaggcagggaagtggggaaggagagaggacgccaaagggcatggagactgaagagagaggagatggccaggaactgagggaaatgcagaagcagaagcagccatggattgcaagctgacaaggccctgaggccgcctaggccaggctgagaggactgaagacaatctcacaaagggtggttaaacgaccacagtctatacacttgttccatccttttcatctccttatgtgtttcttccacacaggcttttcgcagaattttaaaaccttgtcaatcagatctcttatccactcctcacataaacaggcttacagtaaaaaaacagtatcactacgacttctcaaaactgaatttaacgttgtctaaacattttaaaatgtttaagatgtttctttctctttaataataacgttaagatttttatggttttgtttgttttaaaacagcttcatgaactctgtaagtctgataaagttaaagtcttaaggaactattcaacaagcactccattaccaaaccctagggccatttcagtgcatctcagctccgcctagcttttcccattcctcagcccttgcccaccctcacccacagccattctaggagcaaattctcttttctctaccttcaaggtgcagcctggatctcgctgcttcttatcacgaccactgctgccacaccacccagccaccagtcccagcctggtgtgcagcaacccccagagaccaccggactcagcggccagtgtgagccccactgtcggagcaagtcactcctctgttcagaagctgctcatgtggggcacatcaccatgccctgacagcaggccaacaggtcacacctgatctgctccctctagggcacccctcccaccactcccctccttgctgtgttgcagaaacattcctgcctacttcttgaacatgccaagcatgctttcaccttagggcccagaattctctaatatccaaaaggctgccttcctcaccttactaaggtctcatctaaatgttacttaccaggactttcctgatcctcccttagctaagacagtaccccacccagctgattctccctcattaccctattctgtatctgcttcaccacccccggcacatactcatttatgaaggtctcccctcttaaaacttaagactcccaaggagggacaacacctggcacgcaagcaggcactcagtaaatattgctgaatcaatgaaagagcgggatcaggaaagcacatacaatttctaaacattctttcttagcatattttaaaatacaggagaggaacttgcaatcaataggtgtattagtgccagccttcatttaaatttcattcgacctgaaaggcaaatgtcaagcggtaacattcatactgaagactgtatttgcaaaagcacaagaaatccgtaagtcgtttacagcaatgccttttacaagtcacaagatggagatgtagcttcattaaaactgtctgctggatgggaatccatgggtttgcaaggctgtatctgtgggcacatttctctccccccacttccttcaacaggccacagcaatacaatcagtatgtaaaatccagcatatttatttcatcaactctctgcttcccgcttgtaatcaatgtcctttaaggaggtcaggggtcttacaagccctataaaaacaagtcaccaagccaagcatggtagagcatgcctacagtcccagctacttaagaagctggggcaagaggactgatggagcccaggagttcaaaaccagcctgagcaacacggcaaaacccccttctctaaaataattatgattaaaaaaaagacaagtcaccaaccctactttaggttatatgtccacgggttttaacatgctgtctttaaatagggaggtatcacaagctagcttgcaccaaaaacaagttcaaattaactttttttaggagtaactatcaatttctcctttctttccatgaaagttggacaatctttcccgacatctatgaagcctaatcttaataaaatcaagtctttctgtacaattaaggggctgaagggccccatcctcctgcctggcgctgccacggacagccattctgcatgactgaagcttctgctttccctgagcagcagggaggtcacacactgagacgccggtggcccgatgccccagagcacaaggcaaatgctggttcctgctcaccacttcgtcctcggtccagcacttctcgatgagcttgggcacaggcttcttcaccaggcgctgcagggctttgccagcatcgtaaccgctttcatgcagctaaaacaacaacaattatagttagctaactgcaccaaataacagacaggacacaatcgatccaaggcaagctcctcattgactatctcccacagaagagtcaggaaaggggcactgagactccatcatttcagtaggcgcaggaatttgttctcatccaagaccaccctatcccaacccctattctactcactctgggagagggaggcaggcaaggcagaaaatattttggcaaagataggaataggattcccctatattcccataaagcaaacatttagggaatgtttggccccgcccagtgctcaggacattccatgcaatcattatcttacttaatcctatggggaaagtattctctcatttaatctacggtttaggagctatcatcgccctacttcacagatgaggaaactgaggcacagaaagatcaagtaaagatgttcaccacactgagccagcaggtggtgaagccaagactccaacccagccaggaggacccctactcttgcctcattctccgcaaagcagcgtaaagtcacactagattatgttctttctttttagcatttcttaagttttttgactgtgctaatttcacacaaaaacaaaatatttaaagtggctaaaatttaagagctttttaaagaaagtaagtctgtaatagtatgctagtttttcagtacatatgaataaagatgcaggtttatctacatattccctttaggaccagacttgtttcttgtcaaagctaatcaacttttctcaccctgcgtcttttcaaccctgtgtagtgtctggcaccatggacaccttcccacctcgcaaagatgctccagacactccaagtttctgagttccaacttgcagataatgtagagaaacagcaggtacaaagatcctcctgctctatctacctccccatactgtggctgtcactcagaattctcattggaaatccacctttcctgtacacatctagtcttcttacacaaagattggctttgtctaagacttgcatctccagtgctgaacacagtccatagtataaggtaatactccagaaaaacttgctaacttcctaaataaaatactaggttctgggacacagcagtaaacaacacagagatccccgttctcatggagtggacgttctgatcttttcactcgtgcttcaatctcttattttaacaatgagccagcatttgccgaacattcaggtcaagtaaagctgaacattcaagacatgtaaagaataaaccttaataagtcacagtccttatttccaggaaacttacaaattggtacagatacaaaacatacaaaatgacaagatcaagtaggttgtaataattactcttgcttaggtttaggcaaagacctatggaatcacaagaggagacagccatgtgtttcctctttctaacagaagactccggaggacatgcagatgccttcctggcaactgctggagcccctgggctgggcacacagtaagctggcagtggtaaatatttgttgaatgaaatcaataaataaatgctgagacacacactgcaagtctctcttccaaacatttaactgccaacaaaaggaatatcacaaacattcattttcttttatttttttctttttttttgagacggagtcttgctctgttgcccaggctggagtgcagtggcgcgatcacggctcactgcaaactctgcctcccgggttcacgccattctcctgcctcagcttcctgagtagctgggattacaggcgcctgccaccacgcccggcttattttttgtatttttaatagagatggggtttcatcgtgttaaccagaatggtctcgatctcttgacctcgtgatccacccgcctcggcctcccaaagtattgggataacaggcatgagccaccgcacccggcccaaacatccattttcaatgctcactcagcaaaacagaaagtattaaaaatttgaatttccagagcattctcacagtttagagggcactaatttattttaaatcaagactgggaagtccaggttgtacattagctataagaataaatcaactatcttaaaacaaaacaaaacacctacaacaatgatcaatactggatcccacttgggagtggtggtgcaatgaataaatattaacttatttatttttattattatttatcaataaattcgtatttattattaccattagactcttttaaaaataaaatactattatgatttgcaaatgtttgaaaactatccaacctaggcttctttcagacgtataaaaagatctgaaataaagtcagattctcatactttgcctaatatccagaacaagcagacatttgtcaagttctataacacaatgggggtttataatcacaggtcaacgtggattggaactgaataaaaggaagaattacatgcctatttaatgcaaaaagcacacattttagtgataatttgaaatcaaatgaagttgatcaaatcataaatttttaatgaaaagctcatggcaaaattaacaacttttataagaggtaattatactgtatggggtaattataagaaaagtatgaggctaggcacagtggctcacacctgtaagcccaacactttgggaggctgaggtaggaagattgagttcaggaattcaagactaacctgggcaacatagtgagacctcatctctactaaaaatttaagaaattagctgggcgtggtggcatgtgcctatagtcccagctgcagtcccagctactcaggaggctgaggtgaaaggacggcttgagcctgggaggttaaggctgcagtagtcttgatcacaccactgcactacaagtccgggtgacagagtgaaaccctgcctccaataaaaaaaaaaagaaagaaagaaaaaaagaaaaaagggtaagtaggaaaaactatggactttggagtcaaactgcctggattccaactctagctctactatttactaggtatgcgaccttgagagagttacttatcatttttgtgccttaattttgacatctttaaaaatggataaaataataacatcaacctcttagcgacatgtgaggataatattagaaaatatatgttagctacatcttttaaaaagaaaaaaaaaatcggcctcaagtgtgatcagctttccagattacagagtagtcttctcagaaacaaaaaattttgttaagctataaacaaaaaccacttatgtgtcatataaaattacccatgttaaatgagatttgattaaaactctggtctcacatacaggaaaaaatttgaatttcaaaatcttggctgggcgcggtggctcacgcctgtaatcccagcactctgggaggctgaggttggtggatcatgaagtcaggtgttcaagaccagcctggccaacagggtgaaaccgcatccctactaaaaaactataaaaattaggcaggcacagtggcaggggcctataatcccagctattcgggaggctgaggcaggcaggagaatcgcttgaacccaggcggcagaggttgcagtgagctgagatcgtgccactgcactccagcctgagagacagagtgagaccccgtctcaaaaaaataataatagtaataagaaaaataaaatcttatgtgcctgctaccaggaaattgctcgtgagaacataaagcccactccaaaagcaaactgctgagtggatgaagctcaatcaaatatcattaatccctgtggcattccggccttttggtgaaccaagaagagttttaaactatagctggaagagatgcttccactgaagtgttgaacatctcgttgtggttgttccgtttgttagagagcatggctgcagcctgcacaatgcccctcagctgaatttctagtgatgagcttaatggggaaagaggcactcctctgaacaagtcctggcattcctacttccttcacaaaactttatttcagatggcagtttctcctgaagaagctattccagtgacacggtaactcgagcttccttccctactctgttctctatataatggcggattctctccttttgtttgacctgttgtctggctggcctcttaaaatatccctattcctcaaaaaaatagtccctattcctgagtttcccatgttatcagtaagtattgagagtccctacccgtcctcacccctacacaaagacacatctgagaagtaaaaagtgtgggattatttacccaaagtgacaaatttttttctttctttttggagatggagtctcactctgttgcccaggctggagtgcagtggcgtgatctcgactcactgcaacctccgcctcccagttcaagcgattctcctgcctcaacctcctgagtagctgggactacaagcgcccaccaccacgcccggctaattttttgtatttttagtagagatggggtttcgccaagttggccaggctggtcttgaactgacctcaggtgatccacccacctccaaagtgctgggattacaggcatgagtcaccacgcccagccccaaagagatatttcttgaatggatgaaggaagaatattattgcgctatcatcagtgtttcacaggggcaagttcaaaacttggtcaactggctgttctggtgtgccctcctccttaggaaacctaagggactctttcctccttagggaaccaaggggactctttctaaaggggcactatcttcttaatgttatagacattgacttctaccttgtagaaatcttgtctgagaaaattctgagacatctttaaagaaataccttttttttttttttttttttttttgagacagagtctcgctctgtcaccaggctggagtgcagtggcacaatttcagctcactgaaacctccacctcccaggttcaagcgattctcctgcctcagcctcccgagtacctgggactacaggcgcgccaccacacccagctaatttttgtatttttagtagagatggggtttcaccatgctggccaggatggtctcaatctcttgacctcatgatccccccctgcctcagcctcccaaagtgttgggattacaggtgtcagccacagcgcccagcctttttattaaagatacacttttaacatactagaagttgttatggactacaacagcttcataatagggaaacttacctttacaacatttggggaaaattactggcgatcaggacatctttctttccttcgacacatttactgagtgctcaactatgccaggcactctattaggtgctgggatatatcaaatagcccttctttttttctctctttgagacagggtgttggctctgtctcccacactggagtgcagtggcacgatcatggctcactgcagcctcaatctcctgggctcaagcagtcctcccacttcagccgcccaagtactaggacagctgtgcaccatgcctaacttttgtattttggtagaaatagggttttgccatgctgcccggggttgcttttttttttttttttgagaaagagtttcactctgttgcctgagctagagtgcaatggcacaatcagcccacttccgcctgaattcctgggctcaagcaatcctcctgccgcagcctcccaagtagctcagcttacaggcatgcgccaccatgcctggctaattttttttattttttgtagagacaggaactcactatgctgcctagtgcggtctcagactcctgggttcaagtgctcttcctgtctagacctcctgaagtgctgggattataggcatgagccactgcacctgccccaaataacccttcttaagacagagtctcactcttgttgcccaggctggagtgcaatggcatgatctcggctcattacaacctctgcctcccggattcatgtgattcttctgcctcagcatccagagtagctgggactacaggcgcacgtcaccacgcccggctaatttttgtatttttagtagagatgaggttttgccatgttggccaggctggtcttgaactcctgacctcaggtgatctgcccacctcggcttcccaaagtgttgggattacaggcatgagtcactgcacccagccaaagtttttctttctttagatgaggataatgttcaataaagagctaaactggatatttcaactatattccttacataaagtagaattggtaaatttatcaaaacactggctatcttaaatctctaaaaattgccattagaaacattcccctctaatacaacatcaagttctgaaggattgccataatttcatactgtgaaaaacattacgtagatttcaaattctaaacacctgatcacgaccacacagctacgtctatagtcaggaaatttaacacaggcttccccatattgctaaggtaaaatgtcctttaatgtgaataagattttctaccgttttcctaagaaggctgtgcaaaatacattgcaatgaagatggggaaaaagaaacacctctcaaacatcttacagcttcactttgtagccacagaaaagcaattaaagcaaaataattaaacctttctgtccattttgcagccaagtcaggctggtaaaatctgggattaaatgcaattttaatgtagagtatagagaactgtacattttggagctactgtaaaaagatcagtacaaaaagcagggaccaagataaagcatcttgactcagtgagcttacaatctttgaaagctagggaggggagaagcacttagatcttatgctgcccccacgcaaccactatagcaggatgtcattcagcagaaagcactttcagattcatcaccacaggtgtgtggcagtggtgcttttttttttttttctaaatccaatgatcaaggaaacatttacttgtaaatctttccgcctcttttccacatcactaaactgcatgactgcacttctacccaaataaaacctgtcttccctaaaccacaggttaagacctaggatttatgattagggaatctgataacaaaacactgatttcttgaacaatccaccagcctttcaagtcattccatctcagaactatgcctgttttgctgttttctagcaatcggcctttggtctctgggtgtgctccatggaatcctctgagatgtgattttttccttcgtttttggttgttcattgtgaaagaacaaatgtgagtgaactctttccctatgtggtgtctagccctcttctgccacaccttctgcagcagaagtccttggtgtccttgaacccagtaggacattccagcctcagaggcaggctgctcacaccatactctctttgcttccattcattcaaccaagaggtaccaagcaactctgcctgctagcaatggggagggatacagtggtgtgcaaagacaggcatgcatgaactatgcaaagtggacctcatcgcggattttggtgctaaaaacaatagtaacttctgaataataaacacttaatttggctccactataacaaaagtaaccactgtactgattcattcagagccatactgtgccacaataactagacatatttagctagttgcctaaaaagctctcagtaactaactctgggtgctacaataaattaacaactagtcaataccttctgcagcctactgaaaatagtacaggatgtgaggcaagtgacagattcttgctaatagccctgtcccgaaccagttgagttgaggttttcatctgttaaatgggcctaacaccaccagccctcagctgggtcacagaaaaatggaaagtgctaaatgagacaaaatgtgtcaagacactctgaaatgtaaaatagctgtaagctgtacagtggtatcatcatggggagtaatattttagatacatggctcttacctaacactattcaaacaagaggttcaatagagccaacaatgccggtagtcactacacatctgcaattgtcttactacagcctctgacctcctcctgattagcagaaagaaaggatcatgctacaagaaaaacatttctgcataattgcccaagttaaatctgctactctcactctgcctgacaaatcattccatgcttactttctataatttaatatatataagtgctttactggcaagcttctcgaaagaataaataatacttaatgactgcctacagtttaattaactcatgattgaacttctcatggattgctataaacattaaattatatccttcctcaaagctaccatggataaaaatcttgtttaaagctttaattctcttgcctaaacaattctgaaattccagcaaatctgtatgttgcacagagaggtgagagaatccaccttaacgcatggttataaagcatgttattttatagagcaaggatgaggccttaatttttataagattgaaaatgtgcacatgtccaagcacctcattaatattacagcagtcattaaacatctctggatctcaggcagtcttattagcataaactctgcgtattaccacaaggtttcaagtttctattctggcttctcatcttagctaccattttctgtctgcgtgatgttgcaaataaattttccttttggcatggctcagctgtcaggcacctctgttctataatgaacccatgaattacatctccctgctctgacatctctggtctcacacatcaaaatattgttcttcaattgtaatttataacttaatttaaatgtcccttttcccgtgacctttttagatcaaatggcattgcatctggcagtttctactatgccaaagcatacttttcaaatatagccattataataactatataaaaagcctacttaagttagactgcattcaggctaattaaataattccagtccatgaagaacaatattagatatcaaagtcttttgctatgcaaaatatctgtttatacatcacaagaaactgtcaaaataactgagaaaggaaaaaagtatttggaataaatcttaaaattcttcatatagttttaattaattatttcgactattaagataagtgagaaagaccttgccgaaatatgttcaaaacaaaatttaaaaatttcttagccacgtgcagtggcttacacctgtaatcccagaactttgggaggctgaagtgggcagatctcttgaggtcaggagttcaagaccagcctggccaacacggtgaaaccctgtctctaccaaaaacacaaaaattagccgggtgtggtggcgcgcacctgtaatcccagctacttgggaggctgaggcaggagaatcgcttaaacctgggaggcggaggttgcagttagccgagaccgcgccactgcacgccagcctgggtgacagagcgagattctgtcttaaaaaaaaaaaaaaaaattcttggctgggcgtggtggctcacacctgtaatcccagcactttgagagaccaaggtgggcaggtcacttgaggtcaggagtttgagaccagcctggccaacatggtgaaaccctgtctctactaaaaagaaatacaaaaattagccgggcatggtagtgtgtgcccataatctcagctactcaggaggctgaggcagaagaatctcttgaacccaggaggcggaagttgcagtgagccgagatcacgccactgcactctagcctgggcgaaaagagtgagactctgtctcaagagaaaaaaaaaaaaagaaaagaaaaatttcttataaccataattcacaaatgtcaatacattttcatttatacctccatcatcgataacctagtgccaagtcaatatatatgaaacatgtaaatgttaaaaaactagaattgaaactaagagcacaatatttatttttatttggccattatcatttcaaataatgctattaggtaccagagaggctaaaatttgtctgaatggtcttacgggagcaaaattcagggataatggaaaagacaaagaatttaactgcagagggtagggcttgagagaaaggtctagttaattttcagaaggaaatatagttattgaaccaatcttccctccctctttccatcactttctgaaactacaatgttccaggaattatgcgccagccctggagtcacatggaagaaaggagggggtcgcaacatttgctgagcagtgcacagtgtgctaggaactgtgttaggtctttatgatttcatcattccacacacctctcttccacagccagagtactaaaaatgaggaaatgaaatccagaggttcagtatgtttctctaggccacttccctagcaagtagcagcatgaggattctaacataaacccatgttctaggaagatgtccctaccctagaatgttgctactggggcagtttaggacaggcaatctggtgggagcaatgggtacggggactttttccgctgcagtgacaaagcaagcacactgtcttttcttaacttggggctaggggatgagggtgggtggaggaaaggagggagccagcagctcagaaaagaggaaagacacacatgtaaacaaactaacaaaaaaatccccatccatgaaaacactcacagtgctaaatgaaagctgatggggatgacatttgctcagtctggaaaatctaaaatgcattcacaggggaggttttgaaaatcaacaaccagtataatatgattaacttgcctatgctttatgaacagcaacaaccacataaaaaacactattctaggagaaataagcagtgctattattgcagtaaaaacaggctacacgaggcagggcggacctgcgtccttcgcttctttcgctgtcacagaagaggctgaggtaggtcatttttggaactttccagtattcaacattccttcacttaacaaagattttttcaaaggcaaaatattatagaatattcttctaaaaaggaataaacaaatggtaataatgttaatacattaatttagaaaaataaaaaaacaataaaaccattgaattaagccacattccccacgccaaacactaaatgaatggctcctgcacaggcttcacttacactttagggattaaggttgtgcctcttaattttcaagtctctgtgaaagctgaagtttatgccacaggtctttaaatgcaattatggataattaatcatttacatagttaacatgtctacagcctgacttctttttttataaatgcgagatcagccacagaatagtagaaagggagggtgcggagggtgtaggctgcttgccggggcaggaggactccacagacgcagtcaataatctactaagaagactcagcttgaggacccacaatgagtctaactctggccacagggagaaaagctcctggcacattcgtgaacctagactgtttatgctgcttttctcaataattatttgtcagctgagaaagacctatgtctggccacaagtggaaatggttcaggaccacaaatggaaactaaaatatgttttcacttactcctggcatcctcatagccttgaaaacagaaaaaaatttgtgacatgaaactgggcagaaggctggaggatgacataaaaaccacaggtctaagcatctcacgtaggcactagtgaacctactcatacatgctaaattgacctagaaagtgtatgtgaaaggctttcacacaaaaacacaaaatcaagaccagttacatcagtattaagaaacatttacagtaactgctttaaatcctacttagtagaattgaggtacagaaataactgcccccaatccaagggctcagcagtctgaatctcagtgctttgtgatgagtgattctaaggttatgcaaacaacagtccacctaatatttttggcaatgataatgaagttatggaacaacgaagaccgaagaggcatacactgatgcatataaagctccagagttgggaaaatatacaagcgactgtactttctaaaaacttcagccaagaacacagctttagtaactaagaaataagcaaaaagcctctgggcaaccaaaacagtgtccccaaaagccaaaggccctggagagccaggaagctcccactctgagctttagacacttagttacctcacaattctagctttcccaatctaataacaggtctcaaaagaaaaaatcagaaagactgtatgatttcaaaagagaagagcagcagcagacagcctgactgtgggagacacaaaaatttagcaactattatgcaaaccaaagagctcaaactctaacagttgcacattcttttgttaacggacaccagtaatgatcactcagaggcatcgagtaaaggtggacttgacttgagaagatatgaaaatgtattcctcctcatttctaaaatggaagaaaaaaagtaaagaaagaagaaaaggaggagaagagccagttttcctaaaaatgctgggataactagtactccaaagtgctgcagtggctggaatacacagcccaacaaataccaggtgtggggagaaggcaggccactcaacaaataggggagcaggaaggacaggagtggggcgccccagtgtcattacctatgaaccccagaaagttgctgggtaagggggaaacatccaagattctggaggacagggctggccaggacaacacaggttgtcagagtccagtggggctgggctctgggcagggctgtggaactgaagctaaaacagacaccagagacttgaaaaagctacagcttcaaggattgcctgagtttatcccaggccagctcaaagaccaaccttaaaacaacacaacttgcccacaagggtcactaatgagcaacaccttccctactctatcaggcccaggctaggactggtgcaggctggacccagagttttgaggggctagggtagtggctgaggaagaaacaacctgggaggtcagaacatatcaattaatatggtagttatacatgacaattttgttatctaaataaatatccttattctttgcataaggaagccaaatactccctattttataaatcaaatgtcctcacattacagaaatatcatagccactactagaaatatttttatacattctcaatatcagaaactccacactttaaataagtcataacagctgggcaaggtggctcacacctgtaatcccagcactttcagaagccaaggcaagaggacttcttgaggccaagagtttgagaccagcctggacaacacagtgagcccctgtctctacaaaaaaatttttttaaataaataaaaataagcaagtcacaacagatgcaaaaataataataatgagctattttttaaattttttttaaattttttttaaatttcaaaataagtaatatattttagtaatattttatataatagtcattttaactgtggtaggccaaaaaatgaccaccagaagatatacacatcaaatccctggaacctatgaatgtgaccttatttgggaaaagggtctttgcagatgtgctaaggatcttgaaataaaggagatgattctagataactcaggtgggccctaactccaatgacaagtacttataaaagagaggtggtgaagaaacccagactggagaagacacagacacacagaagagaaggcagcgtgaagatgagcagagaaagatggggccacagccaaaatgtgcaaacagccaccagtagctacaagaggcgaagagtgggctctgccaggaggagccggagaggtaccccactgacaacttgatgtcagatttctggcttccagaactgtgagagaacacctctctgtcgtttaagccaccaagtttgggtaatttgttacagtagccacaggaaacaaatacactaaccttcaaaaactggggataaaaaattatttaagagagctataaaaaagcattctgaggtgtttccaaaatataggaaatgaatactagggcaaatattatacattttagaattttgtagtatgctgtagaatacatgagcccttctgaaactcatgggcctgatttgttctaacaatgaggtgttcacttagattctcatcaaacaccctccccacaagggctgcagaaactcaaacatgttaattaccaaataaataaatgaatatatgattttattaaagcctttttttgttttttttttttttgttttttttttttttgagacacagtctcgctctgttgcccaggctgcagtgcactgatgtcatctcggctcactgcaacctccgcctcccgggttcaagcaattctcctgcctcaacctcctgagtggctgagattacgggtgtgcaccaccacacccgactaatttttgtatttttagtagagacggggtttcaccatgttggtcaggctagtcttgaactcttgatgtcgtgatccgcccgccttggcctcccaaaatgctgagattacagacctgagccaccaggcccggaaattttttttttttttttagacgaaggcttgctctgttgcccaggctggagtacagtggcatgatctcggctcactgcaaactccacctcccaggttcaagcaattctcctgcctcggtctctcaagtagctggaattacaggcatgcaccaccatacttggctaatttttgtatttttagtagagacggggtttcaccatattggccaggctggtcttgaactcctgacctaaggtgatccacccgcctcggcctcccaaaatgctgggattacaggcacgagccaccgcatccggcctaagcctgtttttaaatgtaaaaaggctaaaggtttttttatcaatttgctgaagacattgtgttattaatactaatataggctcaaatatgttaaaattctaactgatcaaacggtaagtggatgtttttataaataccacatatatctcaaaacattttaccactctttaacatggaaaaaaatcatctgataaagaagtttcttaaatgagtaaatgaactttctaacttatgccaaacaaaagtaaaagctgaatcacatcacattcctcagtccctgctgagcacctaggaaacaggaaggagatgcaggaaaagctgtggcatgaaggatttctgattggctaaacagcaaatcctccaaattacagattaaccagacatttctttctgtttctgagacggggtctcgctctgtcaccaggctggagtgcagtggcgcgatctcggctcactgcagcctccacctcctgggttcaagcgattctcctgcctcagcctcccgagtagctgagactacaggagcataccaccatgcccagctatctttgtatttttagtagagacagggtttcaccatgttggctagaatggtctcaatctgttgacctcgtgatctgcctgccttggcctcccaaagtgctgggattacatgcgtgacccaccgcacccggcccgattaaccagacatttcaagaaggcgctataaggtactggcctcaatttaaaccaagtttaaatagttatgtatataaatattgtgtatataaataagtgtgcttattaatttttagatgataaccacacttgcctcatagaattgttatgaagattaaatgaattcattcataaaaagcacttaaacttttgcctagcatataaatactcaaaccacaaatacatttcaattttataatcaggaagctgaccaatagttgataccttaaaaaataaaattaatagtgatgaacttaaggtcctatgactggctcaaaattcagtggaaaagctcagggtgggaaagaaatggcttatcaaaagcacatatacaaggaaaaatgaaacataacaagattacaacacaggactaaaaagaatgtgatgagcagacattcttataagctgagactgcactgagcagatgagcttttaggataactgaggggtatccctgggtcaccttatgttggtcagacctgaggagtgttgcttagtgcaggtgccacattttaaatgacaggcgaagcagaccaggaggataaataaaatggtaatatataaaaatggctaataccaccacacggatgatgcctgaaaacagtaccccctcagtaaaagaaagcagtcacaaaaggccacttattatatgatgccatttatatgcaatgtccagaataggcatatctatagagacaaaaagcagatgagaggttgcctagggctgctcaataaaaataaaaataaagaacctaattggattgtaaaagtggccttttatctccccatccaccccagagaagtttaggtaatgctctctctcatgtttagggaaaagaagaaagtggggtataaagtttgactttaaataaagctacatattatctaaaaagaaacaaagtactaaattttaaaagccatttcattcaaacaagacaaaaaataggctgggtgtggtggttcatgcctgtaatcccagcactttgggaggctgaggcgggtggatcacgaggttaggagatcaagaccatcctggctaacatggtgaaaccccgtctactaaaaatacaaaaaaaaattagccgggcgtggtggcaggtgcctgtagtcccagctacttgggaggctgaggcaggagaatggcgtgaacccaggagttggagcttgcagtgagccaagatggtggcactgcactcgagcctgggcaacagagtgagattctgttgcaaaaaaaaaaaaaaaaaaaaaaaaaagacaaaaattaaatcacgcaatttgtgttaaaatgttgttacatggaactttagaagggaatttatgaatttcttagcccaaaggaagccacacaggtgaacacctaaacacttaattttcaaaacaatagctcaaaatgtttctaaaactaaaaaattttcaaaaaataaaagttgaaaattatatattattatgctaataatcagctgaaaaggtcttggttataccagaaaacctcaactgcgtgatctttttctgcatcctcactaatgctatgattaacagcacaactttctgttgacttcaatatcctgttattacataaataaaacactggcaacagtgcctgtcaaggctgatttatatgatgtgctgttctgaaatttattggatttccataataagaaatcatagagcctatcagctttacccattagactttccaacaacaaataaaaaatcctgaacgacaagaaaacccaacatcttaccttaacccaagccagcaaacactaaccatttaatgttgactcatctggatagaaacatttaagtaaagggtgtgggtatggaatgaatgtcagaaggctcctctcacatgcttagggaaaacttatgaaagggcctcccggcaatgccttatttgggagctgagaaatattccacattcaagtcataagcactgcaaagctaatccaggtccagatactttagtgaaggccatttataatgaacaaacaaaaaatctgacaaaaattctatggacttaattttttagaataaaagagaaatgaaaatgatccttagaatagggttatctgcatattctgctatgccaacttcctaacatcaatttctggatgatcaagtgtgatatgaacttgaacttgatttatctattcaatcattcaacaaccatttagtatctctctaccatgtgtcaggcatcagactagggttagaaaacacaaataattaatactcaacagttaacaaatagtgatatttatagaccagagatgaaaaactatgaagccactgggagccttgaattctttgctgaaggagatgtgggtgtgcataaataaataagcaaacaaacatgtactctcttgaatacataaagagcttaatccaaacgtctaaaagccacccgtatctcagggaataaaactgtccaggcggaggtgaaatctttgttgcatgattataaattttacttacacacagtgaatatatagttatgtttagtgttggtgagaaaatggcaataaattactgagaaagaaaaagcaaaataatttgaattgtattagaaaccaggaaagatacctgagcccaaagaaggaaatccaatatcagtttagtaaaaataagttggcaagatatattctagaaaaccttagtctcaaatgatggggcttttctgcagtttctaagtaggaatataaaggtctattttgtaaatagccaaataaatgtaagcactcaaaggtggctaaattaaccccattaggataagacagatcatctccatgttatatagcatgatgtttacaaattatatgtcagctgcaagtgttcagatgagcctaatgcaaacactgtatgaggaaacacacacagaaatatttccacacaagatctttctggggaaacaccattacttcttcatatttaacataagcttatatttaatatataaaaatacaaataaaactttttttttttttttgagatggagtctcgctctgtcgcccaggctggagtgcagtagcgccatctcggctcactgcaagctctgcctccaggccacaccattctcctgcctcagcctcccaagtagctgggattacaggcgccaccatcacgtccagctaatttttgtaattttagtagagatgaggtttcactatgttagccaggctggtatggaactcccagcctcaggtgatccacccaccttggcctcccaatgtgctgggattacaggtgtgagccactgtgcccagccaaataaaacaattttacatttataggtgttcacatttgaaatattaaaataaaacatatcattgctacatacaaaaaggaatacgcccaatgttactaagaaatccctcttttcctaatgagagagaccaacatgtttattacatcttcttcctctacagcggtacaaagctgtttcttatgtatgaaaagataagaaatgcatgttaacataaatgaacaaacaaagaacaactgtcctgaactatctgccagttcactattggaccaaaagtagcaagtcatgtggccatgaaaataagatatttattaactacctctgtgattcttcaatgaggcctctactattaagaatgtgggccggatccggtggcttactcctgtaaccccagcactttgggaagccaaggtgggcagatcacctgatgtagggagttcaagaccagcctgaccaatatggagaaaccccgtctctactaagaatacaaaattcactggacgtggtgccgcatgtctgtaatcctagctacttgggaggctgaggcaggagaatcacttgaacctgggaggcggaggttgtggtgagccgagatcgtgccatcgcactccagcctggggaacaacagcgaaactctgtctcaaaaaaaagacatacggctaaagttttatataacctgaaaaccatcttcattaaattaaaacagactcaacactccaaacaaaaggcagagcttgccaaactagataaaaaggcatgaaacaactaaagaatacaggagatgttaccttaaatacaaagaaaaaacaagattcaaagtaagaagttgtaaagagatgtaccatgcagacaacaagcataagaaaactagagtggctgtattaacattagacaaaacagacttcaagacaaagaatattagtagacacaaaaaaggttacagcagaaaggtaaaagggtcaaaagacagagaaagacacaaatattttaagtgttcatgtgtctaataaccaacttcaaatatatgaagcaaaaattaacagaatcaaaaggagaaacaaccaactctacaatcacttttttttttttttttttttggagatggagtctcgctctattggcaggctggagtgcagtggcgcgatcttggctcactgcaatctccgcctcccagattcaagcaattctcctgcctcaggctccctgagtagctgggactacaggtgtgcgccaccacacccggctaatttttctatttttagtagagacggggtttcaccacattggccaggatgttctcgatctcttgaccttgtgacccgcccacctcggcctcccaaagtgctggaattacaggcgtaagccaccgcgcctggcctacaatcactattgaagactttcatacatgtctctcagtaacatacaactaggtgataaaaaaaattagtataagagaagatatgaatactaacgtcaaccactgacactgcataacagcacacccagtaactacagagagcaagttgatggcaagtacacatgaaacatgaaccaagacacatcacatgctcagccaagaaacaaggctcaaaagatttcaaaatactgaaatgttactgagtactctttgaccactgaattaaattaaattagaaatcaataacattccaaaaaataaaacttagagaagccccaagtatctggaaattaaggaatttagtactaaataattcatgggtcaaagaaatcaccaaaaaattcaaaacatttttgaacagaataatagatcacaacaaatcaaaatttgtggtaaaatcagctatttaacatcccactttagaaagctaggaggaaaatgatcaaattaaaccccaaataggtagaaaaaaattaataacgaacagaaaccaatgaaatataaaacaaacgggaaaaaataataaaaccaaactctaaagagatcaataatgttgaaacgtctttatattgatcaagaggaaacaaattaccagccttggcaacgtggagtccatcttaaaaaaaaaaaaaaaaagaaaagaaagaaaagaaaaaaagcactttctatataaaaaaatttagatggctaaactgtgaattctggcaaacatttgatgtagaaagtaatatcaatctttcataaacatcttaagaaaacagaacaggaagaacgatttcccaactaattttttgagggagtattactctgatatgaaaaccaaagttcttattaccaaactccttattacaaagaaggaagactacaactcagtatctctcatgatcacaaatgtaaaattccttaacaaattattagcaaattgaatccaatagtacgtagtgaccaagcaggattcatcctaggaacaaacagttccttcatatttgaaatcaatgtaattcactatattaacaaaataaagaataacaatcatataataatctcattagatgcagaaggaaaaacaaagcaactgacaaaattcaatgcccattcacaataaaaactcaacaacctggatatataagagatcattctaacttgattaaaaaaacaaagaaaggccaggtgcagtggcttacacctataatctcagcatttggggaagctgaggaggatcacttgggcccaggagttcgagaccaggctgggcaacatagtgagaccccgtcactacaaaaaattttacaattagctgggcatgatggtgtaccctgtagtcttagctacttgggaggctcagacaggaggattacttgagtctgggaggtcaaggctgcagtgattcaagattgctacactgcactccagcctgggcaatagaccctttctcaaaacaaacaaatacaacaaaaactgcattgtacttaatagtaaatgactgaaaactttctaagattagaaagataatgtccactctcatcacttctattcagtattatagcagaggttcaaggaagtgcaataaagcacaaaaaagaaataaaacacatagatcataaaggaagaggtaaaactatatttgcacacgacatgtttagcaggaccaaaaaaagccaacatataaaaactgattgtgtttctatgctatcgaagaccatttagaaattaaaattttagttacaacagaatcctcaaacaggaaatacttaggagtaaatttaacaaaatgttgtaagatctgtattcccaaaaaatcttattgtaagaagtaaaagaaagcggggcatggtggcatgcacttgtagtcccagctactcaggaggctgaagcaggagatcacgtgagccaaggacttcaagcccagactgaacaacatagcaagacctctttaaattttttttaatcaaaaaaaaaaaaaaaatcaaagacaacttctttaaaaatagagaaatatcgtatttatggattagaagatccaatattgttaggatgtcagtatttcccaaactgatccataaattcaatagaatcccaattaaaattccatcagactttttattttttattattattatttttttgagacagagtttcactcttgttgcccaggctagaatgcaatggcacggtttcggctgactgtaacctccgcctcccgggttcaagtgattctcctgcctcagcctcctgaatagctgagattacacgcacgtgccaccatgcccggctaatttttatatttttagtagagacgaggtttcaccatgttggccaggctggtctcaaactcctgacctcaggcgatccgctcacctcggcctcccaaagtgctgggattataggtgtgagccactgcgcctgcaagactttttaaaaattagaaactggaaggctgattctaaaatttacatggaaatggaaattacctcaaatagccaaagcaatctttaaaatcacatttaaagcagaaagacacccctgaggtcaagacttcctatatagctacagtattcaaaacacagaggccctaataacgatcaatgagacagaatagaatccagaaaaagatccaaacataaaaaagcagctgattttcaataacaatgtcaaggcagtcaaatgagaaaagtttttccaaccaatattgttcaaacaacaggtatctgtgtggaagaaaatcaattttcactccataattaacgcatcacaattcaaaatgaatcaaagacctaaatgtaagaagtaaaacttctagaataaagcacagaaacaatctttgtaatcttggagtaatcagagatagtaccataaaaggaaaataatgacttattaagcttcagcataactatatattaaagtcaacattaaggaaaaaaagtcaggccaggtgcggtggctcatgtcttaatcccggcattttgggaagctgaagtgggaagatcacttgaggccaggcattctagaccagcctgggaaacatagtgaggccctgtcactagaagaaacaaacaaacaaacaaaaactctaaaaaaaattagacaggtgtagtagcctgtagtcccaggtactcaggaggttgaggcaggaggattgcttgagctcaggagtttgaggttacagtgagctataatcactctactgtactccagccttggtgacaaagtgagacttaaaaaaaaaaagaaaaaggaaaaaaaaatttttttaaaagaatgaaaaaaagtcatggtatgggacaaataattcccaatacatatatcaaaggacttctacctgaaatattaacaaacaatccttataactaaattgtaaaacaaatttttttaagtaaacaaactatttgaacagaggcttcacaaaaaaagataaacaaatgggcaataaaacaggaaaagatgctcaaccctattaaattaggaaattccaataaaacctcaatgagataccagactacacatccattaaaatggataaaatttaaaaaaaaataactgacaacaccaagtcttggtgaagatgctaaagacgtaaaattataacacactactgatgggaatctaaattggaaccactttagaaacctgtaggccgggcgcagtggctcacgcctgtaatctcagcacttcgggaggcccaggtgggaggatcacgaggtcaggagatcgagatcatcctggctaacacagtgaaaccccatctctactaaaaatacaaaaaattagccaggcgtggtggcgagtgcctgtagtcccagctactcgggaggctgaggcagaagaatggcgtgaacccgggaggcagagctcgcagtaagcgtagatcgcaccactcactgcactctagcctgggcgacagagcgagactctgtctcaaaaaaaaaaaaaaaacctgtttgacagaacaggcgcagtggctcacgcctgtaatcccagcactttgggaggccaaggcgggcggatcacgaggtcaagaggtcaagaccatcctggccaacgtggtgaaatcctgtctctacgaaaaatacaaaaaaattagctggacgtggtggcacatgcctgtagctactcaggaggctgaggcaggagaactgcttaaacctgggaggaggaggttgcagtgagccgagatcgcaccactgcactccagcctgggcaacatctcaaaaaaaaaaaaaaaagaaaagaaaagaaaagaaacctgtttgacagtttctgagagagcttcctacgtacaaacaatcctgccactccaagtatttacctgagagaactgaagataaatgtcaacataaagactcatacaacaatgttgaaaaaacttttatttataatggccaaaagcttataaacaaccagaatgttgtttaacaaggttaaagaatatgaaaaaattgtgaatatgcatatccatacaagggaatacttatcaataaaaaggggatgaactatcgatacatgaaacacaactggctctcaaaatccttatgcccaaagaagtcacacaatatgattccattcctgtaacattccgcgaaatgcaaactactccaaaatgattttaaaaaaataaaaaaaacattgaaaacacgatacttcaatggctatctgaggctggaagcagaaaatgattataagaggccatgaggcaacttttgggggtgttggaaatgttttgtatcttgacattatagtagtttcacagatttataagtagtttcacagatttatatatctgaaaaccctcaaattttttactttgaaacagagcagtttattatacataaatcttacctcaataagttgtttcaaaaattacacactagcaatctcttttgttaataatgaagaaaaaacagaataaaaataagtaatctaagagcttagattcaaaaataggtccacataattgtcataaagaactgatagctctgggcaacattgtgagacatcatctctgcaagtaaaaataaccagctgggccaggcgcagtggctcacgcctgtaatcccagaactttgggaggccaaggcaggtgaatcacctgagatcgggagttcgagaccagcctgaccaacatggcgaaaccctgtctctactaaaaatacaaaattagccgggtttggtggcacatgcctgcaatcccagctactcggaaggctgaggcaggagaatcgcttgaacctgggaggttgtggtgagccaagattgcgccattgcactccagcctgggcaacaagagcaaaactccatctcaaaacaaaaacaaaaaacaaaacaaaacaagaaaaacagctgggcatggtagtgcacacctatggtaccagctactctggaggctgaggtgggaggactgcttgagcccaggaggtcaaggctgcagtgagccgtgatccaccactgcactccagcctgggcaacagagcaagatcctgcctcaaacaaacaaacaaacaaaaaagaactgacagctcaaaaattttctaaaccaattgcagttttaaaaatgaaacgatttatttaaatttactcgtatttaaatactcctactggatgttcaacacactttaatgtggccatatagcctatttcatttaagttctatgttgccctaggaagcaggaaatatacactaattactcacaggtttcttctaaactgataaatgcctaaccttgttttaaatctatgctatactctaagaaaacaataaatgctttccacacaacaatgtatatatctttttaacttattacttaacacagctcaaatcttctattactctagggaagtaaaaaatcccagtaacttctctcacaggatattttcattcatttttcattaggaaaatgcttgcaactgaagttttcggagtcagttcaacagtgaagtacaaaaattaaaacagcacataacttttcaattcatcacaaaatatgtacacataacctaagacacctgagccatgtcaggctagtctgaagagtttcagtgtcataaaaatgaaaaattgtacaacaaaaaaatctctgggagtgctaacaaaaccttcagaaggagcttgccacaaagaaccatgggcaaaagtagccaaaatgatttctatactgaagtatggtctacagaattcttaagagagtttggaataaaaaggggaataaatcatatacattcaagaaagtgccaaaaatagacatttaattaaatatggcaagatcttcattattcaaaattcaactgatagcacagttatgaaagcaggatttttttcacaaagcttttatacagagaacaactggccagacatggtggcccatgcctgtaatcctagcactttgggagtctgagacaggaggattacttaagaccaggagtttgaaatcagccctggcaacaaagtaagacgatgtctctacaaaaaaaataaaacttaaaaaaaggccaggtgcagtggcacacacctgtaatcccagcactttgggaggccgaggcaggaggatcacttgagcccaggagtccgagaccagcctgggcaatacagtgggacctcatcttgacaaaaaaaatttttatttaattagtcaagcatgatggtgggcgtctatgatatcagctacagctcttgggaagctaaggtgggagaaaagcttgagcctgggaggttgaggctgcagtgagccaagactgtgtcactgtactccagactgggcaacagagcaagatggtctcaaaaacaaaaattagctgagtgcggtggcacatgcctgtaatcccagctacagctactcaggaagctgaagtgggaggatcacttgagcctgggaggtcaagcctgcagtgagcctgcagtgagctgtgactgtgccactgcactccagcctgggtgacagagcgagactttgcctcaagaaaaaacaacaacaaacaacaacaacagaaaaaagttcctatcaaagactttctctttgtacacacacttttaaggtattctgaattcacagacattcatatctaacctaccacagcctctactgggcagtagtatcatcaacctctgagtttcagcttcctcatctgtaaaataatcttaaaggccccttctggcttaatcatatgctcaaaataaagattttgtatttaaaactaaccaacaaaaaaatccccactaactatcctatcgaatcagtgacaatgtacacaaacacacaatatttatgacaatgtgaaaaaacattctcttatttacagaatggcatatccctagcaaaaccactcaaatgttatatcatactcaagaaacctaattatactaggaataaaaatcagccatatcacgcagatatctacgtttcctcaaaagcaagctgcacagtagatttctaaatcaggaatggggactactttcttccctctgttaggaacttttgggactgtcagtatttaagtcatctagccgcctcggattctcctatttagaaactgggacagatgatcttgaaagtctcttctaactatagtgacctctcaagaaattaaaaaaaaagaaaaaagaaaaagaacaaaggggtgcttaaatgacatttggttaatcatcagaagaggtgcttagcctcatactcaacagcctacatacacatacacaacgatgcagactatcaatatatcagaaattgattccataaatatcattagctcttcagatttaatggtttcacattagtaatgatagagaggaattatttcatgtaactttaaaatacattaatattcctatacagccccatgggatatagcctaaggccaaaacaaataaaaacaacaacaacaaacaaagaacgaaagacaactggtttcagtaatcatattgtttgcagcagtgtgttgttatctgagctgctgtgtgtttattatgggattaaagtagatgagtaattatgatggtatgtcatgcaaccaactcagtaacattagcctcatttccctttacttttaattttttagaaattattcgtgtaaaactttttatagtcatgtaaaatattaacatgttccaaagtatactttataaaaaacaagtttatgcaaaaaagtttagcttcttcccatccctccatgtgctttaaaataaatacatggtctcagaaacagtgaagtacaaaaacacggcttctagattccaatcttgggggtatgaccttaaattgtgacttaatctctctcaacttatttccttatgtctaaaaaggtgataataatagaacctagaggccgggcgtggtggctcacgcctgtaatcccaacactttgggaggtcgaggtgggaggatcacaaggtcaggagattgagatcatcctggctaacatggtgaaaccccgtctctactaaaaatacaaaaaattagctgggcgtggtgggtgtctgtagtcccagctactccggaggctgaggtaggagaacggtgtgaagccgggaagcggagcttgcagtgagctgagatcgcgccactgccagagcgagactccatctcaaaaaaataaaaaataaataaaaataaaaatagaacctagaggtggttgtgaggattaagcaagatcttctatgcacagtacttggctttgtgaggcctcagttaagtatcaggtgctattattaggatctcatttgagagtcacctcaaacctgcagcacagacacagattaggaaatgaacctgcaggtgccacatcactggcctggagcccccatggcacccaacagccaagaccacaactcactcctgagtctacaggcgacttcatgctccgcactcatcacacattccctacagccagttcaggggaaaaagaagtgtcttcccactcagggtgacttcaaaagacttactgtgttcagtgcattcagagtggtgtcatcccgagaggctgcgacacagccgtcctctgtagagcctccatcacacattcctgcaaatgccgccatgctccttcagaagaaaaggtttttcctttattagtacatagtaatatcaggacagagacttagaccttcaattttcagaggacatttccagcccagaacaaattccattactacacgcatgatgaaccagttcccagctctgcctctgctcctatttttttttttttttcttttgagatggagtctcactctgtcatccaggctggagtacagtggcgcaatcttggctcactgcaacctccacctccaggattcaagggattctcctgcctcggcctcccgagtagctgagattacaggaacaccccatgcccagctaatttctgtatttttagtagagacaaggtttcacagtgttggtcgggctggtctcgaactcctgacctcaggtgatctgctcacctcagcctcctaaagtgctgggattacaggcgtgagccatcacgcccagaccaaaaataaatttaagttcctcttcactcacgcagaaagacatatgttacttttagtcagatccatttgtattgtttcttcccacgttttagcagtactaagattttagatttgagagcatgaagaatctaaatctatgagccacaatatttcagtagatgacaatcttctgaaagaaaagtctccagaaaacatgtgaaattaagtcatctaaaattttacttaattcctctcattctgcatatcaactacctttaggtgaattaaaagtaaaaaatcatggctgggtgtgatggctcatgcccgtaatcccagcactctgggagcctgacgccagaggactgcttgaggccagagagttcaaaatcagccctgacaacatagagagagaaaaaaaatatattagccaggtatggtggtgcatgcctgtagtcctagctactggggaggacgaggtgggaggatgacttgagcccaggaggttaaggctgtaatgagtcatgattatgccactgcactccagtgtgagaccctgtcttaaaaaaaaaaaaaaaaaaaggtgagaaaccagagataaaacctcttagtcattcactccacttacacattctcatctctactgaatgccaccatgcacaacaccgttgactagaaaacagccaggtaactggggcaacacagaaaggaccccatctcaaccaaaaacaaaattaaaaatagccgggcatggtgccacgggtctataaccctagctactcaggaggctgaggcaggaggatcgcttgagctcaggaagttaaggctgtagtgagctataattgtgccactgtactccagcctgggtgacacagcaagaccctgtttcaaaaaaacaaaacaagtaacaaccaaaaaaaaaagaaaaaaagaaaaaaaagaaacccacaaacccatccagggttaaaattcagatgccctaatccttgctttcatgtttttgttgtcgttgccaagacccagaatcactacatacaaagtctgcctgcctgctctgtgacacctgctctgtgacgaccgctctgtggtgcccgctctgtgccgtgtgaggagcgaattcacacttctctctgcatcgaaggcatttgtatgttctatgcaactgccacgagggtgatcacagataaatattctcatgtaggcaagccacaaaaatgtcaagttcaggacaggcactaatgaacagccacaaagtagagacagaacatgaaatctgtagagggttttgtttttgttttaaattttactttaaggtccaggatacaagtgcagaacgtgtcggtttgttacattaggtatatgtgtgccgtggtgctctgctgcacctatcaacccgtcatctaggttttaagccccgaatgcattagctatttgtcctaatgctctccctcccctcacccccacccctctgtagtggggttttcagatgagctgaatgactgaagtactcaactggattgagaggttttggtaactgtatgtatggcctaagctgttttcctcttgaaaagttccaaaatttgatgtggggcaaacaccaagaagaaaaacattacttcatcatgaaaaaaattacttcaaactatttttctctggtaagaagagccagggtcccgattacagagggtgtaaccaaacttaaagtcagagaacgcccaatatagaaataaaatctcaggggaaatgcaaagtttactgcctataatcagttcagatggtctaattcagaaagcaggatgggggtagattcctattaccttgctgccctcaagtacataaggaggtcacagtcgttaactccaggcatccagaccagttcctcatgttgggtcactgtatcaccatctggagaaggaaatggttgcagatctggaagtttggcctgtaagacagggatgagtaagtcacaatcaaggcatgtattaattataaagagctatctcaataagcagtctttaggaacatatacaatgttttactgagactctttccttggacagcagaaaaataacaacaaaaccatgagtcatttaaactgacctatttcacatgtcaggatcatttcaccatagaagatttcacaatagactgcttaatatctgcttaacagtgtcaaagtaaaccagtgccagcatgataccaagagtaaaactgaagcacacacatatgcataaaataaacaaaaaaacaaaataatgtctttagatgataacagctattgataaagaaggaaacacacatacatttccaatataacaagttgacaaagaagacatatgcaaatgatacctcacctaaggatatttgctaaaaaattaagtgagctatcctattagaatagtgttactcttaagacagtcaatagcaatataagtcatggtcaataccaaaactagatgagtattaagtaaacattaaaaaatatagttgaggccaggcctggtggctcacgcctgtaatcccagcactttgggaggccgaggtgggtggatcacaaggtcaggagttcaagaccagcctggccaagatgctgaaaccttgtctctaccaaaaatacaaaaagtagccgagcacggtggcgggcgcctataattccagctactcaggaggctgaggcagagaactgcttaaacccgggaggcagaggttgcagtgagctgagatcgtgccactgcattccagcctgggagagacagagcgaaattccatctcaaaaataaaataaaattaaactaaattaaattttaaaaatttatatatagttgaggctgggcatggtggctcacgcctataatcccagcactttgggaggctgaggtgggtggatcacctgaggtcaggagttcaaaaccagcctggccaacatgataaaaccccgtcactactaataatacaaaaattagccaggcgtggtggtatgtgcctgtaatcccagctacttgggaggttgaggcaagagaatcgcttgaacccgggaggcagaagttgcagtgagccaagattgtgtcactgcactccagcctaggtgacagagcaagactccatctcaaaaaaaaaaaaaataaaaaaaaaaaaataaatatatacacacacacacacacacacacacacacacacacacatatgtagttgaattgacctgtggtaacagaaatcagggcagtgatttctttacgaaagaaggaattgcttgtgaagaacaggaaggacctttctgggatgacagaaatgttctgtgccttgatacgaatcatcacggcagattgaaaagcatacataagatacgaacaattcgctgtacatagagtatacctcaataaaaagaatttaaaaaaatattcgagcaacagtgctccccaccaagactgtaagtgatcagatttaaatacctgtggcattttctcacccacactctgctgggacagagcaagagcaagcaggtgccatgaccaccataaccagcagagacctgtgaaaagtcagatatttgcaagatactcatgttctcatcctgtcaaatgatgaccatgggcacatgagtctgatagagctccatgggacatgaagcctgggcaaacaatttaagtgaatgcagcaggctgaatataagccagcaccatccaacagaaataaaataagaattatatatttaattttaaatattctagtagtcacgttaaacaaaatgccatatcccaatctggactagccatattccaagtgctgaacagctatgtgtggcagtggctcccgacctggatgtgcaggtgtgaagaactcaagagtgaagtggaccacggggaaatggagatagaaccgccccatccagggaatgctgccacacaggaatgggacccagtgtgtgtacatcctccatctttttccaaattccagaaatcttcacatttatgtaaaagtttgtggttttaaatgttggtattcaagtttttgaggcaactgcatagcaaaacatcacattagtaggccatgtggctctcaggctagccatcagcacccacacagctttacaggctgtcttccatgcctctaaatgtgtatcaagctgactttctccaagcaaggatgttcttctttggttaagtattgacttctctaacattgaactgagtgtcacaattagttctgcttaacacatagtgaaaatagtgggataaaattaaaacacaatgggcctggcgtggtggctcacgcctgtaatcccagcactttcagaggccgaggcgggcagatcacctgaggtcaggagttcgacaccagactgaccaacacggtgaaaccctgtctctacgaaaaatacaaaaattagccaggcgtggtggcacacgcctatagtgccagctacttgggagggtgaggcaggagaatcgcttgaaacctgggaggcggaggttcccgtgagctgagattgcaccactgcactccagcttgggtgacagagcaagactctgtctcaaaataataacaacaataataataacaacaacaataacacaacaaatgttggagtcaaaaggtctttgacactagtactgagttctgcttccccagcaccgagtacagtactgggtacagcagttctctaatgtctgttattaatcgaaaagtactattactgtgagcaggaccaacctcccccccattcttgagaaaaatggactagaaatataattagacagtttacagaaaaagaaacgaaaatgcctcttaatcataagaattgatgagttggagacggggttttgctgtgttggccgggctggtctcagctcctgaccgcgagtgatccgccagcctcggcctcccgaggtgctgggattgcagacggagtctcgttcactcagtgctcaatggtgcccaggctggagtgcagtggtgtgatctcggctcgctacaacctccacctcccagccgcctgccttggccccccaaagtgccgagattgcagcctctgcccggccgccaccccgtctgggaagtgaggagcgtctctgcctggccgcccatcgtctgggatatgaggagcctctctgcctggctgcccagtctggaaagtgaggagcgtctctgcccggccgccatcccatctaggaagcgaggagcgcctcttccccgccgcccatcgtctgagatgtggggagcgcctctgccccgccgccctgtctgggatgtgaggagcacctctgctgggccgcaaccctgtctgggatgtgaggagcgcctctgcctggccgccccgtctgagaagtgaggaaaccctctgcctggcaaccgccccgtctgagaagtgaggagcccctccatccggcagccaccccgtctgggaagtgaggagcgtctccgcccggcagccaccccgtccgggagggggggggggggtcagccccccgcccggccagccgccccgtccgggaggtgaggggctcctctgcccggccgcccctactgggaagtgaggagcccctctgcccggccagctgccccgtccgggagggggggtcagccccctgcccggccagccgccccgtccgggagggaggtgggggggtcagccccccgcccggccggccgccccgtccgggaggtgaggggcgcctctgcccggtcgcccctaccgggaagtgaggacccctctgcccggccagccgccccgtccgggagggaggtggggggtcagcaccccgcccggccagccgcccagtccgggaggaaggtggggggtcagccccccgcccggccagccgccccgtccgggaggtgaggggcgcctctgcccggccgcccctactgggaagtgaggagcccctctgcccggccagccgccccgtccgggagggaggtggggggatcagccccccgtccgggaggtgaggggcgcctctgcccggtcgcccctaccgggaagtgaggacccctctgcccggccagccgccccgtccgggagggaggtggggggtcagccccccgcccggccagccgcccagtccgggagggaggtggggggtcagccccccgcccggccagccgcccagtccgggagggaggtggggggtcagccccccgcccggccagccgccccgtccgggagggaggtggggggatcagccccccgcctggccagccgccccgaccgggaggtgaggggcgcctctgcccggctgcccgtactgggaagtgaggacccctctgcccggccagccgccccgtccgggaggcaggtggggggggtcagccccccgcccggccagccgccccgtccgggagggaggtgggggggatcagccccccgcccggccagccgccccgtccgggagggaggtgggggggtcagccccccgcccggccagccgccccgtccgggagggaggtggggggggtcagccccccgcctggccagccgccccgtccgggaggtgaggggcgcctctgcccggctgcccctactgggaagtgaggacccctctgcccggccagccgcccagtccgggagggaggtggtgggtcagccccccacccggccagccgccccgtccgggagggaggtggggggatcagccccccgcctggccagccaccccgtccgggaggtgaggggcgcctctgcccggccgcccctactgggaagtgaggagcccctctgcctggcgagccgccccgtccgggagggtggtgggggggtcagccccccgcccggccagccgccctatccaggaggtgaggggcgcctctgcccggccgcccctactgggaagtgaggagcccctctgcctggccagccgccccgtccgggagggtggtgggggggtcagccccctgcccggccagccgccccatccgggaggtcaggggcgcttctgcccggccgcccctactgggaagtgaggagcccctctgcccggccacgaccccttctgggaggtgtgcccagcggctcattggggatgggccatgatgacaatggcggttttgtggaatagaaaggcgggaagggtggggaaaaaattgagaaatcggatggttgccgggtctgtgtggatagaagtagatatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcgtgctcgttaagagtcatcaccactccctaatcttaagtacccagggacacaaacacttcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaataaataaataaataaataaataaataaataaataaataaaaaagaattgatgagtcaacctctctgacaacagaaatgcaaattaatggcacatattcaattttgcatctatcatactgacataaagccaaatgtttgacaacacataaagccacgaaaaaaattagcactcatattagttgctagtgtcaacacaaactgatacaatctctgtggaggggaatgtggcaaaacccccaaaattatatatgcacttgtcctctaagtcagccatcccgcttctggggatatagccccaagatacactggcaaaaacatcaaaatctatatgcacaggctattcactgcagcattacatgtaatggcaaatgactggaatcaactcatatgcctattaatagggatcagatgaataaactgctacattcatacatggagttctatgaaatagtattatagaagggaatgagaaggagctctatatactgctatgaggagaacacaagaatatactgttaaaagaaaggtagcaaaaggatgtatattatgttattatttatctaagaaggggcagagggaatgaaaataagaagcttaaataataataatctcattaaaactacaccaaatggaaagaaatgcaacaattgagctggttctactctaggaactgtttcaagtaactctaagatatattaatttgcttatacagccctggcaggatatacataacaaaatgcaataccaagctgttttcaataagcatactgtttgtagccatgtgattattgctattctgggctgttatatgtgtattatggaattgaagcaaataagtaattttgttggtgtcattaaaaaatgggatttgagtcacgggaaaaaaataaagatatacataaaagaaggacagaattagtataaaggccatagaaaaatctgaatttgaattggatgtatcagcataaatttagaatgtattttatctttaagaaagtagggaaataaaacacctatttcctattctgtctactgaaaaggcctcgaaatagcaaccaacccagtaagaatgaataccccagcacccagtatgtaaataccacttcccactacaataaaagagggctcttctgagacaagtttaattccacatctagggaagacaatgtataaggtgaggcagtaaaatcatgtcttactagagaaaaacgattaagtgaaaaggacaaaaaccactgggattaagtgaaaaggacaaatacgaaggaagatgctcctactggcccaaaatggatcttttaatcatcaataagaactgattaaagttgattatagattaaaaaataaaatccactggtaccatggaaagataagggtgaagtttcatttatttgtacaaggaataaatggatggcagaattagaatatcactgttttgaaatccctaataaaataatggatctaagaaataatcagtggtggccaggcgcggtggctcaggcctataatcccagcactttgggaggccaaggcgggtgtttcatgaggtcagaagttcgagatcagcctggccaacatagtgaaaccccgtctctactaaaaatacaaaaaagtagccaggtgtggtggcgggcgcctataatcccagctactcaggaggctgaggcaggagaatggcttgaacccgggaggcggaggttgcagtgagacaagattgtgccactgcactccagcctgggcgaccgagtgagactccgtctcaaaaaaaaaaaataaatgatcagtggctgctaattacaattaaaaaagagacatatgagcctcctggcagaagcacttaccaccacccaggaagcatttttctggaaggcagggtaccaaactagaatgaggccgaacctctagatttaactactaattctcaagtcatgcaaagagcaaagtaacaaatttaatgcaatcagccaaatctagactgcagaacaccctacaggatgaaatagcttctttaccacatacactgggggactaggggaaggacctgggaattaagagagatttaagagatgtatcaaccaactgcaatgaatggctctcatttagattctaatttgaactatgaaaatataaagaaagagagaaagatacagacagacaattagggaaatctgggcatcgtatacacttgaatattaagaaattggtaatttttatatgttctgatatattgtgattgtgtccaaatcccttatttttggaacatctacaaggaaaatgatgtatttgtgaggcgtttaaaataacggcaggaagaggtgtgagggggaataaatgaaatgggtttgactaggatttgatacttgaggaagctgagtaatgaagagaaggactttactgtattattctttccctgcttttgtatatgttaatattttcctaataaaaaggttaatttttttttttaaagactggttctgtcaccaggctggagtgcaatggtgtgatcgtggctcagtgctgcttcaaccgcctaggctcaagcaatcctcccacttcagcctcctgagtggctgggactacagacatgcatcaccatgcctacctaatttttgtattttttgtagagatggggttttgccatgttgcccaggctggtctcgaattcctgagctgaaatgatctacccaccttggcctcccaaagtgctgggattacaggcgtgagccaaaagtcaaaaattttaaaaaggtaaatgttgccaattcatttttaaaagttttattatttttggtgctccaaaacatttctttttgaaaatgaagcacacagaatacatttaaaatctgatgtaaaaaaccaaacatctgattttaaatggtggtatacaaaaatccaatcacagtaaatttgctccttttccaagaatgtaagcatcttttccttaggaactacattttcttttatggtaggaaaaaaaaaatctataaaataaaagtctggtacaaagatctcaagacactggaaatacacagtgagagggaaaaaatgggtagtaaaatacagtgcaagagaaagtagagaatgggagacgaaactgagtggcattaggttgagtatcaggttcccagaccgaaaatacagccccgaggtggcagtcaggcccacctaatggaacacaccaacaaaagactctacttgaacaagcagacactgtcctcctgcagcttctttcagtctgtatcagttataaccccaggtctgggatgagaagtatcttctataaactatgtgaccctgatagtttttgtgttcacttcacttcataactccttcacttcttaagttctttcattacagagttaaaataggttatttaaaaatgtaaatgacacacaatttagaaatgctcaaaatctagacagaaataataactagacagacgactgaaatctctatgcacttccaaggctcactgctgcctgtatcccatgtctttagacatgatggccttagctgtggattccccagcatccattccaactcaagtgctaatcatgttaaactctttcctcatggtttagaaatagacacatgacccaatccatggcaacaatatgtgggtctactggggacctgctggggaaattttccttgctcctaaggggaaaagaagtccaattctttcttcctctcaacacttgctaaatttcattcattgtaagatccactgttattttatgtgcactgagaaaggataaaatatagccaataaattataaccacaccacagaatgtacaatgaagcccaactataggagcaaatgtgaaggaaaaaagtgtatcttagaattagtcaaactgagctgaggatgacgccacctccatggaggccagctgggtacaagagagtctcagagaagcacagcagagccccagtcctgcctgaccaggatgtcatgacatgggagacagaaacagagccagagtcctgtcagtgaaagcatcctaactgatactgagatcaaaacagaatatgccgggcccagtggcacatgcctttagtcccagctactcagaggctgaggcaggttggactgcttcagcccaggaggaggtcaaggctgccgtgagccgtgatcgtgcctctgtgctctagccttggcaacagaatgagacctgtctctgaaaaacgtaaaaacaacaacaaaaaccaaagagctgtaataaatgcaatgaaataagaaagagcaacagtcgtgacacagcaaccctctgactgaaaagtgtcctaaccatcttgactctcctgaaggaaaagaagttgtttatttttttgcagacagtctcgctctgtcgcccaggctggagtgcagtgtcgcaatcttggctcactgcaacctccgccccctgggttcaagtgatttctcctgcctcagcctcctgagtagctgggattacatgcgcacaccaccatgaccagctaatttttctatttttagtagggatggagtttcaccatgttggccaggctggtctcaaactcccgatctcaggtgatccgcctgcctcagcctcccaaagtactgggattataggcgagagccaccacgcccagccgggaaaagaggttttaaacatcttttatctttttttttttttttttttgagacagagtcttgctctgttgcccagactggagtccagtggccacagtcttggctcactgcaacctccgcctccggggttcaagtgattttcctgccacagcctcccaagaagctgggattataggcgcctgccaccacgcccggctaatttttgtatttttagtagaaatgggatttgccatgttggccaggctggtctcgaactcctgacctcaagagatctgcccacctcaaccttccaaagtgctgggattacaggcatgagccattgtgcctggctttaaaaatgttttaaataaaaatatgtgatcaagtgttcatcaatggatgaatagataaacagtgatacgtacatacaatgggtcatttagccttaaaaaggatagaaattctgacacatgctattaacacggatgaaccatgaggacattatgctgagtgaaataaatcaggcacaaaaagacaaatactgtatgattccattcacatgaggtacttttatgaggcagaacagtcaaaaacagagagaggaaggagaatggtgattgccaatgctgcagaagagaaatggagttactgtttacgggtacagaatttcagttttgcaagatagaaagagttctggagatagatgacggtgatggctatacaacaatattaatgtacttaactactgaactttgcacttaaaaatgggagatggtaaatgtatgtggtgatctgaggagggtggaaaaaaaacctctgtatttataaaaaattcccgatagcaataaccacattctaagatgctgcgcaacagaataaagtgccagcagagtaataagaaacaaaaacctattaaggaagctatgaaaatgaacttcacctgatgactaggaccgacacgaatctccccctgggtactgttcagcctcctggaacagaaatagagcagattaagttagcgcaatacagttttgacataaacattcacacatttttcaaaaaaagtaattctcttcaaataaatgaggaaaaactgaggaagaattaacgtccccactacttctaatgttctgtatacatacaccacccaccaccacacatgcacctctaaaaccttttcctttgaaaatcctaagaactgcagcttcctttcatgagaaccttcctacatcatcgttctttttttgagacagagtctcactctgtcgcccaggctggagtgcagtggcacaatctcggctcactgcaacctccgcctcttgggttcaattgattctcctgcctcagcctccagagtagctaggatttcaggtgcctaccaccacgcccggctaatttttgtaattttagtagtaaatttcagtaaattttgtaattttaataatttgggttttcatcatgttcagccaggctggtctcgaactcctgaccctcaagggatccgcctgcctcggcttcccaaagtactgggattacaagcacgagccaccacacctggcccctataccatcattctttcatgcctcagagagatggacattcctgtagtacaattccagtcagacatttcttccgttcaaaacatctcagggtgccctaccataagccttataaaatacaaataagaaaacttatcctaggacatatactgagccatccatccatccatccatccatccatccatccatccgtccgtccgtccgtccatccaacaaatatttaagtacctactataagccaggaattgtcctaggtgttggggataaagcaacaaacagggacaggtacagaggctcacacctgtaattctagcactttgggaggctaaggcgggaggatcgcttgagcccagaagtttaaaaccagcctgggcaacacagagtgacgccatctctacaagaaaattaaaaatcagctgggcatggtggcgcacgcctgtagacccagttactcaagaggatcgcttgagctgggaggtcaaggctgcagtgagccatgttcgcaccactgcactccaacctgggcaacagagcatgaccctgtctataaaaaaggcaacaaacaaaacagtgtcaaagaagatggcctaaaaggaggcacatgctcttgtttttctctcatggatctgatacccatacccactgtgtttgaaattgttaaaaatacattttggaaagctatcgtttcctttagggcacctgggcccagtactttcttcttttaatccaatcattttctcatgaagaatcttgcttgggcaaaggtggtggtaaatgtgacaaaggaagaaaaaaagaagaggaggaagaaggggagaaagggaggaggaagacaaggaggaggaggagaagacgaagaagaggaagaagaagaaatgtggtggcccagtcatcaagaatcttacaagcctccagctggcgaggcagcatctgtaccaaaacaccagaacaggccgatgcccgtattcatcaacataagacacttcaaaagacacagtacaaaaatgtgaaggggaggtaccaaaatgaggcggcttcaagagaagacacagaaggagataataggcctagcagcaggaaaaaaaaagaggactttccaagtagaaatgaaagcatgcagaggtggcaggctgaaagggaggggcggtgacagggaaatgcttgcatgtgggctgacttcatcatacaagtcatcttcatttcttcattaggagaatggtatgtggaaaaacgaagctaaaagatggattgttctcataggtttatgcaggaaatggaagaagctgttttaggaggtatgtaaaggaatcaaatcagccacaagttattttaatcacaagcgcttctttaagaaaaacaagcaagcagtcagcgttaccactatttcccttccaacttgtccttttctattttctaactagctgtgagcaaaacaagctgccaaaagctctaaatactttccaaatgctttcttgcctacaagtaggtctagccagaatgtatcatttcagaaaccttcagccacagcccattcagtaacttctgcctgcagctcaacctttgggttcttccagaaggtctgttactctggagttctccagtggttggatatcatttccatatcatggctacactgttaagtccttgataattccagaaaaaacattcctgcttgatttttattttattttggagatgaggtcttgctatgttgcccggtctgttctcaaaaccctgggctcaaagggacccccacctcagcctcccaaagcgctggaattacagacatgagccaccgcactcaccgcccaaccccatttttattttaataagccaatttatcatcatatttagcttaaaaaaacccaatgtaccatggtaatgaaacaaactcccaaataccctgttgactagaactacttatatctcacgtatttccataaaaataggatgcagataattattattaaactaataatacaaatgagacaaaaaaatgtattgggccatcttaagagacttgaaaattgtttaagtttataacagggaagagtactaataagtaggctataacatgaaaaccaagataaaataaggaaacttcttaaaagcttatttaaaaatccctctttgcaacaaaagtatttttaaattgtatgtaacttttaaatatcagggttctatagcaagaaatacaacaaagttctttttgagcaggtaggatctgaggtgcagacaatggcattagcctactatatgcaagagttacagaatatagaataaatggcaaaagtactttttaggtccaagatataaagaggtagatagcaacacaccaccttagacaaagcttgatgcagctgacagaaaaactgtcagaatatgagctgaaggtgaaagacaagaagtacacatggtggggaagtgccagcatccagctgtatctggatccaccgagcaatcagaatcctccttactgaactaagtatccctcccctgctgccgcactgctctcctctcttttttctttttcttttttttttttttatcctgtatccccagacagctgcatcacccttgataggtcaggcagccacaacaccccagaatgtttccctggcacatggaaaaagcacccccatgaggctgcagccaggtgcaaagtgagtctgtgaactgctcccttcttgaatgcacctttgtggttcacacctcactcattaatgatatttaaacatgacagtatcaacagcttgtaggaaacactcttttttttttttttttttttttttttttttgagacggagtctcgctctgtcgcccaggccggactgcagactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaggaaacactcttaatcatcaattgcaatcttgatgcaatgactacattttgtcttttacttaacatttctcaaacttttaggtctctgtacccttttacactcttaataattactggagtgtgtcttggtggtcccagaatctgtctcttgtttcaacaatgtctgaacagcacatatcctgggactccatctgttccagcctccaactgccctccaatctcccctccatttgcaacctccagcacccttcttctcggccatatcctgcttctgggaccagccaccactgtttttgtggttagctcctcaaccccgcaagctctgggaggcatgagtgacttcttccacgaatcggccaagaagattcagggcactgagtgtctcttgaagatgtgtgtgtggcagcggcacccatttccaggatgtggagaagccatctcaaaatgagtgggggtaaaaaccctgggttccatggaagccaccatggctctggggaagaacctgaaccagatcctcgatctttaggccctgggttctgcctgcacagacccccatcttctgtgacttccggagagccacttcctagatgaggaggtgaaactcaacaacaagatcggcgactaccagaccaacctccccaggctgggctgggtaaatgtttcttccaaaagactcaccctcaagcaccacgaggagcctacagagcccagcaaacttttaggagcccctctcaaagttcagggctactgcctaagcagcgcctccagccactaccctggacccctctcccaagccgtggacaaaacagaaataaagcttattacaaaaaataaaaataaaaattactgaacatcccaagaaatctaaatttttgaaaactttcaaaatattgatttaaaaatagcaataagcccattacataacaatatacatattcttataaaaagtaattgcatttaagcagaaacctttagtaaaaagtgaggcattattttatgtttttgcaaatctcattaatatttgacttaatagaaaagacagctagattctcctatctacttttgaattcaatctgctgcaatatattgttgtggttaaattatatgaagataatacagcctaacacagtgatgtaactagaaaagggaagaatatagcctttttgatactacaccaaaaactcaacaagttcccggcactctggggggccgaggtgggaggatcacttgaggtcaagagttcgagactagcctggccaacatagtgaaaccctgtctcgactaaaaatacaaaaaattagccgggtgtggtgttgcatgcttgcaatcccagatactcaggagcctgaggcagcagaattgcttgaacctgggaggcagaggttgcagtgagccaacatcgtgccattgtactccagcctgggcaacaagagcgaaactctgtctcaaaaacaaaacaaaacaaaacaaaaactcaacaagtaatcatttcttaaagatgtgtacacaaggtgagtctaaaagcctatcaatagtcttttgactgtgctactctgaaatccattggtctgtcttgcctttgaatgaatggatcttctactcagatgtgattttgtaatgtcatgcattggttttatagagaatgtcagtttactcagttctgcagatctttcaaatatcaaccagttctttatacagcattttttaaaaatcatattaatatcacctatctcataagaaatgcctttcagtgtagagaagctgtcaggctcagagtggtgagtacaagcttttcgaaattctaatttttacttgaaagttcaaatcttagccttgtcaaatagtatcagtgttttccttgaaataacaagctcacttaattcatcttcaagaaagtttctgccaaatgcccacgtctgaatgaccacagtttgtctgtcagttgttctttcaaagagtaactgatattccatgaaaaaagtggctagcttcgcttctaactcaaatgtctcgacggaaccaaggcttctcctcaagacaatcactgtcttttggtatagggcagaagacttttaagtcgggaagccaagtcttgggattaaaaaatactaataggctgggcgaggtggctcacgcctgtaatcacagcattttgggaggccgaggcaggtggatcacctgaggtcaggagttcgaaaccagcctagtcaacatggtgaaaccccatccctactaaaaacacaaaattagccataccgggtggtgtgtgcctgaatcctagctactcgggaggctcaggcaggagaactgcttgaacccgggaggcagaggttacagtgagctgaggtcacaccattgcactccagcctgggcaaaaaaagaatgaaactccgcctcaaaaaaaaagaaagaaaagaaaagaaagaaaagacaagacaagaaaagaaaagagaaataataataataataatgaggtccacaagctatgctctgagaagcactgattatggcacattctgaacttcagcaagtgctggaggctaaaattcatctagaagactccagctttcttctttgatgaataacaacagtagctaacatttcagcacttactatctgtcctaggtgctctacagtattatctcatttctaggtattaaggcatttaattcatgttttgatattaacagacatgttagtattgctattcacagaaattcaggtgtctttctatcctgtgttcaaagcaacacagcactacacgtggtggtgcacacctggaatcccagcactctgggacgctgaggcaagaggacagcttgagctcaggagtttgagaccagcctgggcaacaggctttataaaaaatgtttttttaattagctggtcacggtggcacgcacctataatcccacctactcaggaggctgagccaggagaatcacttgagctctggagtttgaggctgcagtgagctatgatcacaccactgcactccagcctgggcaaaacagagctagactgtctttaaaaaaacaaacaggccgggcgtggtggctcacctgaggcaggcaggtcacctgacgtcaggagttcaagaccagcctggacaacatggtgaaaccccacactactaaaaatacaaaacttagccgggcgtggtggcaggcgcctgtagtcccagctactcaggaggctgaggcaggagaattgcttgagtctgggaggcagcggttgcagtgagccaagatcatgctactacaccccagcctgagtgacagagcaagactgtctcaaaaaacaaacaaacaacaacaacaacaacaacaaaacatagctactaaagaggtttctgcttggatgtacaatgctgctgaattaacaaagtaggtctagtcaaagccagggtggtcatcaacttcggaagaaaaatccagaccaaaggcagtatgaatcctagccaagacatataaaggatactactgtatgaattaagaaaccaaagatgcaagtaatatccagaataatgcaacatacacacacatctatctttatcctcatcttaagagttttcacatacgttatcttaaatctaggtgtaggccgggtgcggtggctcgtgcctgtaatcccagcactttgggaggctgaggtgggcaggttacccgaggtcaggagttccaaaacagcctggccaatatggagaagccccacccctaaaaatacaaaattagccaagcgtggtagtgggtgcagtagtgggcacctataatcccggctacttaagatgctgaggcagaaaaattgctcaaacccaggagatggaggctgcagagagccgagatcccgccagtgtactccagcctgggggacggagcaagactctctcagaggaaaaaaaaaaaaaaaaaaaaaatctaggtgtattatagttacataacaaacacaagcaaaataataatactagctatcaattactaagtgctttctatgctgggcacatattatttcattattccacgacaactctatgaggcagtatctccataggtaataataataacaatactaattttaacattaataaagcaactaatatatccattgaacatttactatgtaccaggcattgcaaggtaagcaatttccatttattttcttatctaatcttacaggcgaccctgtaagataggtgctattgtagtaagtgtacaggtcaggtcactgaagccaagagacgttacgcagttgcccaagattaaacagcaaataagtggagaaatcaggaatcctactcaaggtcagctgactccaaagtcagagctctcaatcacactcccatatggcagaatgattaagttactgaaccaaaatcacacaattaattacaaacagaatgatgagaatccatatccctttccctattttggttctatgtttatttcaaacacccaagcaagacaaaatgatcaaaagaatttttttaagtttgaaagtcatgatgaaagagaaaaacctatcaaagttagaggccaatgtatataatactcttgaaatgacaaaattacagaaatggagacacattcgtgattgccaggtgttagagatggtggggagagggagggaggcggagggtgcgaccacaaagggagagctttgtagtgatggatagctctgtctcttcattgttgtggtggttacacaaagctatccatgtgataaaatggcacagaactacacgcacacaatctactaatgccagtttcctggttttggtatcgtattacagttacaaaagatgagaccactctgtggtatctttgcaacttcctgtgaatccaaaaaatttaaagttttaaaaaagtcaaatgaagggggggatatactacaggcagatgggaaatcagaaagaacaccagacatgagaaaagctgattaaaggacaaacagatcaacctcaaattacactgtacacagctgaaccagtaactgaagaaagagggccacagcttattagcaatgagattcaagaaattaactccaagtgacatatttattttttccttatgtttactaaggatttctgctgtggattcatcatcttggagacatctttatactgtgaatcatattacaaaaaccgaattaagaagtgtcactatcatccccagcaaaagaaggaatttctctgtgtagctaatgtaaataatatgtttttcaaaacaacttaagttcagcctacattattctacaaatctttgttttagaatatgaaaaaaatagttccagaagccaaattacaacaataatggtaagttgttgtttttattcctgaagtattaaaaaaacagaaagtcattgtatatgaaatctgatacaaaaaaaccccagtgtaacaaagcagtatccatagcaactacaacttaatatttcagtcctcttcaactgcagtggattaaataaaatgacaagatgttccctttgaaaagtaacctgttaccatggaaacgttttattctaagaagtaaacagggaatggacagaaaggagcagggagcctgtaaatgaatatcaaaaagggagaagcatctttgcagaggagatggaggtggcgatggcaggcaaagggagggtctgtgagaagagcatgcctgctagatgcaggatcccagcccaacccagaggcttggcccagaacatgatgcggccacttcttcaccctgaagaaaggggaaggggcaggaaggcaatgttctgtgaacattcaccaaagacgcccaaagatctctatgtgatcacggtgactgcttaagataggcacttgattctacaagggaagatgagggaggaggatagagatatgggaagaacacatgaacagaaggcaccaccatgaagcaactaagggcaagagctgaccccctcattcagcccctccccaagccttgggtcctaacagtcgtgtagcctgtggcccattcccaaggtgctgggacagaaaaggctcaagtcagacccttgttctgtggctggcgtcatgtatgaatgagatcactgagaaatctctctccctgtccttcagatggtaaatatcacacagcagacattcttatcttttccacagggtattaagttgagcaggaagactgacatggcatcaacagaatgaagatcttagaaacgctacttagtacacatttagaaaatgaccacagaagaagtctgtgggtccagaacaaaatacactacattttaagaaaaccaaaaggcaatttatcagaatcacttttttagatggattgtgaggtaggagtgaaagcgaggattaagaaggaagactagtgcaatatgctgggtttctcaattttccccagcatgaacacatacttcaaagctgccctgaacaagtctgaaatttctttttaaaatctaacatagtatcttaaaaagccatgcgaatgttgtattctatcccatcatatattcccattcatttttagagaaaaatttccataaatctgaataaaatcattgtgctggccgactctgggcacactttctgtgggttagccctgctccttaagaaacagcaataaataaataaacaaataaacaaacaaacattaaaagaaacatcattgtacttcctattaggatctcccatgacactgtcacacccacacctgagtctagatgttcaaaagcagggaaagagcatggtcttcagaattaaatgaacctgaattaaaattttagtatcaggccaggcatggtggctggctcatgtgtgtaatcccagcactttgggtggccaaggtgggtgggtcccttgtgcccaggagttcaggaccagcctaggcaacatagcaagacctagtctctgcaaacaaacaaacaaacaaaaaacccaaccaaccaaccaaacaacaaaaacaacaaaaattaaaaattagccaggcatggtaaaatgcacctgcagtcccagctagttgggaggctgacacaagaggatcacttgagcccaggagttttgaggttgcagtgagctatgatcacaccactgcactccagcctgggcaacagagcaagaccctgtcgctaataaaattttaaaaataagtttcagtacccaggttttgtttgctctgtgattttgaggacacaattaaatctaattccttagtttcctcatctatgatatgaagttgataatgttattatgcaaggttgctataaaaataaaagatgatttatggaaagaactagacatagtacctattgcttaggggtcattaatattattaaactctatatactggcaataagtgagaatggaagctaatcctgctattatgagttcccgaagtaccacttacctctccttccacccatatcacagtcaggattttatatttattttttgtagttatttctttgaatggctgtcttgccctctagactggaagtacatgcgggtaagaactaaaactggttttggtcaccataatgcagaactcactggctcttactagatacatttttaataaataaatgactccaatattctaactcaactactgcttagccacagacagcaagcaagggctctgctgcaaagcttagctagtgaagtccccgtgacagaaagccagccctccaagcaaaattaacttaaacgtaggtttgattaaactgcctaacaggaacaaaattcattattcaatcaaaaataaaactaaaaacaaatacaaatgaaaaaacaaagagatttagtcaacttaaagttaccacttccatattcacacacaaataaatacaaaggccaacacaagaacttgtccaaaatccaaaatcataaaattctaaattttctctgtggaaagttcctgagaggccattgatccaatcttctagcttaatagaagaaatcaaggcctgaggaaagaaaagtgctcttttaaggggtcacactgagttaattactgaagaagactccaggccacaccggcagctctcccacagggtcctcctaaatataattcagggtccagaactagaaatttggcattgcctgaagaataataagaatttccatgctggtaagatgcagtaaatatggcctccacacacaataatgtatgagtaatgtcaggaaaaaaactggtcaaaaaaatttaacaggtgagaaagatccagtttcaaagtgctatagtgactttgctccgttgtctaaatttcttatctgccttctctctcttctccattatgtggtaacctaccgtgtatctggcaacgtcataaaacaacattccaccacaggctcctagggaactttactgtaatggcctgtggcaaagtttaggggctgcggcctaacaaagctgcctgcacacacatggagattcagccaaaaaactttttaaaaaaaaaaaaaaaaaaaaaaccactatgaccgaaacccacttacaaagcagcagtcactgtagattaagctgctctcctgacccaagatggtgctagctttctgcatattgaaatcaaactgtataacaaagctgaatgaagcacccccagaaaaaaaaagggactttggaccaagcaagcatgtctacaacacgtctaaaggtttctttgtcccctcagggaaatgttataaaaaaacatgacaattgccttattcctcctcgctgcagtggtatgaatatagaaggaagagaacacaaacaggcaataactaacacacacacatgcacctagtgtgtgtaagtgagaaagtggcaggaaatgtttaatgctgaacacacccaatattataaattatggaagtagagcttctttttttcaaaaaaaaaaaaaaaaagaactccaagatgtataaagaaaaacataaacactcaaagagagtaagaagaaagtggatcagtaaatagttattaaacatactggtggttaataattagtgtaattcctaaaacaatccctagcattgtcttagttgaacaggctattaaaaataaaaagatgttggccaggcacagtggctcatgcctataatcctactattttgggaggccaagacaggaagatagtttgaggccaggagttcgagaccaacccaggcaacaaagtgagacctgcatgcctattttttttaattaaaaatttaaaaatatatgttgttgttgagataatcatatctacatgagcttgagactgtacatttgacctgcgaattaataacaataatgtactaagcaactatgtgccaagcacttccaagttgttttcatctaatctttacaaaaactgtaagaaatatttatttccagattacccatgagaaaaatgaagctcagaggagggaaggaacctgtcgaatgtcaccgcttgcccaattgtcacttattaggtggaatctgaaccacactacctggctccaaatctagcctttcctcttaccacagatgatgcattcatttattcaacatattcataccaaagacccatttgccaggtactctactagaaatggagaccgtaagaatagacttggcccctgccccaaaagcttgatgtccaatagggaaaaaaatcaaataatcacaaataaatgtgtagctcaaagaagtttgatagaaataatctctaattttcccagttgaattaagtgttttaccttagactcaaagtatcatagagtatacaatatgagatcagttatctttcagaattgttttaaaagtacattcaagcatgagtctcattagaccaaaaagaaaaataaatcagactcatgctttatcacccacagttgcaggaatacaggcatgcccctatcagaaactgctcagaagagatgataactaattatctgtgcttatttaggagaagatttgtgaatgtacacaccatctaaaatattcctttagctattattttctaccttctctctcatcctgtcagacatttatgttacagtcttagaatacacggttttctggtggaagacaactcggttgagtaacaaacaaaaagtacctggcaaatgcgtctttggtatgaatatgttgaataaatgaatacacaaagtaaaatggaaaagaaaacaaattcagaaggaaaagaatcaggaaaaaagaacaactagagaatcacagacatctggtcttagatatattagagtcttctaattcataaattaacacagtagccacgagtcaaggaagaagtgaaaagaagattaagaatgaagtgtcagccgggcagggcggctcacacctataatcccagcactttgggaggctgaggcaggcagatcacccaaggtcaggagtttgagaccagcctggccaatatggtgaaaccccgtctctactaaaaaatacaaaaattagccaggcatggtggcagatgcttgcaatcctagctactcaggaggctgaggcaggcaaatcgcttgaacccaggaggcggaggttgcagtgagctgagatcacaccatcatactccagcctgggcaacaagagcgagactccgtctcaaaaaaaaaaaaagaatgaagtgtcaggccaggcacgctggcctgtaatcctggcactttgggaggccaaggcagcatggattgcttgaggccagaagtttaagaccaacctgggcaacaaggtgaaatcccttctctacagaaaatacaaaaaattagccaggtgtggtggcgcccacctgtagtcccagctatgtgggaggctgaggcaggagaatcaccttagcctagggaggtccccagggaggtcaaggctgcagtgagctgagatcacaccactgcactccatccagcctgggtgacagcgtgagaacctatctcaaaaagaaaaagaaaaaaaagtgacatgtcaattaaacacaatcaagttcattctagctttcaaccaaagacagactgcaaaacttatgttgacagaggaacgctttaaatgtgaggctccctcagattcgaattcgagattctattacaatgataagaacaactaataagatattaactttgtgaacttctctattttttgaaacatctacttgctacattcccaacatttcctgatattctcaagtgcaacagaagcagaaccataagccaaaatgaaacaaactagcatcttttccatgttcaagctacacagaccaaagacttcatcaaccaccagagtaacttcccatgtgctgttccctcacctcctccaccagacaagcacagaagccctgaagcaagcctttagcattccaaaaaatatttttcccagacaggataatatagaagaaatacataccacactcattagagttactttattggatttgaaacatagacaaattcgactcttaacaacagaatatccacagatcacagtcagcaaccacaagtcttcaccatcaaatagatggcggcatccaagctccataaatacagatttgtactaggcccacacaggccagccacaccagtggcaggaacctgatccagagctgattcggctgtgagcacagcttcctgttcacatttttatttgttaactgtaaagaaagtttcagaagaggtaaagatctagaacagaaaggcaatattctcctgactcaaacaatgagtttgttccttgagcatgaaatgtgagtcctgcccagatcccacaagtgcatgacagaaagtggtgcagtgtccagttcctctcgtctattgaagggatacttttattaaaagaagcaggaaggaagagcaatggtgcttttaaacagagtaaaataaggcgagttccagaagcaacattatatggtatggggtacctccccaaaactccccagtgcaatgcccaaataaatatggtcacaatgggaagaaagccctcacatgggtaaaaaaattgatcacaaaaataataaacgcacaccctaaattatccttctacaattcatctccttagttgcaatcccaaaattgaatctgtaagaatacagattatacttcagtaatattttcagtgactagaattcaccaacattagccttcctaaaaactttccactaaaatcaagggcctccctggaaagagttgaccatgcaacactccaaattcacactacaccactaagagcttacacaaggaatttctccttgtatcaatgcatagtaaatttcttctccttcctatgagggtttttcagttgcacattcttctatattgtatgctttcttccatcctcacaaatgcacaaaatttaggtggcattcaaattttttctaacctttatcagaagaaaaaggagtggaaacaaaaaggagcaaacagtataattcaaaaacttcatttaatatctacttgggtaagaattcaatttgtcctaaatcttattctgactggctccctaaataaaccacagtgaaagccatctgtctgaacctgctctgcaacaggacaccccaaaagcacaacttcccctgggtagaagaaactagtgtctggctatcaagcagtgggtacgaaatgaggccttgtcaatgactgccttctcagcaccaactactctttttactccatttaagagaatagaattccaagtcacatgacaacatacacatatgcaaaaaatgctatccgattctaaaacagatacaaaaataaacaaaatacctaaacttcaatttctaacacaaaagtcaatgcatactttttttaattgccaaagaattttccataagctctaaaaggaagatgagtctgcttccttttgaaggcaagagactaagtaaaaactgatgtgacataacctttcatttttaaaaaaatcaattttaaggtgttattgttgcaatcataattcacaactgttccctgaatatgtcagacttcagaaaaagatcacaaaaattataatttgctctggcaaacaggctctcaatcaaaacaaggttccacccaccttcaaagcaaccaatagaagcccacctaccatccttcctaaaacatccaaacagagctgctctgcggcccaggcattccatactagccacaaggcaagggggcggcctgcaggcttgctctgcaggtcttgaaggcaaacaagcttggcaacacacacccagcacgactgaggttaagattatactacgagccgaagaggtaaggggaagaggacagggacagagggacccgcaaagcttcacattctatatctgctgaatgcctctccggtagtccccattcttagttctgattttacgcttcacaataccacctacatggccagctagggctgaattaaaggctctcaggaacatgcactatgaatgatgaaatgattcataaacaccttcagaagtgagaaagagcagcaaaacccatcactgtttcggtgaggccaggggaagatagcctacctgcaggggctgaatggatcatccatgactaacacgggctctggtgagtctagctggattcctgaacctttactttctgctaaaactctgcccttttctacactaacaactcaaaatggaggcacatgcagtctcagagacctcatagagctttcactgagcttgtgctatgacctaagccttcacgcagaacgcagaaacttcccctcactctgacaggactgagcatgtgctgtgaccctccctcatccacacactgtctctccacgacgcaatcaatctcaaccctgctgtttccgtaaataaagcccagccaacagactctgcagcttctccctgcacaccaagctagtgtgcagggaagtggggccttagaaaggggatccaagacagccaacagcagggaactgagcaagcccagccatggagaggcttcagttaaatgccctgctctgtcaggaactcagcaagccaagccacggaggagcgtcagttaaatgctctctgctctgtcagcacaacagcaagttttgtctttttttttttttttttaaggtaaatggtgattttaaaaagcaagatcaccaagaaatagaatcaaaagacagatatgaatgactacacacaagatcaactaatagaaatactgcaacacatttaaaaacatagtagtagctacttaagagaagcaacttcacaaatttctttttgaaactctaaacattttgaaaaagaccaaacaatccgggtaaagttatggagtgcttggccttgtcacacaggtacagacacagtgtagatggtattgtgagcagggtagctaaagaaaactgtattttctgcaaacagcttaatcttccttagataagaaactaaaaataataaataaaacattccccaaataataaattaaaacatttcctaaagtaatactagcccaatcaagtctagcttgaagaatctaattctaacaattagaaagacaggaaggttcaagattcaacatcgtgccacaaacacatgaacatccaaaaatctcatttgaggtcctgattcaaaatactaaggcagatccatataagaaatcctagctttggatgtgcaggcttagtttccacttacaaactaagaggtgattctatagattattaatcagttacaaaaagaaaaagaaatggaagaccatgaacctcgccaaaattataaaggacaagatagggcaggaaagggcagtgccaattctgtttcccagaaatgtaatggaatgtcaggaaattaaagcctgttgaaaagaacacacagtgtcctcaagattcctacagtgaatgcagaatcaattccatttccatagcactcccgtttatgctatgaaataaactaaattctgaaactatgattcaataaactcttatcctgccgataatgtaatttagaaaatacaagaaatgccaagtacacttaaatacgttttcctttgacctaacacatgaaacaagtatctacaggctggaagaacattttcccttattggtatgtgagacaacatattcccaaaactgctgttactaccaacagtctagagaaaaatactttctaaacacaaaagcaatggaattagaacctagcagccaaataatatgaatatgagcagcaaagaatttcctcccaaaagtgtatatattaaaaaaaaacaaactatctaaccctttcatatggaaaatgtttacttgaagaaatcaacacaaaataatatgtaataaattcatcagtctctgaaagcccatgaaactgttacatagagcacactataaaaacggttactgtaacagcaagttaagaaatgtggattctaattttggtctcattagatgccctgagttaccaaaatccaatggccttcccctgtgataatggattccaatggtggcgccagcctttgtggatatcctcttcattgtctttcctggtgctggcatctcacagttggcttcacatgccatgccaccaagacagacagccctttctcttgttacccctcaggggcagcgtaccccagcggccacaccccagatctcctctccttcacactctctcccgtggaaaagtcacccacactaccaccatgccagccagctccactctgaagacacttccttcctggcagcagctcagaaatgcaggagcccccggaatcctctcactgtacctctctggggaactgcacctctcttattagattctaagtccttcagggacaaggacactacctaaatcatctttattggaaccacccaactctcctattttgtacctcaaagaactctatctgaagcagtggaaagggcacagtatcactcatatagtatggctggccaaaattacataacctagatctaatcgtggggaaacgtcagacaaactcaaactgaagaacacttgacaaaactggcttctaactcttcaaaaaggtcgatgtcataaaaaatctttaaaaaaggtgaggaaacatgttgtgaaaacaaagagagacaagggatattaaagagacacaacaattaaatgaggcttatgatcatggggaaaattactatgaaggccgttgttgaaaaaactggcaaaatctgaatatgaactatattggactatatcatattgtattaatgttaccttttctgattttgataatcataccatagttatgtaagataattttcttgttcttgggaatacacactaaagtattcaggggaaagggtgtgatgtctatatttcattcccaaattgttcaggaaaggaaaatacaggttgagttatcctaatcccaaaatcccaaaccaaaaatgttccaaaatctgcaactttctgagcaccaacatgatgctcaaaggaaatactggaacgttttagatttttggattaaggatatagaataagcaaatattccaaaattccccctcccccaccaaaacatgaaatccaaaacactcttctaaccccaagcgtttcaggtaagggacagattcaacctgtaccacagagagagtcagacagcaaagatggtaaacacagacagcaatacagcaaaaaaagagatagaggttatctcataaagtgtatatttctaataattttgtgcatgaaacaaggttttgattgggttttgattgtgatctgtcacaggaggtcaggagtggaattttccacttgtggcatcacttcggtgctcaaagcattctggattttgaagcattttagatttcgaattttcagattagagatgctcaacctataatagagcaaacctataataaagtttaaaaggtaataaaataaaataaatataaagcaaatatggcaaaatactaacaactggtgaattgagtaaaagatatatggaggttctttcttgtactagtctcataactcctctttgaattatgaatataaaattccaaacagaaaaattttaaatatattaaacaaacagaaaatatatccaccagcctccacaaccatcagttctcccttcttttttttttttttttttttgagatggagtctcgctctgttgcacaggctggagtgcagtggtgcaatctcagctcactgcaagctccgggtcctaggttcacgccattctcctgcctcagtctcccgagtagctgggactacaggtgcccgccactacacccaactaaattttttaattttttttttttttttagcagagacagggtttcaccgtgttagccaggatggtctcaatctccagacctcgtgatcctcccgcctcggcctcccaaactgctgggattacaggcgtgagccaccacgcccggccacaaccatcagctctcatggcatctggagagctgacacaaggggcaatgaatgacctgcctccctgcctgcagtcatggtgctctcacccccaaacagaagtcaattaacacccagctccaaactcactccaatctcaagaatataggatcagtcctcctcctcctcctcctggtcagagaatctcaaggagtcttgaaaccgagcagttccataattaggttagccactaggtcacattcaaccacaaattccaattttagaaatggggctctgattccatggagcaagccttgctttacactgagttcaccctggtaccctactcagtgcttaagggcatcccagagaggggccttgttttctctcctagttctcttgaacacgggctgcctgtgtactgatgctgactacccacctggacctcactcctgccaccacattttctagcccatcgtttgccagcctgcagggatgtacatacaatctgcaacctggcaccctcgtatttccatctgttgccaactgccaaggccttcccagaagtcctgtgatccccatgtacatctataatctctggatcccagacatccttctctcctcctattaatcccaagtgaacaacaggtgtaggattagcacttctgaatagactaaatgagagctgagtgggagagaagaatacacaattcaaatcaattttttctaaaattaaaaaaaccactttgtccactataatacttaaatttgtagtgagtagattatgtacctctatcaaaggtaagtaaaagctgtaacatgaaaattgcctaagttttatcttaaagaatttcctacttcccagaaacaaaaaatgtctacaacgttgtattcattaacaagaaactttaaagccaaaatggggaggcggggcggggaggggaagcaacactcaggaaattctagagaaaaagtttggaagagatattctaattagtactaacttcacatcaagagaggagaagtattcagaagcagtttatttaaatttcatttactaattgccccgcatatctagacatggaactgagttttcgttttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcccgatctcctgacctcatgatccacccgcctcggcctcccaaagtgctgggattacaggcgtgagccaccgcgcccggcctgaactgaactgagttttctatctatctatctatctatctatctatctatctatctatctatctatctatctatctatctaactttctatctatctgtccatctttctatctatctgtccatccatccatccatccatccatccaggaagcttgctgatttacctattagctttaacaatttggatgggcccgggggctcacaaatataatgagaggccgaagtggtgggtgacttgaggtcaggagtttgagaccagcctggccaatggggtgaaacccagcttctactaaaaatacaaaaataagtcaggcgtgatggcatgcacctgtagtcccagctactcagtagtctgaagtgggaggatcacttgagcctgggaggcagaagctgtagtgaggccagactgcaccactgcactccagcctgggcaacagagcgagactccacctcaacaaaaaaaaaaaacacaacacaaaacaaaaccaacaccaacaataaaactaattttttcacaagttttctcagatttcctatggtgaaaattatactttattaataaatgttcattttttcatttccaaccctcacatattttcttcttcaagtcttaatggatattgaaatcctgctattgtttctggtttcagaggaaaaagtttccacactctgcctttaactatggtgcttgctgtaagtttatggtaagtattctgttagattaaggaaattcattctacaattaattttccttttctaagagtcccctccccaattattacagagcgttgaattttatcaagtgctttttctacattaagatgattgcatgggtacaaaaaaagaatgaatgaataaggtctagtatttgactgtgaaacagggtgaccatagtcaataataatccaattgtacattttaaaataactaaaatagtataattggattgtttttaacacaaaggataaatgcttgagggggtggacaacccattttaccatgatgtgtctataatgcattgtatgcctgtatcaaaacatctcatgtaccacatacatacgctatgtatccacaaaaattaaaaattaagaaaaagatgattgtctatgttttcttcttctatatgtcgaagaggcaacatatgctaacagataaattattaaggcattcttatattctataaatttggacatgcatatttaccttgctagactccgtttgttaacatttcatttaaacattttacattcatgttcataagattgaacctataaattttatttttttaacctggttttataataaaggttttattagcttcataaaatgactcaggggacccataacaactttctctgttctctggaacactggtagaattcacctgtaaagcatgagtctgattcatttttctttttctcttttatttggggggggtccggggaggggggagacagagtttcacttgttacccaggctggagtgcaatggcacaatcttggatcactgcaacctccacctcctgggttcaatagattctcctgcctcagcctcccaagtagctgggattacaggtgtgcaccaccatgcctagctaatattattatttttaatttttttttgagacagaattttgctcttgttgcccaggctggagtacaatggcacaatctcggctcactgcaacctctgcctcctgggttcaagcaattctcctgcctcagcctcccgagtagctggggttacaggtgcacgccaccccacctagctaaatttttgtattattagtagagacggggtttcccatgttggccagactggtcttgaactcctgacctcgggtgatccacctgccttggcctcccaaagtggtgggattacaggcataagccactgcccctggccctttttttttgtatttttagtagagacagggtttcaccatattgatcaagctggtctcaaactcctgacctcaagtgatccaccgcctcagcctcccaatgtgctgggattacaggcatgaaccaccaaacccagcctgatttatttttcttttcggtctaatgagattaaaaaaattatccaatgcaaattataaaaactgcctttaaagggagaaggtatgcagtttttacctatttcctctttcttccaggcggaaatctggatgtaatggccatcactacattgccaaccttgaaacaagagaacagtggcagacaaggtagtaaagggtggacccctgatgactgtgaggtcctagtctaggagtgcttcctttcaaactctgcttacatgagagagaaatgaaagtgatattttatttaagccttttacacagtctctttctgaagcttccagtatttgaagttctcgggtgtgtcttgctgtttgtctcatctgaccacagttaatggtacatggtttcttccgatatttctgacggtgagcttggcattcaaggatattttatctgtggggatcctacaggatcttggatgagggtgtctcccattaaaaaacattttacatatgcttctgccaggtatcttgaagggtttactggcatgagaccactttttatattgccttcttatcctagagttctcatattctgaagggcccagaatcccaaccctaaacaggtgggtttccctgttactcccctctaggttggaaaatgttaacaaactcaatccagcctcaccatgagctactgaaagatcagcttactgctttagttttcagtttctcttaattctttggagctcagctccgcagttaaaagttttgttatgtgttattccattactccaggtaacattcctagatgttatctgacaaagggtttttgaaatgatcaaagggtttttgaaatgatcaaatcaaatgatcaaatgaaaaacaggcttttgtcctgttttattaaagttatcttaacttcagtaggctttgttttccaaaaatacatgtactctcaaccatctccaatattttccatctcaggtaaatgtttctgagaattcaaatgtgatggcagataaaagcaaacaggaaaaaatttgtatccagctctagctgctcatcttcaaaagctacacaaagaccacgagctgtggtgagtggaaaagggaactgttactcaaatgcaagtaaattttagaatgtctcaaattcaaattagttgaaatacaggtgttttagattgttaacttttccacttaagtataaagatttatgttgaggaaaaaaatggtcccaaggtcacagagcaaagtgacagaaaattaagaaataaagacattaaaaataatgaaataaggtttcttaatgttaaagaagaatgttacacataaggaaaagggaataaactagcagaaattctgtagtactggattgaacttggagaatttcacatgaacttatgaatatacacacataaatacaaaactataggtgcaagtgtgtgcattatatatgcgatagatacaaacacacgcactccctagctctgtttctcagaaggtcagagagcagcaacacaaagtaatgagcacacttagcaccaaatctaggctttaaaatatcattctccaaacactgggacaatctgacctcaaaatgaataacaacagcagcaggttataaacaattaaataaaataggaggccattattccgctaaataaatgaataaatcgaaagtttgatgaagatgagatctacacagtcacaaagcaacctcccacaaaatggttattaattaaaaagggaaaaagagacaccgtacaatggcaaaacctggcagacatcacgtccagcaactggtcaaagtgaacattaccagcaactggacaaataagaattgtatactgacaggatacagaagaaaagaacacaaaatttctgtgatacacgatctaactctaataataaggaaacaccataaatgcaaactgagggacagctgggcacagtggcatacaccagtagtcccagctactagggaggctgaggcaggaggatcacttgagcccgggaggatcactgaggggggagggaggatcacttaatctaggctgcagtgcacttaaaccgtacctacgaatagccacctcactctagcctgggcaacataataatactccattgctatttaaaaaaataataacaataacgcaaactgagggacaggatacaaaataattggcctattctcttccaaggtcatgaagccaagaagcaactgaaaaactgttccagatttagggagactaaacaaatatgacaactaaatccataatgccaaacaagatccttctgttgtaggtttttattaggaacaccggcaaaatttgaatagggcctgagaataccatggtaataatattttcattgttaatttcctgattttgagggctgtattgtggttatgtaagaaaatgctcatgttcataggaactacacaaaatactggagtatgaaagagcttcagggtgacaacatactttcaaatgattcagttaataaaggtcttctactctacttacaaggaactattctgttttaaaacaaaataaaatgcacacagtattctaactaccacactaactcttaactcttgctattattaacattattgcagttgtcagtctaggagagagaaagtatagtccctgtaaatgcctcaagtttatgactgctcctgaacataatgatagtaacatataagcctcaacactgctgcaaaactacacttctaggaagaggaagaggagaagggagaaaaggatgagaagaggtgggagaaaagcggacagcctgcaggagatttagccgggcatggtggcccctgcctgtaatcccagcactttgggaggctgaggagggcagatcacgaggtcaagagatggagaccatcctggccaacatggtgaaaccccctctctactaaaaatacaaaaattagctgggagtggtggcgggtgcctgtagtcccagctacttgggaggctgaggcaggagaattgcttgaacccgggaggtggaggttgcagtgagccgagatcacaccactgcactccagcctggcgatagagcgagactccatctcaaaaaaaaaaaaaaaaatcagatatttttcaatcttgtctctaaaagaaaatttgtaattacttctgcaattcccaagaagaaacaaaaaatctgacagtttacagaagttttctgcagggtagctttcatcatccccatcttactgatggagaaacagagtccagaaagtgcatgctttacccatggacacgaggattaagtagcagcacgggactagaacccaggccacccagatccaagaggtgagatcttaccagatggctggaaggatcaagccgtcagattaaatggctagaaggtgttagacaaatgaaaaaagcaactaaggacagtaaagagaggcatataaccacgtccctatggtcatctctttttgtaagctaagaccaatctattttatattttagtttaaccaccgacgctggtgttttagccaaatgcacctaaggcctcctaactggctttatttatgaagacctctgagctgaaatttattgactttattaagtttcttggcagactctggatcagacccttcaaacaaacagagaacacaatgacattacttgcagagtatgctcaccacagaagtaaatctggatgaatcttgttcacatgtacaaaactgaacactccctgagtgcagaaatgtcaaaaacaaactccaaaagcaaagcccaattacctcagggttcaaagtcaggtcaacattagatttaaggctctctcatttttcacaatctcttagtagtttgtattctacttgggcaaaaaattatgccccctaaatttttgcccaattaagttttgttcccgctgagtggagcggctcatacctgtactcccagcactttgggaagctgaggagggaggatcgctgaagcccaggatttagagaccagcctggggaacatagtgagacctcaactagacaaaaaatttaaaaaatgagccagggatgatggcgcacacctgcagtcccagctacttgggaggatgaggcaggaggatcacctgagccaggtaagttgaggctgtggtgagccctgatcacgccactacactccagctgaggcaatagagtgtgaccctgtctcaaaacaaacaaaaaaataagttttgttacttaaatttcatggctagcactaatacagagtcataatcccttatctaaaatccttaggatgagaggtttaccagaattcagaatttttattttagcactacagcaaatatatcacagcatgtaacaccccagcagtgttcatgtaataatccatattccatcatattagtatttttagagtaaaacttacacaaactcacacaaagtgaactgaattaagaatataaatagcctcctatcagttcaggttaggttcagccatcaaatacattttggcaccaaccttggcataaaatttgttagatcttcagaactttcatatttcagaatttaagataagagagtatggatctatattactatagatgctttatcagtattaataagtattctagattaaaaagaatgaaatataagtttatacctaataataacaaagtaattccatgccaattaccaagaaatccattcttcccaaatgttaaaggcaacaaattctagagtacagaacagtcagtcagtttcccactatcacacattattagttcaataagtggtaatccatcaggaacaaaaaaaatcagatccctgacaagatacaacattcagaaatataatgaccaggttagagaaaaaaataaaatgaagctgtacactgaaatttaaaaaggatctatgcaaataaatgtgaaaaaaattccaaaatttcagtgctgttcaatatgctaacaaagtatggaaaattacataaatcaacgtataactacttttggaaaatcagctctgagaaataaacagttccatcttaaggttcactttcaactgctcacttaaagttcctgcattatttaaggagacaacagtcatgaaagtctgcagtcatggaatcactattccttaaatttccagtggactttcctatatgcagtattgcccaggaccattacacaatcagaagaactttgacatttcctttctacattaacttacatacttacctaaataactcagggcactaagagtcagcatacagtacactatgtagccacgactacttactagtcctactcattaaaactgggggaaaactatataggaaaccagcttatcatacagcctcctccctcacaaacgtgaaacaaagacagaaacagaggtaaattctgcaagggtatgcaccctgggaattctaagaactgggctgtgcacagccagtttttctacactctgttaaattagatgcatttttggatcatttgagcagctgtgggaactatagccctaaccccaaacttcagagatataaggaaatgttcgggataacaccagcaagccaaggcagtaggctgcattagctccactgctgcaaatgtctacaacggcctttacacttcaactgtgagaagtttgagatttgcctcaaagtttacttataaatgggcacttaagtatttgttcagttcaagtcatccaacactactcaagcacttaaaacacacaaagcagaaggtggacatagggaacacaagtgtagaagaaaatcagtggtgactagaaaggtcactaagggaagtgattcaggatgcagatcctgtaagtgtgctgctatcatcatgtctctgtgttccttattgcatccatattttaaaacaaacccgatgggatgtattgccctgaaagactgtcagcagcacacaatgaaaaataagaaaagaacttgagtgagtgcctggtttacaaaggtaagttacatattacttttaataagcattcagcaaaacatgtataactaacatttgtaaaaaataattttggttagttgttacaaacctgagagttgaagagttaaaagacaaaagctactttagttaattaatataacttgtgcaacaggaaaactatcaagtgattaaataagcacaatatcactaaaataacatccaattcctttgtatctagagagaaatccaagttcaagcattttacaatttacctgggcaacaggaagacatgagaaggtagccaataaatgcatatgtaaaataaacatttcaaaatatcagatgcttaagaaatattaccactgaccagcttctttatcattggaacacggcatacttttgaaaaaacaaacaaacaaactcaaccatcatagttttctttcttttccttttttttttctttttttctcgagatggagtcttgctctgttgcccaggctgaagtgcagtggggcaatctcggcttactgcaacctccgcctcccgggttaaagcaattctcctgcctcagcctccagagaagctgggattaaaggtgtgtgccaccatgcccagctaatttttgtatttttagtagaaatagggtttcaccacgttggccaggctggtcttaaactcctgacctcacgatccgcccgccttggcctccaaagtgctgggattacaggcgtgacccacctacacctggccaagcatcacagttttctaaaggagaaaaggtactctttgatgagcattatattactatccatacatcaagcactatctagaatctagcttctgatgctgtctagaaaatagcatccaatattgagaggaagagagggagacagacagacagatacactaatgcgagccccaagagagctgtgggcagcttcataaaaccacaacaaaaaacacgttcccttctacccctacgttgactactcaacaacattctaagttttacatacggtttctgaaagtcctctagaaaaatgttctcaataaaatgatacccattttgcctttacacttaatgtagttcttttgctaacttctttgagccaagtattatttattatttatttatttatttattttttattcttttaaaagacagggtgtccctctgtcgcccaggctggagagtgcagtggtgccaacgcagctcactacagccttgacttcccaggctcaagcaatcctcctgcctcagcttcctgagtacctgggaccacaggtgcagcccaccacgtccagttaatttttattttatattttgttgagagaagaggtctcaccattttgcctagctaggctggtctcaaactcctgggctcaagcgctcaagcaatcctcccactgtggcctcctaaggttctaggattacaggcatgagccactgcacctggccggggatgttttatttccttctaaatcttcacatgtataaacatgtcttgggtgtccagagcatatattacttgatcagtggctaacatcctgtttttaaaatccttaataaaatatgcagtcacatgatcaatacagggcaagtatgaatatatacactcataaaaattcttccacgtgctacattaaagtagcatctatgacagacataaaaattgttaaattactctgaccctattgcttctcattttaaaaaaatagtaattcaaactgttacatagatcttaccaagatgttttgagaacttgatgtgtctgactcatactagtagtcttactaaagatatttcagtgtgtgttcctggagttttattaccaagagtgaacaaaacaaatgagtaaccaacaaactttccaaaattacttagtctttttcaatatggtattatggaaggcttgacagaatgtgaatcagggaaataatctaccaattcttaatacttaattcaaaatacagataaactaaaagtatatctttatcccaccttctttcaacccaaattttctcatttttctttttctgaataaaagtaaagagcaaacaaaaagccactttagatgtcaaagacattaattacaactcctcccaaagaagtttactgaaggactctggagtcattttttttaagtatgttactagtgtatgtccagaagcataaactacacacacacacacatacacacacacacaaatgagaaaaggaaaagagttctcaatgaatggacacaagtgactcacttaccttgtctcagggttatatcctaatatgtagaaaaatgaatccactcgggctttaaactctctagcagcaaatatgtcagaaaaatgggagatgttacacttccctctgggaaaaagagaaaaaaataattagtaataccctcaactgcttttgctaaccaaaactggagggggaagggtggaggaagcactgaactaagtccatgtgcatggagaatcggctacaaacaccacactttatttcacctattcagctgtttcatgactgcttcactgtacacctgtgtaatctgactgcttttatatcaccattttactaataaagtaaaattaattaaaacaacaaagataaactggagacaggactatgagaaagaatattaaacaaagtagaaatggagaaaaattaaaaccattgtgaatataagaaaaactcagtttaaagcctttctaaatcataaaaaaaaatgagcctttcttcctactatattatgataggcagaaagtttaactgtttaaagctaaaatgtggaatatttgacatgtctttggaatacagcttctggccaataaacatttttcttctcctgcaatgtgcaacaaataaagttacttggaaattaaaacctagagaaattttaacttttttgcataaacatgggccccaatatacaaggagttttcaaattttggggtaactttaaatggctataaggttagaaatcactttcccatagaaatactaaaataaagtggagtaaagttttcaggttcatttaccacctaaagttaaaccaacctgtagttgaaaaccctacaatacttactccaaaacggcttaagcaatgtttccatgcaccaagtatcaacgtaaatgccagaagcattatatcacgtggtgaggcctaacttccaaatccaaacacacacacgcacacatacactcactccaggattcccaaagaggcaggggaggcttaagaactctaactccctcctggtcactttaatgccaagtggaagccaaaggctacagtgaggttagatggaaatggaggaccaaaagttcccatttcatatcaaaagccgtgcagcatacttccaggacgtggcctcccactgcttgagcaggctatctgttgtgataagaactccatgagtatgcacggtaacaacatacacaccagctaatggccacagtgttaggaagagaagctggctgaggggttatcagcgtgggttcattcattcacttcctaccaagaaattaaaaagcaaggttcttctttaccttaagggcttaagtacctgtaaccaaagcagggtcagccaggcacagtgacttcacacctgtaatcccagcactttgggaggctacgacaggaggattatttgaggccaggaattcaagaaaaacttgggcaacattagttgagaccccatctcaccacacctggttaattttaaaattttttgtagatgggagtctcactaggttgcccaggctggtctcaaactcctggcttcaagtgatcctcctgccctggcctcccaaagcactgggattataggtgtgaaccactgcacccagcccccatctccattttttaaattaaataacaatgctgttgatataaagtccctttggcaactatagattagaaagtatctatagttctatagaatagaagctacagaatagaaagtattccagggttactgagcacttcaaacaacactgataaaactgagaactgaatttaaaattttatttgatcttaacaaataaattatttgatcttatgtaaatctaaatagctacgtatggctactagctaccatagtgaacaacacagatttataagacatttccatcacagcagaaagttctattagaagtgctatagtattcatacctactatttgtagatagtaagatccaattcaaggaaaaatacagactaagcatcaacttcccaggcccagaactgcctcttctagtatttaactagaactaaaataagcttctgggaaagaaaatgcaggtatgatcttttttacaaatgaacaactagctcactttgaaaccactcatccatacaaggtgatttaatccccgaaagccagaagaaataggttcctttagcagtaaaatagagataacacctactgcacttataaagacaaagcctacaaaactctactacacaatgctatgtaaagtaagttattcctattattgtacattactaaaggaaattgattcttcttttattattgttcgttatttcactcttaaactggagtaattaatgtatcaattaaaggtaaagaaaacccttaactctaaacacaaccactagaaatcaggtatgtttagggcagggtttatcaatcttggcactaatgacagtttgtactaaataattatttattgtcagaggctgtcctgtacattgtaggatatttaagagcatccttggcctctacctagaagcacccatacacatttcttcctcacaacaaaaaatgtctcaagacttgccaaatgtctcctgtgagggaagaaactactggcttacagaaagccaaaagcaacaggaatagaagcatttcatctgataaatgattatgaagttgtcgtaaatgggatttttctctaccatcaagccctttctctatttgattctgtttgtatatgtgaaaggtactgacatttaaacatttcacttttttatcctttcttatgcttctaattgcactgtacctctaatacaatgtggaaagagtgaacatccttggctagttcctgatgtcagtggaaatgtctctcatgtgttcctattaaatatgacactagctttacagacaatcaaaccataatcatagtattggaaataattgactggtttcctcctttagagttaatagtttgatatatgctatcaatagagtgaaaacctgaaccaaccttgcattcctggaataaatcccagctggtcataatgtattttttaaacaaggtattaaatttttaaaaaacaaaaagaatttggttaactacatctaagttttcttcctcccaaatttgtttttatctttattatttccttctttgtacatttttattgttgctattattcatgaaaggtttattcataatagcctaggaacaacccaaatgtgcagcaacagggaaataaacaaatcgtatatatgtacaataaaatactacacaaagatctagtgatacataaaataccatggacaaatctcaaaaattaaatgttgagtataagaagccagacacaaaaacagtatacactgcatgattccacttatatgagctttagaagaggaaaaaataatttatagtgagagaaacctgaacagttggtgattttgggtgggaagtttttagagggaaggatcttgagggaacttcctgagatgaggggaatatgccaggtcttgtttagggtcaaacacatttctgaaaatgtacacttaaaatctacattgtactgtatattaaaaaactactagaggaaagtaaaacaatgagaatcattaccatatagctgtagccatatggtaatgattcataatcttgccagttagccagccctcaaacactgagtattgagcagagctgaagaaagggtttccataaccaggtaaggccaccaggattggctctgactgggtggcacccatttgaagtattttacaaatcaactcgtgatgaacagtgtttacctttaaaaatgtgtgtatatgtgtgcagaagtatgggtatgattttaagtattcagtgttttttatcagagcactcttctcaccatgatctctgtcaaaagtaggacattatttgacattgtttacagaatagatgaggagggaccgttaagagaaaattgccatcacatccaccttgctgaaataaccagttccagagcctcctaaagtcttgtatactctgtatctaaagcaatgcttcactgttaacagaaatatgactaaagacagggaagccccatgtgttagcatcctttcattcaacagtaaaaaaggcgtcccggaaatgactcatttcagtaatccttccgagtggggcgggccccagagagttttacacctggggcatcatccgaagggtcttctggctaccaagaggaggtggctatatgaaaaggatgaagaagagacaagagagcccctcttaagtaaggagacaatacaaatgaaaactgtggcctagaaattcactctcttaaaattaccaataactgggaaggtcttcccgtatccccaggcatgcgcaaactccaaagactcaggacaacgtgcacgagcacacacagaatgtttacagtagcaaatctgttgaaagctattattatcattattaagatggagtcttaagaataaaaaattattaataataaaaaataaattattaataaaaaattcttttttttttttttttgagacagagtctcactctgacacccagactggagtgcaatggcgtgatctcgactcactgcaacctccgcctcccgggttcaagcaattctcctgcttcagcctcccgagtagctgggattacagacgcgtgccaccacacccggctaactttttatatttttagtagagacgaggtttcactgtgttggccaggattgtcttgatctcctgacctcgtgatctgcctgcctcagcctcccaaagtgctgggattacaggtgcaagctaccatacccagtctttttttttttttttttttttttttgagatagggtctccctctgtcacttgggctgaagtgcagcggtttgatctcagctcactgaagactcaacttcccaggctcacgtgattcttccagctcagccttcccggtagctgggactacaggtgcgtgccaccacacccaacaattttttgtagagctggggtttcaccatactgcccaggctggtctcagactcctgggctcaagcaatctgcccagcttggcctctcaaaatgttgggactacaggtgtgggccaccatgcctggacaaaaataaataaataaaaataaaaataaataaaaatatatatatataattttagtttgtacttccccttttgcccaggagttgcttaacaggaagttttaaatttccaggtgaaagggtcttctgttctttgttttccttagtaaactacaattttattgcattttaatcggaatgattttttttctgtgatctaatatatgaccaatttttgagaaggtggcaagatacacaaatcaatgtgtattctttattattacaggatagagttcaaagtatgtctgtaggccaggtgtggtggcttacacctgtaattccagcactttgggaggtcgaggtgggcagatcacaagaggtcaggagttcaagaccagcctggccaacatagtgaaaccttgtctctactaaaaatacaaagattagctgtgcatggtggtgggcgtctgtaatgccagctactttggaggctgaggcaggagaatcgtttgaacctgggaagcagaggttgcagtgagccaagatggcgccactacaaggatgggcgacagagcaagacttcgtctcaaaacaaaacaaaaaaaaaaaacaaaaaaaattaagattattagcttagggggaaaaagtccaaaactgtacaaaatctgtaacaaggaagatttttaaacactcctgaaagacaaaaaaggggatatgaacaatggtaaaacatccatgttcttagataggaaaactcaaactggcatttctccacagattaattaataaatccaatacaatcccagtacaaataccaacaagctttttttttaaaaaaaaaaaaacaaaatattaagcttcacatggaaaaacaaataactaaaaaagaggggaacatatattaaaacatactataaagcctctgtaattcagagtgtagtgctgacacatagacaatagaacaacaaaacaaaaaagcaagtacaaaatacatatggaaagcaagacaatggtgacatctcaaaccactacaatcaacataggtattttaataagtaatcctagaacaactgggtagaattattttttaaatatggtgtagggaaaggctttctaactatgactcaaaatccagaggcaataaaagactgataaatttgattagataaaaatacattttacacaataaaaaatacaacaaataaaattaaatgaaaactgacaaaagtgggagaaaaatatttgcaacaattgccatgtaccacggttgtataaagcactttttaaaagtaaaacaaaaagaaaacccaatagaaaatacataaacagacaatttacaaaaaagagacaaaaatatccttcaaacatatgaaaaaatgttcaaactcattgttagtgaaataaaataaaaacatggagataacacttctcacctatcagacttgtaaaaatttaaaaagacaaaacattctattaggaaaacaggctgcttcatacttatcagaaggaacacaaattggtacatgccagctgaagggaaatttggtaatatgtaacaaaccgcataggcataaacctttcaacccagcaatcccactattataaatgcaccctgacgttcccaatgataagaaaatatatatgcacaaagatattcattgcagcatcatttataattgcaaaatcctaggaacaacgtaaatgctcatgcacaagagagcagttatatcaactacagtatatcaacataaggaagtaaaagagaatgagaaagtcctctatgaactgataagagcaattcccacaatatactgtcatcaagtgaaaagagcaaagtacaaaagaccatctacagtattctacccttcatataagaaagacggggttttaagaaaagaggcatgtatctgctgatttgtgaaaagaaaatgctggaaggatgatccagcaagtaaaatgatcagtaacctagagcagcaaggtgggagcgaagagggaaagaagtagaggatgggaacatggtggcagggttgaagagtatcttcttataaccctgactcttagaaccacagcaatagtccacatgctctcacacacccataaaataaacagtccaggtcaacaaggagaaaccaaaaataggatgtaaacagcaacaaatgaacctaaatgtattacaaataaacaaatgcacataaggaggtaagaaagaacagaactgacctaagtaagaggaaaagcagtatttggcactataagaccgaaaacaaaaagagtcaataaacgggtttctcaccaagacgtgggttacaaattctgaaactaagttgtatgcatttgagaattaaacaaaaacaagtaagtatattttagacaatgagaactgagtttcttctgtgttggagaaagcagttataaataacggaaagtgaagaataaaatcttcaggccaggcccagtggctcacgcctgtaatcccagcacctcgggaggctgaggcgggtggatccggaggtcaggagctcaagaccaacctggccaagatggtgaaaccccatctctactaaaaatacaaaaaaattggccaggtgtgggggtgggtgcctgtaatctcagccactcgggaggctgaagcagagaattgcatgaacccaggaggcagaggttgcagtgagctgagatcacgccactgcactccagcctgggcaacagagcaagactctgtctcaaaaaaaataaaataaaatcttctagtgttggactggaattgaaattaatataaccttacaagtctggagttaggggaagttaataggcacaggctggtatacatacacatcctagctctgcctgctaactggatctagaaacaatgatatccagtagtaacacacatgcctaatacccagatcttggtttctaaacactgctctccactaaagggaaccccggttcctcacagaatggctaattccagcgctggaagttagaaaataaaaaacgagcctgagaacatcttgtggagctagaaataagaaagtgctcaaaaaaatacagaagtttgctgataaagtgcaggggccaatctgaagtagctcctaatggccaaagctgggcaataaaacaaaaaataataaattataacaaaacaaaataaatatccgtaagttcatgctgatgtaaatactcaaatagatttatgggataaaagggagatttctttactacagtggaattccaattaataagtgtagaagaaaagaaaaaaaaatgaaaaaccaccataggcaagcttcacaaaagtaacttttacaggtgaaatccactgataggtgcttaaaatcactgggtgaaaatttaaggagataaatgatttgcagagtgtcaaagtatctcccaggttaattaagcacaggggaaaatctgctttacagtgaagaaacctggcagaagccacattcatcaagtggacaaggtcaatgtcaccagtaattagacattatcaacctcatgaagcccatgataagatgcactcagaaacatgtaatttctgtggttcttgcccaaaatgcctaacttcagaaaagccaaattgagggacatttgacaaaacaattgatcaataatatttacaataccaaggaaggtcatgaatggtaaggaaagactggagaaccattacacactgcaggagactaaggagaaataattaaatgcaatgtgggatcccatataagatcctagaacaacaacgaggacattgctgaaaatcaaagagaatctttagtctaatgctattgtatcaatgttaattccctggttctgataactgtactatagttgtagaagaagttcacattgtgggaggttaggggagggatatattgaacctgagtacttgtaactttgctgtgtgtctaaaaatagctccaaataaaagaaagtttttcaaatactatgaagtactcaagggcagacggaatatcttactgggtaggttcccatcaccaaatatagagcccttcatctactagtagattaataaaaagtgttaaatgatgaatgaataaataaagcaattgacaggttatgatgtctaatgaagtactaagcatgtatagacaaaacaataaaaatgctgtaggtcaaagttatttcacatataaaaacaactgtagattaaagccagataaggattcttaaactgcaaaactaagagctctgagacaccatgaaactccttacagaacttgcaggagctaaagggtgttttttgttgttgttgttgttgttgttttttgttttttttgagacagagtctcgctctgtcacccaggctggagtgcagtggcacgatcttggctcactgcaacctctgcctcccaggttaaagcgattctcctgcctcagtctccctagtacctgggactacaggcaccagccaccacactcggctaattttttgtatttttagtagagacggggttttgccatgttggccaggctggtcttgaactcctgacctcaggtgatctgcccaccttggcctcccaaagtgctgggattacaggcgtgagccaccgtgcccggccactaaaggatttttaaatgttttaaggaatggttgggaaactgtccacagatgtgactaatctgtttcaagccctaaacatatacatgaacctagttgctcataacaaagtagggagataaattaatttataatgaaaagaaacagactggaagcctcaaacagctaatttagggctccttggccctggtcttccagaaaattcatcctaaagcatcttcctataataggagcccctgggtaaaatgacagcctataacctgacctgcagtaggatatttctttccccaagtgactcctccaaataggaagcaggtaatcagaaagctggaaaacagtcctcagtcagcaagacacttacgatctcctgtgctgccctccacaatcaatactggagaatgcactgatgcgagtacacaataaacccaagaatgttccccaggtcacatgtcctcagtccaatcacaaagcaatcactccagatccttggatccttaataaaacattatccttaggggagaaaaagtagcacagaaaacaaattacaagttacaagtttatctgctcgttcttggagtgtgttgagatagctccctaagctgaactcttctccatatacctgaaggaatctaaatatctaatccctcctccgccaacaggccacagagaaatagtaaaataagtgtatgctgagtgattacaccatcattaactcagtacaaaattacacttaatttcactttttcttttcttccacttatacttttaagaactcagcagaaattcaatgagctatggagtgtactacacatgttactagggcctgagatgctctttgagggactttcacactccttaccatactggatgtggaaccagatgtgtgtgtttggttcaggattctgtcattagtcatgtgaccttgaacaagtttgtcaaaggttagctcaaacgttaaaaaacgtgacactggccacaaggctacagcagagccaggactcaaacacaagtcctctaacttcagtctattataccacaatgccagccaaaaattcttacccgggaataaacagaactcaaaaaatattcaaaatgctaactttactctatggtggttatggataaagtgtgatgaaataagatcagcagctgtagaaacttaccttgaaaggtagagataagggatagctaaggtcaagaattcaaaactaacagcaatgcagtaatgctgaacttcaacacacatttctacaactgcgaagggctcagattttcttataggaagaaactctggtaggaaaaagctataatctcacaatttacaaagaaactacagggcattttgttttccttttgattcaccatggctaaaggataaagctctctctcctcctttataacccaactctagcaccagcttgaaagcaaaccttatacatcagtttcctcctgagtgaatggaatggcaagagccccctcagagttactgtgaccggatgaaaccacacaaccgagccctttgatcttcaagaagaatggtgctaagcactaacatgatcagtctttttcttttttcttttttgttccccatggtttttttcattacatttgtttgatcccttttcatgtgcccacagactattttatttgtatctctctcaaaattgaatttatttttagtagtactggtttataactatggagaaagaataaattatttctgtgaataaactatgagaagaaaattggaaaaaaaaggtaaagcttaactttaaccatcccccaccaaatacaccccaaacattttttaagctaatctaccttcgtgaagagaaagagaacaaacagagactgctggggggcactgccatcccattctgttttatgggagtaatgggacaggcaaagcttctttcacagtgagcgctgctgccaagagcgaggccggatcactaagtgacagcaacgcgaccctgcaccattagggaagtgcgtccacacacacgtgtgaccctgcaccactgggccagcacgtccacacacacacaaaactgcaccactaggccagtgcgttcacacacacgtgacaccacaccactaggccagcaagtccacaaacactcatgacaccacaccagtaggccagctcgtccacacacatgtgtgcaacactgcaccactaggccagcatgtccacacacacgtgacacaccagtaggccagtgtgtccacatatacgcgtgcaacacagcaccactaggccagtacatccacaaacaatcgtgacaccacacaagtaggccagtgcatccacacatgcgtgtgcgacacaccactaggccagtgcgtccacacacacgtgcaaaattgcaccattaggccagcatgtccacatgcatatgagacactgcaccattaagccagtgcgtccacacacacgtgacactacactactaggccggcacgtccacacactcatgcaaaattgcaccactaggccagcacatccacacacacacgtaaaattgcaccattaggccagcgcgtccacatgcacgagacactgcaccacaaagccagcgtgtccacacacacgtgacactgcaccactggatcagcacatccacacactcacgcgacactgcaccattaggccagcttgttcagtgaccaaacaaccacctgtcatctgatgtctttgaaaaaaatccaagtcacaaaaggatgttgtatttgacacttacaaaatcaaattcaaggtaaaagttttataaagcagctaccactttttatgaccactttaaagaaaacaccacaggagaaaaaaaaactaattaatgaggattataattatatacccagtgaaaagaagataaagtattaccactgtagcactccagctgtggtggccagtgaaaggacagtgacttacacatttacacatctccaagaaacatctgattgtaaacttagctacagtaaattcatggaaatcagatggaattatttaggataacttgttcttctaaaaatgctaaagataaaaatgggccagacgtggtggctcatgcctgtaatcccagcactttgggaggctgaggtgggtgatcacttgaggtcaggagttcaagaccagcctggccaagatggtgaaaccctgtctctactaaaaatacaaaaattagctgggcatcgtggcacatgcctgtagtcccagctactcgggagactgaggtaggagaatgaatcacttgaacccaggaggcggaggttgcagtaaagtgagccaagatcaagccactgagctccagcctgggtgacagagcaacaccccgtctcagaaaaaaagattctacaaatctcaataccaatgataagtactcaaatatgttgattttaagcatttatgtcaaaacatgttgaatacagttacatatctcacatatttgttcaactgaaactctaaatcgattaaaatcttttccctcaacccgtgagacaagacggaaacaggaaggaaagagtatgcaaaccagtgtaagaagtattccaggatttggctgagtgcggtggttcacacttgcaatcccagcactttgggaggtcaaagtgggtggattgcttaagtttaggagttcaagaccagcctgggcaagatggtaaaagctcatctctatgaaaaatacaaaaattagccaggtgtggtggtgcacacctgtagtcccagctacttggggaggtaggattgcctgagcccaggagtttgaggctgcagtgagccataatctcaccactgcactccaggctggacaacagagcgagatcctgtctcaaaaaaaaaaaaaaaaaaaagacaagaaatattccaggattaagtcatcggtcccagctaacaatattccaggattaagtcaccggtcccaggtaacaatattccaggattaagtcaccggtcccagctaacaatattccaggattaagtcaccagtcccagctaacaatattccaggattaagtcactggtcccagctaacaatattccaggattaagtcactggtcccaggtaacaatttaactgttccatcaatataatcaaccctgcattaacttcctttgttcagcaagtgagcttaagcttggaaagccaatcttaaaagtcacacaaagcttgtggaagttcacaagaagtttataaaacactgagaaactctctaaattcatctaaattcctgtaagaagtcaaacctaactacatccatgccataccccacagcagagttggcaaactatggccagaaaagccatatctggcacaccgcctgcttcctgtggcctgagagaagagttttcccatttttaaatggctgaaaaagaaagcaaaagaagaatatttcctgacacatgaaaattaaatgaaactcaaatttcaatatccatcaagttttactgcagcccagccacttcatttatttccatgttgtctattgcttttatgccacaatggctgagctgagtcactgcaacagataccatgtgaaacatcagctgacccgaaaagcttgccaaagcctgccctaaagttgctactaatttaccttgaaataactgactttagctatgtagctttgcaaaaaagactccaggtggttttcctgaataccatctgagcatcagaatggagaaattattgtaactcattgtagttttaagataaaagctaccaaaatcctagtattttgttaaaaccatattacagtacttaacaaaaaaaaagtagtctttcaccactttatttccagtgaggaaagggttttaagaatatcagtagtcttacttcctataccacttaaaaggcacaaagtcagccatacacacacaaaatgagccattatgggcatccttttcttgaaagagacagaaaatacccaaagatgcaaatgtcatggtcatttttttgacataatttctgaagacattatgactggctggaatgttaccttctgcctcagaatgaaatcttcaatatctttctacccatctcctccccctgccaatgaagctgtatagtaggaaatttttcagacatacagaaaatggaagaatagttcaatgaaaatctctataaattttgcctgggttctcaagtaattacacgctgccatatctgcttcatccatttctctgtcttttctagtggcaggaattaaatctttagaaagtaaactgcagaccatcagaacactttttcccacctcagcttcccaaaatgccaggattacagatgtgagccaccacacctggcccatcggaacatttcacccacatacttcagcaaacaataccaggataataatttccaaggaaatgaagatacaataatatagaaacagcattaaaaagtaaattatcaaaaaaaaaaaagagagagagaagtaaagctagattagtgaagacacggagaacctctgcaatctcaacaatccagagcggacactggcatgttcactgaggccaaaagaggagtctgattaatacagtgactactaaaagatcaggagaaattactctccacctcctgcactcagtgactcctccttcacatggaagagcacgtctccagtacttacctaagggcagcagcatggtaagtgtcaacgtaatcagaaatgaagagctctcggttcttgataactgggtctgtaatgacaagttctcttccagagtctgtcaaaaaattaattaagacgacattaaaactgagtttcccaaaacaagtaaaaaaaatttgtaaaacttttctttcacgtttaccacccactaaataaccgggcctggttagcatcgttaagtatgcaaaatagagaagaggaatcataaattgcaagaataacaataacagaatgtacagtttttgtcaacaaagtatcttcttggctatgttttataccccttagtaagaccctatattttgccaaaatggattaagcacaaatggaaaaagaagaaaaacaactatcttatcctagcacctccttcaactaccaaaatacttagtgatcctgtcttatttttcttgctaaatattacaaaatggagtgaacttacacagtttccattgataagaatatttttaacaaggaactataatttacacgctttaacagaggtttttttatagtttcaaagaaggaaaaaaaaaaaacagaaagataaaaaaagaacatcattcttccaagctgtttttcattggtttgttgactgtgagaaaagtggagcaggatcagggccaggcaaagtttgatgccagcgccagcactgccacttagacaatgcatggccccagcaacgtccttagcatctctcaacctcagtttcctcatctggaactagagagggacagacccacctcacgtgactaactggtagccaatgtgaatcatcaagcataaggcctaccaacactccaaaatccatttttcaaaaagttatcttcatttaatgaaatgtctttagaaagaactttgcccaaagctaagaaacacacaaatcaaaccacaaggacatatttaccattttcattatgtcgatcctgaaccaaatgctgatacacagaatctggaacctcagattgacggtagtaccatttgacgttcatgaggagatggtccctcttactctgaaaaggaaaatctaacagcattaggaacaggatttcaggtggccacaagtgcatatcatacccatgaccaaaagcccctgtaaacgggtggacacgtagatagggagagacacaattaccatcaggaccacaacaatacataagtcagttatgaggtcaagttttgttttttaaaaacacccatcaatagatccctctcaccttacccctctaaactgcttatttcaggaaacaaaaggagaccagtcttgaatctgtttatctccccagtttaactaatccattcaaaattacatttttatttaacattaactatacaatactacattaatatatccttctattttaatctttaatcattttggtaaatatttagagtcagtgttagctgactgtcaaggctcattaagggcaataaggctagaaagaacttaccccacaaggcctggcacaaaataatctcttctccaaggtttgcctattacccagactaaatcagattctccttccactgtttagccacagttattgttaagtgccaaatgaatatagcgaagaatgggtggtgatgaaggtactatgagtccagagacctcatctcatttatttccgaatctccagataatagaacatcttgtataaaattatttgtgaataatgaagaattttatgattatcacataaatgatcctgtaaatgtttgtaggacactgcactatgttatccctaaaagttaattttgttcccagtttgttcagagaataaaggatcaaatattgcccttccattagcaagttatggggctgcagcttgcaaaagatcatctctgtggctggtcaagaaatagctcaacagggagtgcactgaggttccctgcggcctcctaaaatacttttccaacccatgtgcggccttaacaggcttctccaaggtgaatgcagtatcatgcctttcagcagcctctacgttctcatcacaggcccgttggtcagtaatgaatgagagctaaaattcaagaaatgcctcatgtttataaaggggatgcctaaatcctaaaatatgataaaagagccctcattaatgaaggaagatgcttcctgctttaacgagcaagtcacaaatatagccaacactaaaacaccaggaaggttccaaaaaacctttgctaaaaaacacttaaaagccatttaaagaatcagaaagatgacaattgccacaagtttcaacagaactcaaatgtgaagatgtgttatttcttttttttttccttttcttttttttttttttgagaaggagcctcactgtgtcgcccaggctggagtgcagtggcgtgatctcggctcactgcaacctccacctcctaggttcaaacgattctcctgcctcagcctcccaagtagctgggattataggtgtgtgccaccatgcccagctattttttgtatttttagtagagacatgttttgacaatgttggccagactggtcaggaactcctgacctcaggtgatccatccacccacctcggcctcccaatctgctgggatttcaagcatgagccaccacgccggccgaaaatgtgctgttttaaagtaaatacaaaaattagccgggtatggtggggcatgcctataatcccagctactcaggaggctgaggcaggagaattgcttgaacctgggaggcggaagttgaggtgagccaagatcgtgccattgcactccagcctgggcaacaagagcaaaactccagctcaaaaaaaaaaaaaaaaaaaaaaaacagaacaaaacaaaacaaaaaaccaaagtaaataacataaataccaagattctttttttgcatttaactgtgccaaatacacatgcctacaaaaatacggcatcatcactggtttaattacactttatacatagaataatcctacatgatgagtactctttaatatttatgcattttatgcctttatattaaaatttctgatggcaaaaaaaactttctacactgtttatgcttcagatgggaaaaagaggacataccagtatgttaaataaatagaataaatgttacatgtagcagtttagagaaataattactttcagcaggggattatggatgtgctaacatctgacttgagaaaaaatgggagagatttcaatgaattttttcattgaaataaagatagacaaactactgaacatatccagaccccacagtccatctgcatgcatcaacgaagccattctggggaaatatggagaagaacctgagtcctgactctgtctggcctttagtgagcttacaggacaactggagttttctaactctattgctgaccaaatacacaggcagcaagggacaaatcgccaggacatgggagagcagctagaaagtgtaggagatcaggatataccacctcaaaatatgctctctggcacaaggattatttagccaagaacttaagaggggtagaggaaaaattatattttgtctccaagaaaacttagtttcttccctcggcaggataataaaaagcaggaccaggataagattactcattatagaaaaaatatatataaaccaggggaagaagcagcacctgtttggcagtgcttggggatgcattcagttaaaatacgctgtctataataaggacttgctcaacctcagcactactgacatttgggccagaggattctttgttgtggggatctgcctgtgcactgttagatgcttatgacatccccggcttctaaccactaattgccagtagcacccatcgtccagttctgacaaccaaaactgtctctaaacattgctaaatctcccctgtggggacaaaattgtccctagttgagaaatcactggtctagtaattcattttgttttgttttttaaggaaaacaaaatcagaatggcaaaaataaaacctggttcgagcactacagggtagggaagatggcctactggaaagaagatgggaaggcctgtggccccctccaatctcaattccatgacttcccatgtatgtgacttggggcacattaccgagattctcccaatctccccttttctgtaaaaaggagatactgaaatctacctaaaataattactgaaagaatagaaaagacagaaagcatctagaactgagtaggtgctcaatgaatattgtttcctctattggtaggtgattgtaaccaatagttcacagaaaaatctgaagaactgtgccgagaagtgtgggagttacttcttcaccagaacttggtttcctacaagggatgatagtgatctctagtcactgagctactaatacatgcttcagtgctcacagaaatgtattacttcactgagcatacaggagtccagatctactagcactcctaacaacaatcttttaaaatctaccatctatgtatttctgcaacacatttaagacatctgaaaacctgaagggcaacagaaataccttttagatacagtaactcaaatttgtacaatgtctatctttcagaaccaagccagggatactggtgatcttctgaagtacaatatctatgttatcttatggtgtaggaatacctactgattacacacacaaataaattaactgctttggtttatttgtacctagatgtatgactcctaatattatactttacaatggcagtgaaggaactattggattccccaatgcagtactatgcaataaccagggagtggcagcattgtgctgaaaagacttcacaatcaattccacagataaaacacacaaaggtagactggaagtaaacaacaatttgaaacaaatttaagtagctgtaatatccacaatctttctaaataggccggtaacttaattaaaaatgaaaagtccataaagggaggcagtgtgtggtttcagcagtactagattacaattaggtaatctaggattacagttcagtctgcaactgctagttgcaacctgagtggagtcccccaaccctatgaaaagtgaaggggtggaacaaaattgtttctatgctctctttccattcttacatgtttatatctagatttcctcctcaaacaaaaccaagtagataaaatgatgctgtgggagaatctctaattttttctctgtatctgtgcaatggcactggctaacggtgccatcctaaaggtttacaaattaaaatgtcaccttcagtggaagctggccactgctataatactgagggaagaagagagcatcccctccctgagtaagtgttcccagagctacctcagacacaaaagtattgctagaaagttagacacaggtaattatgtaattcctactactcactagttgaagaattttgttcaaaatcacagaaaattaaagccagacgtgaatttagagatcatgcgattcaagcaaaactgtctaagtttgaatcctggctctgcaacttactaagctatgtgactttgggcaagtaacttctccaagcctcaatgctctcatatacaaaatgggagaaaaccaagtttctaccttatttggttgtgaggattaaataaattaatataaagcaagtggatgagctcaaaaaatgtcagatattactatcattgttttacagaaaaagagagcagcaaagatagagagaaaagaggtcccttaaagtttttgcttttctaagattcaaaattatgttagtaatagtgtcatacagcaaattaagaggaaaatgtcttcatttttccaacaattctagaagcttgtcaagaatttctcaacaaataagcctcattttttactaccaatataatttaacaatggcataaatgtcaaaatgtttataaataatatatttcaaacagaatgcagaataaagagggaagtgaagcttcctgtgtgaaagcaccctagggtgtacttctgaatagtaagaggagaccactgggaagtaaataacttctcaccagtttgtttgtttgtttgtttgtttgtttagagacaaggtctcactctgttacccaggctggagtgcaatggcaccatcatggctcactgcagcctcgacctcccaggctcaagtgatcctcccgcctcagcctcctgagtaagtaggaacacaggcacccagctaatttttaaaatttttttgtagaggtggacatcttgctatgttttaagccactaaacaggagcacatccaatctgcttaacaataaagtttcaggactctgggcaaaaaaaaggggagggggagttgtttctgggctaaattatagaccctggctggatttctcttgaaatgaagaacatatgtcgatttaaggagattaatagaggacaaaatccatcccccaaatctgggcttagaaaaaagatccttatggtagctatctgggagcagaatagcaaagatttctacacatctttgaataacagacaatagtctgttgagatttaacaaatttaaaataactgaaatgaaacactcagaactagataactgacaagcggtagactaggggaaaaggaaggcaatggaaacaggcaaggccaagaaaaagttgctgttgaagggcaactgtgttgtcatcagcaacacacaacacagtctgcccaaacacagacacagggtctaacgttgagatggaaacttcctttcctagagatctttcatgattattaatttagtgttttatcaatttaaatagcctgagtctttcctagaaacagtcttaatatcagcctcagggcaatgtttttccacaacataaaaatagtaataataatcgagggggtatctggatagttcataaataccaataggactagggcagagagagagagagagtccttcacacagaggtggcctgcaagccagacagaacaactgtaaattcacctacgatacagaggaaagagcttctttgtcccactgatcaccagctgatgatacctgccaccagctcacagcagggattatcaggtccccaaagcctccaaaacagaccactcctgtccctctgtgttatcaaatgtgacagagatatcaaggccaaagacagcctcaacagagtacaaagatggatattagcaaataaataactttgccaagtcaaaacaatctgctggagagaagaggagtaacctcctgcatatatttaactgcttagtcatgggggctcttgattcagaaccaagtgaaatcagatcaaaattcttactctataagccaatatagccaaccaagtttctccagaaatttgggatgaagtggctaacatgtgtatactgtatggcttaaaaagatactttctgaagaaacttttcatgcatttccacaacatggtgataataaggttaagagttgtctgaacattagaggtttactgtataattcagaaatgtatacataaaacttttaattggtagtcagacactaattaagcatacagaggggggaacaccgtctcccagagacatcactatctcccttcaagtgtgctcaccaaccagtttaaagaggcattaactctgccagttgagcccacctccacttacaggacaatgactgttagacgtgtcaccttagctaagaccttggggacacagtcataatggctttgatcattcctgacttcaagggagaagggtagggacagacaatggggtcaaagatcactattcttcaaagatcaaagctaactccagatacagactgagtaacctcttatccaaaatacctgggaccagaggtgtttctgatttcagaattttctagattttggaatctttgggtatacataatgagatatcttggggatgggacccaagtctaaacacaaaatttatttatgtttcatataaacctcatacacatagcctgagggtaattatataaaacattttaataatatatgcagcctgtcacaaaggtcagatgtggaattttctacttactgcatcatgtcagcactcaaaaagttatggattttcaaattagagatgcccaacctgtatttatttacacaggtaaatcaaaactaaagataagctttctgtaccagtcatagttacccaacttcatggataaatatctgaaattaaatttaattcaattaaaatgaaattagatccaggaatcccacttctgtgaatttaccaaaatatttaaaatcagtttgtcaaagagaagcctgcactcccaagtttatcacagtactattcacaataaacaagttagggaatcaacctcagtgcctatcaacaatgaatggagacagaaaatgtggtgtgtgtgtatgtatgtgtgtgtatatgtgtatgtgtgtgtgtgtgtgtgtgtgtgtgtgtgtgtgtgtgtatatatatatataaaactactattcagtctttaaaaagaagactcctgtcatctgcaacaacatgaattgaactggagaatattatgctaagttaaataagccaggaattgaaagacaaataccacatgtgcttattacatgtggactcaaacaacccaactcacagaagtgaagagaagtggttacagaggctgggcagtggggggaatggggagctaatgctcaaagggtacaaaatctcagtaaagaagaataactgggttttttaaatgatcgactgcacaacatgattaatatagttaataacagtgtattgtacatttcaaaattggtaagagagtaaatttcaaatgttgccatcataaaaaatgataattagcttgaattattctacattgtattaatgaatcatacatcattttgtactccatacatatatacaattataagttgtcagcttacaacaaaatgaaattttaaaaatgaaattagataggaaatatcttgtaatatttcaagcctctaccctatttaacataagactctaagaatgcccgggcaccgtggcgcatgcctggaatcccagcactttgggaggcagaggcaggtggatcacctgaggtcaggagttcatgaccagcctggccaacatggtgaaaccctgtctctactaaaaatacaaaaattagttgggtgtggtggtgggtgcctataatcccagctactcgggaggctgagtgaggcagtagaatggcttgaacccagaaggtggaggttgcagtgagcggagatcgtgccactgcactccagcctgggcaacaagagcgcaactctgtctcaaaaccaaacaaacaaaaaggatctaagaattttacatatctatatatattatccatataactttacagccattacagctcaaaacgccaggaaagaggtatagaaaaacctaaagcagagtataccaccaggcctcaggccatcaaggttcatgtatcccagggttctgctctgacatggggaccagtgggtaaggggaaaaactgaaatactgactccacagactcttctcaggagaaagaaaggactgaatatactttataattacaccatcctatacacatctcccaaatgcactgagtcattaaacattttgtttcattttgagagggcagagtgaggcctcgcaagtaaatttcttattgccattgataaagtatccactcttgtttgatcctggaacaccttctcccaaccttggtgtattttagtgtagcgctggaactgaacagacctaaaaatccacagggtcgtcttctgcatccactctcagtggggcctgaatccacctatggaaggaccacggctgtggcacagctcccctcaggtggccacacaactcccatttctaaaataccttaaaacaaggggcaggtagaggaaaaataaaacaaaataaaatacctgggctgggtgtggtggctcacacctgtaatcccagcactttgggaggccaaggcaggtggatcacaagttcaggagttcaagaccagcctggccaagatgatgaaaccccgtctctactaaaaatacaaaaattagccgggtgtggtggcgaccgcctgtaatcccagctacttgggaggctgaggcagagaattgcttgaacccaggaggcggaagttgcagtgaactgagatggcaccactgcactccagcctgggcaacagagcaagactctgtctccaaaacaaaaaacaaacaaaaaaaaacctgaaaacaaaaattaaatgggacacagaatcctgttggtggtaacatcacatttattagcatttccaaatgggtatacctggaactactggtacatccaatatatagcagacttctggagggatctgctcacaactggaatagtaattttttttttttttttgagacggagtctcactctgtcacccaggttggagtgcagtggtgcgatctcggctcactgcaacctccgcctccagggttccagcaattctcctgccttagcattctgagtagctgggactacagcatgtgccaccacacccagctaattttttgtatttttagtagaaatggggtttcatcgtgttagccaggatggtcttgatctccagacctcgtgatccgcctgactcggcctcccaaagtgctgggatttctggtgtgaggcaccgcacccggccagaactagcataatgaatttttaaagagaagttaagtagatgaaagaaatagaagaccatggccacatccatctgactaggctgcttactgcttgtaggcactaggatcaaggttagaggctcattttcaaaacctatgagtggtattcaattcaaaagactgttgtcaagagataacatcagcatctgggtctgtgtgaaaggatttaaatcaccttctatcagatgttgaagcatgaagggggaatggtaggaaggcagatgactattcacagtgtttacaatcaagatatacaaataactggctacatacaaacactcagaaagatgatgtaactatgaatgtactgaagcacaggctcagatgatgggcaataatttcaaaaccactgtttcttgatgatgccttgtttgttaaacttctgccgctgttaaattatttttacactttaatatggagaaaaatcaaccaatattttggtaggaactaaaacagtgcatgaaaactaaatcatctctgaaatgctagctaaggagtcaaaactcattaaggattttctacttaggattatattgtgtatgaacactgaaattttcagacaattcattcttgtatttgtttgtagcagagaggccaaaactaagcacaggtaaaaccttgggaatatttgtacttcttgccctcatctgtaaactacaaggctgggtaactagatgacctctgttgtccttaatatcacacacacacagagataaactgtacgtcaaggggacttagcagatagggacagacatagcaaactaaagagcacttctgtagctccccaaaagtatcccacaatgtacttcaacctgactgtggggttaatatcaggtgtctgaactggattaagggacatctagatagttggtaaagcattatttctgggtgtgtctgtacaggtgttcctagaggagactggtgtgtcagatggtagcctgtgtgggaagatctgccctcaatgtaggtgggacagcatctaatcggctggggtccagaacagaacaaaaaaaagcagggaaaaggagactttgctctctctccaagagctaagacacctttcttctcctacctttggacatcagaactctaggtcctccagcctttggactgaggactcacaccagcggccccccaggctctctggccttcagcctcagacagagttgtactataggttcctttggttctgaggcttttgaacttgaactgagccatactatcagcttccccgcatctccagcttgcagatggcctgcgatggtctaaatgtttgtcaccctcagaaactcattctgaaacttaatccccaatgtaacagtattaacaagtgaggcctttaagaggtgattagatcacaaggagcctgataactcattaattcattgatgcattcatgggttaacgacttatcacaagagtgagtctcttataaaaaccaggttggctctctcttgtgagccctactgtcctggatgccttctaccacattatggcacagcacaaagccctccccagaggccaaccagatgcagccccttgacctgggacttcacagcctccagaactataataaatttattttctttataaattacccagtctcaggtattcagaaaaaaagactaagacatggctatcatgggacttagcttctatgatggagtgagatttattattcccttaataaatcccctctcatctgtctgtctatccatctgtctatctttctatccagccagccagccagccaattggttctgtctctctggagaaccctgactaatacactgacaaatactaaatgtcagattcagctttaaaagttcagttttgaagggtcaatttggcaagacgaaatttcgcagataaattaaaatcctacccttggacctccaaaatctgctgaccaaacacaaaaatgaatcccattctaaacagtattctcccagcagctctggttttatcagatcaacattctgaagcacaaattttctctttggtccaaaggatttctcccataaaggaagaaaaaaatagctattcgtagagagtgtaataagaaattgtcaaattcccccttaatccctactaaagctttaaacagtccattaaatttctttaaaagcaaaaaaaaaaaaaaaagagtacaaatatcacaaaatttgacatttttgtaataatactttggttgttgtttggtgacggcggtgatggcagtgatattattcatttggagggaattaatgacttcttacacatgacatagccagaaaagttacagagctcaaccacacatcaatggtggggtcagactttgcggtaatgagcaggatgtcaaagaaagggtggggaatttctcacattatttaacatcacattattttataagtaagacttaccaacttatgattaaagatacatggcagagattttacaattaaaaaccgatgatgagctaccatgataatatttccttgaggttgggcacagtggctcacatctgtaattccagcactttggaaggcagaggcatgaagaccgcttgagcccagtagtttgagactaacttggacaacaaagtcagactctgcctttacaaaaaatttaaacattagacaggcatggtgtcatgctcttgtagtcccagttattctggagactgaggcggtaggatctcctgagcccaacagctaaaggctgcaataagctatgatggcactgccacactccagcctgggtgacagagctagaccctgtcttaaaaaaaaagaaaatattttattgactcaatacactttttacagaaggacctctcaaacatcttaagcttcaagattccttagattcttaaaaattattaaagagtcaaagaacatgggttatagcttatcagtacttactgtatttaaaaataaaaaaatttctggctgggtgcggtggctcatgcctgtaatcccagcactttgggagactgaggcgggcggatcacgaggtcaagagatcgagaccatcctggccaacatggtgaaaccccgtctctactaaaaatacaaaaattagctgggcatggtggctcgtgcctgtagtcccagctactcaggaggctgaggcaggagaattgcttgaaccggggaagtggaggtgaaagtgaaattgcgccactgcactccagcctggcgacagagtgagactccatctcaaaaaataataataataaaaataaaaaaataaatttttttgtaatttatgaattcattaataacagtaataaacccactacatgctcgtgttaacataaataattataacaaataactataatttttagaacgaacataatgtaggaaatgagtaacacttttatttctgcaaatctcttttacttctggcttaataagaaaacagattcccatatctacttctgcttctgtattcaatctgttgagctatatcacacatcatttagccttttgtggaatgcactgtacactcctgagagaatgacagtgaaaaaaagcaaatgacgtcttggtatcattatgaaaacagttcaaccctacagacccctggaccatagttaagaatggctggtctctgagatgaagtcgacaagctgcacagatggctccaggtgccctctcttttagacacaatcatttaaataaaaagtatgctcccgaaacagcacaatgactagagattttaaggcacaaattcatttagatgtcagatactattaaaaaagatttcattattatttatacaaccaaacactccagacattccagtagagagcagaagttacacaagaagaaaaatctaaataggaagctctcattgtcaaatttaaggtatctttccaaaaactgagctcaggatataaaagaaatatttaaagcttgattcaaacaagtatttgtctacattaaaaaggtatactactttaaaacaacggtgaacccttgaagctgaaagcatgcagaaaataataacctagataatttccgctattccaggcaactttctggccatttcaaaaatgatactgcttcctacctgagaaaactggcatcattaaacaaaacctttaagaaaaagaaagatattagcttacaatgttaactgaatcatatcttttataatgactaatatacctaatttatgtgaatctagcaatattccgccctctcctggtgatatgctttttgtaccactgctgtctgaattaaaccctgagtgtagagttggtaacacagtaaagtaatttttagcaacacaaatatttgcacttttaagaagcactagagacacagttttagaaattactgactcaaaagttggcctgcataataggaatccaagtacagccagcaacttaccaataaacaaattcaaatagttggataagaaaagggaaaatcagcaggaacactaaaaaattatattttcctggtttacgtaaatcagtctgtcttatcttaaatatcttaattatttcttctcttcctttaacttaaaccaaaacaaagacggtaacctttaatactagttagtctatttataaccgttccatctacaaacatttttctaatacaaacatgccctgatagcttatcttggtgcacatgccagacaacaaaggcccactggcctgctggagaggagaaatggaaagcaggaaatgagaagccttagttaatctccaaataatcgatcagtgtattcagtcaagtgtgagctgagctgggaaaatgctgctttaaaaaagaaagaaagaaaatcaaagagcatgtgactggagccacaattcattttaaaatagggtaatttttgtcaaaaagattctgcatcacgttcaagcaccaacaacaacatacggaaatgttcatatcttctgcagtaagaccccttcctttaaaatctcttgtcatcttttttcaaaaacaagttccaacttttgggctttgtttcttatttcagtttatcttaattattgaggtataatttacatacacacaataaaattaacttattttgtttctactagttttgacaaatgtatagagttgtgtaacctccaccaaaatcaagataggcaacattcccattaccacaaaaagaccaacttccattacagaatcaacatttgctgtgatgaaaaggctttgggtgccagtgttgccagaaaagcaacattctaatctaacttccttcctccattttagcacacagagaagttaatatggagaaaaacaattcagagtctgctgtgactcttctatctattgctagagaatactacagacaggaatcccatgatctttaaatcaagtaatcggctagataaaacttctgggctaagaggtaatatggtctcaggaaattcctagaacatacaacagttttagcgacaagtgatataaaaataaacaaaaataatttcaaattagatctgagatatactttcctcaaactatataaggaatatttattgggcatctgctaggcaccagacactgttctggagatggttgctgagtatatagaagtgggaaaaacaggaagtcccagtcctggtagaacttccattccaatggaggagaagaccccttaccaattcccccaaccctctcctctaaaatgtccaataacggttaagtgcttttagaaagttatgatgaatgaaatctgccacttagtaaccataaatcctaggcaagtaacatttatttacactgttatttaatctctttggatattattttccttaaaattagtggtcttctcaaaagtacttcaggatagcaggaaaaactgtattgtgacctgatatgtcatatacagagacaggtttaaataaccctaatgattccatacaccagtttctctacctacaggacctaggaggaaacctaaatgtcttgcttgcttgctatcctgagcgtgttcatgaaaactcccaaaggtggctctactttcttgctttatctttcttatttttctttttaaagttttattatgaaatatttgacaggcagaaaggtataaaaataacagaaccatctgtaccaaacatacctaaagcaacaaaaacattatcgaacctaaagaagctgcctgtggaacctgcctacagcccagaggtaaccaccaccttgaattcactgatcattcccatccagtacttcatgcttttacttaatatatatatataactaaaaatacataaggtattattttgcatgtttttatactgtacataaatgacactagactctttgagttcttctataatatgctttgttctttcagcattacacttacatgatccatccacgccctagttcacttattttaagtgacatgtattaccttcatatacagcacatcacaatgtgttcatacattttcctgatagtagacatttgggtcatttccagttttccaccattacaaccttggttgtaataagtattcctatatatgttttcacacataaaacttttctattcaaattatttcgattactctgaatgtttggtatcacagctaagtgttcaaattttggtattggtaaaatgttgttcacagtgtcttactaagtaatttaaatatatattaaaggctaaaaaagtttatgtctaagcatggttttagataaagccattaactgtgatgtgttgccttttatttctggagacagtctcactctcacccaggctgcagtgcagtggcccaatcacaggtcactgcagccttgacctcctgggctcaagctctcctcctacctcagcctcctgagtagctgggactccaagcaaatgccaccacgcccagctaatttttgtactttttatagagatggggtttcaccatgttgcccaggctggtcttaaactcctgggctcaagcaatcctccctcctcagcctcccaaagtgctgggattatagacatgagccaccgtgcccaaccaatgtgttgtatttccattaataattcactgcaaaatattttctaatttccactgtgatttcttatttgacccacagactatttagaagaatctgggttccttctacacatctgtgtatttcccaggtactccttttggtcttgattcctagcttagtagcactatggtcacagaacatgttctgtatgatttcaatgctctgaaatatgttaagactatgatctatatatagtcttttttttttttttttttttttgagacgcagtctcgctctgtcgcccagactggagtgcagtggcacgatctcggctcactgcaagctccgcctctcgggttcatgccattctcctgcctcagcctcccgagtagctgggactacaggcgcccgccaccacgcccggctaatatatttttgtatttttagtagagatagggtttcatcatgttagccaggacggtctcaatctcctgacctcatgatccacctgcaatattatatagaaatgaaaatactgcaacttacaaaaacatgaatttcacaaacatgctaagccaaaaaaatcagacacgaacaaatatatattgcatttcattcccttcatatacgaagtacgaagacagacataactaatctgtgatggcagagctcacagcagtagttacgcagttagtggctaggagagggcacgagggtaacctctggagtgcacacattttatttcttgataccagaagttagacagatgtgttcactatatgaaaattcactgagctttctatttagaatgttctttcatgaatatatattagacttcaattaagtctaatttatgaaattaaaaattaacatctttctaaaattaaaagtctaattcgcaaatgctaaaatttacatacacatatacacattaacacgtatgcacatgaagtatctctggaaagatacaagaagctggcaacaattgttgcctctgaggaggagaaccctaaaacaacttataccaaaaagtaagaaagtgctcaaagaatgtgaaagacacgcgaaactcagcctgaaaggacagacctgctggactagttctgctagaacaacttgagaatcaacacataatgttagtaatagagtagaaactacaaagaaaaccagaaatcgtgcatccttgctgatataggtaaatgaataaagtgaatagttgctaaataaccggacactttcagagtcacagggcacctttccataaaatattaactgataacaaaggatgaaaaaagtaacctttttttttttttttttaaagacactgttttgctgttgtccaggctggagtgcactggtgcaatcacagttcactgcagcctcaacatcccactctcagactcccaagtagctaggactacaggcctgtgccaccacacctggctaatttaatatatatatatatatatatatatatattttttttttttttggcagagacagtgtctcactatgttgcccaggctggtcgctaactgctggctcaagcaatcccccaacctcggcctccaaaagtgctgggattagacttgggccattgtgcccacctcaaagaaataactttataattaacttttgggccttgtaaacccaatcttaagtgatcaaagtgaatgccagtaacagaaggaaccaaaattgtgccctacttggcagggtacaaggaaaagatcccaaacctgaatctaataatgaagaaatacgatacaaatgaaaactgagaaacattctacaatgtaactgaactgcaatattcaaaagtgtcaaggtcatgaaaatcaggggaagactgaagaactgttctaaaatgaagaggattaaagaaacataactaagtatataacctataattctgattagatccattccctacacagggcattgaaacaaaagccaaaatgtgtacagggtctgaggattagacagtaataatgttattaatgttaatttttaggtttgattgttgacttgagggctacatcagaaaatgtccttgtaagaaacacacatccattatgtatcagtgtgtaaaggggtatttatttggcaacttattctccagtggttctagggaaaaaaaaaaaaagttctctgtgttgtacctgcaccttttctataggcatggggtgggttagataaaagactggagaaataaattttagtgccaattataaaaatatgtaaccataggcagtggtcactaaaagccattttgacaaacaatcagagttaaaactcagtaaataagaagaaagttacatgtaactgtaaggataaaagcatgttaatgccagccagttaaaaattagtttcaggaatttagtccataataaagattaaattacagaatagcagggaaagatgaactatttaatgagtttgtagagattcctagaaagtcatctaaaaaaaattaagttgtatctatacctcatactgtatgattcaaaatgatctgaaatgagtctaaatgggtcaaagattgaaatgtaaagaataaaaccataataaaaaaatgcaaattaaacttatatgaagaatatattgctcatactggcaaatatccaagttgataacactctgctggccaggttatgggaaaagggttgtcattatgttttacagaaacataagctggcacaattgtgttatagaaagagtaactgggcaacatctaccaaaattacaaacatattcatctgtttctccagcacttattgaaatttattctaaagatacatttgtgctgggcacggtggctcatgcctgtaatcccagcactgtgggaggccgaggcaggcagatcacaaggtcaggagatggagaccatcctggctaacacggtgaaaccccgtctctactaaaaatacaaaaaaattagctgggcgtggtggcggcgcctgtagtcccagctacttgggaggctgaggcaggagaatggcgtgaacccgggaggcggaggttgcagtgagccaagatggcgccactgcactccagcctgggcgacagagagagactcaaaaaaaaaaaaagatgaaagaaagaaatttcatatgacttttgaatttttttgtttttttaaattatataaatgtattacctattcaaaaactatttttaaaaactcacagggtgtttgtttatgtcataggcctttgctctctctctctcccctctctttctatcctagtatattgctgctctttcttttttatgtagctagccttccagtggatagatggtgtctgaccaacagaattggaacctgcatcagccatatactgttaagagaataaaacggaacagaaacaagcctgtataattacagttggtcatgccaacagtctggtgaccaatcttttacacttaaaacttaaagaagttacacgttttcaactgcctgtagaagaaaatcacatactccttggccccccatactcatcatgctgacacagatcacttgagcttaaaaatgctcacaatgtttctgaaagtgaataggcacagagccttcaaatatgagatctagagtatctcactgaatataagatattccactcaatgctaccttataaaacaagccctagaatcaaaatagcttatcactacatcttattcattgtgagatataccgctgaggctggacatgcactttaaaagggaaagaggagccgggtgcagtggctcatgcctttaatcccagcacttgggaggccgagatgggcgatcacctgacgtcaggagtttgaaaccagcctggccaacatggcaaaaccctgtctctaccaaaaatacaaaaaagccaggtgcggtggcgggcgcctgtagtcccagctgctcaggaagctgaggcaggagaatggcttgaacctgggaggcagaggttgcagtgagccgagtttgcgccattgcactccagcctggatgacagagcaggactccatccgggaaagaaaaaaaaaagggcgggggggagaggaaatcattaataaggtgtaactgaaacctgtcctgaaagaaagcaatgagcacctctttttatcataacatattttgtctatgtttcgtatttccacaaactcctctttgattacagattatgtctttccaagaagactatttggcagcaaagtgctgacaaagtattgatggcagacctccttacacaaagcctattagcatttctattgctgcactgcacactctggtattataaatcacacacactcagcatcatgcccaataatcaaacagttacctaacaactaagggtattacaaacgcattgaactaatctttgaatatatgctgataattaaattccattatggtttctaactttaaacctaaaggcaggcaacactgaaatcaagtgtcatccactgtgccctcacatatgccatgaaatgtcatttatattatatagttcacttccaattactgaatacaccagccagagcatctatcactaatattaaaacaagcagaacccagcagtagagcagtggaaggcatcacatggtttaaatggatttctcacctttcaagtgtcaaggggtctttccaagaacatctcacttagggggttgttggccttttaacaaaggaagctgctccagttgaaagaaacattcaaaagacaagacatgctgtaaagcacagctcagagctagagacatctgccccttgtgttaaaacacaaaacagtaaaagatcctttatatgaaaaataaatacatgtaaaaattgagcttttgtcaaggttactaacaaagaagttatgttaatatctaaggagcccttgtttaggcacatgccccacagaaattagggagccctcctgtccagaagatctattaatttcccagtttttaagaccaaagaaatgtttcttgaaatccttgcttggagccccaaagttaaagcagccatcaagcacaaagctatgccccactgtgttccgctgtctgtgtccatgtctgttactcacgcagaaccaccacgattagcacaagttaaatttcatggctacgtagaaatgcacattccagctctctgcctactaccatcacatgatgatctttaaaacaagaatcaagaaaacgttcctaatcctctgtgttcagaaaagcttttactgtcaaaagaaaactttaatagctgactcttggtaattaacacataatagagccaccactaacctattaacaatattaccgtattctataattggagggtaaaaattagctatagagggaattgtaggaaatcattttctagctctaccatcaatgttatgtcagataggctaacaagaaaaactgttagagttctaaatggcagtaaataattattggaacataaaatgaaacaacgcccaagaaaattcaatctgaccacacagaagaaaagatagtggaaccaggcctagggaatttatagagactactgcctctgcattaataaagaaatcattatctggtaactataactcaaatcaggctctagaacaatggttcttaacttttgctacaactaccccatctgaaatctgcatgccatgcaaactactgcctaaggcggggcacagtggctcacgcctgtaatcccaacactctgggaggccaaggcaggtggctcaccggaggtcaggagttcgagaccggcctggccaacatggtaaaaccccgtctctactaaaaatacaaaaattagttgggcgtggtggcgcatgcctgtaatcccagctacatgggaggctgagacaggagaactgcttgaccctgggaggtggaggttgcagtgaactgagatcgcgtctgggatccagcctgggagagagagagcaagactccatctcaaaaaagacaaaaagaaaaaacacaagataaaggatgcttaaaacctaaccaagtatcaacagtaaaatcgaaggacacttagaaaattaactgacattatagacaacgtcaagtaatttgacatcatctcttctttgaaattcaccatcccatcatgtgagcctatgtatacagctcctagtagcggataaagtaggcaaacttacatgaagaaagaattccattactataagctatcattaaacaacttaaatatctagagaaaattcatgaataataactgaggtgattcagagtccacagcataaccagtttaattgcatttaccacataactggtccatatacactggaactctgaacgtgctagacgagtgaaagcaaatgtgaaagcttttatttcagttctaatgtactgcataataaaatttaaaaacacacacaactaaaatgtggattaaatccaaaaactataatttcattaaattgcattataagattttcacttactaaaatacagaaaatgttttctaatatgcattggacttttttagttatactttacatgtgaaatgcagagatttttagatacactatttagtttttataaaggctcaactcaaaacagttctatcactccagaaagttctctcaagcactttcccagtcaatcctcaccctacccatagaaaacctcgatctagctagctagctagctatttttggagacagggtctcactgtgtcgctcagactggagtacagtgtggtgtgatctcggctcactgcaagctccacctcccaggctcaagtgatcctcccacttgagttgtgtgccaccatgctcagctaatttttttatttttgtttttgtagagaagaggtgtcatttcactatgttgccaagactgatctcgaattcctgggctcaagggatcctcctcccatctcaggctcccaaagtgctgggattacaggtgtgagcaaccagatcctgctactactctgatttccatcacagattaatcatagggcagattcatatttaactttttaagaaattgtcaaactattcaagtggttgtaccatcttcattgccaccaacaatgtatgagaacttgcattcctgacaaccttgctaacattcagggttatccatctcttcaatttagccattctagaggctgttttggggatcttattgtgacttaatttgcatttccctgatgaccaataatgatgggcactttttcatgggcttatctgccattaatgtgtctctgtttaagactctgtcaattttaaaacactgatttggtcttatcctataagagtgttgtttgttggaaggtatttttttaaatgtattctgcatccaattgctttctcagacatatgagtgacaaatattttcttacagtctgaagctgccctattttcataacaatgtcttttgatgaattccaatttttttcatttgtggttagtactttctatcccctcattaagaaatcattgcctaaatgaaagtaaacacactctcctgatttcttctacaagtttttataggtttgagattatatttagatcaatgatccatctcaaattaatgtatggtatgaggttgggttatatcctgtttttcacatagggattatccagttgttccagcccatttattgaaaagatttttttcccactgaaaataatttgatcatatatgtgtggattcatttaattttgcattcaagagatataaagcacatctcagtccacaggatcactggcattttaatcttactttgtatagtattaccaatattggaaagcatcatttcctaatattaatatacctcatatttacatgaaacaaaatattggtgtaataggtacatagagattttttttccatttgagttatgcaattacacttcttaaatatattattatttaatatgtatgcatatacactggaactgttgtgacacttttaatggctaatgttcatgtttataaaatatgtaaattttcagctattaatataattgcttgctggtatataatatcagataaaatgtatataacaaaaataatcatataaaataacaccgtttcctcaaatctccaacctcagctaccacacagttgctcctctggttcaatgtaaaattttcctcaaaagttaatatattttaagttattattttaaagagagagggtcttgctgtgttacccaggctgcagcgcagtggctatccacagggctgatcacagcacacaatagccttaaactcctgggttcaagcaatcctaccgcctcagcctcccaagtattaatgactgggactataggtgtgtatcactgtgcctgcttttttttttttctctctctttctttaaaaactttttttctttttttttttttggggggtagagacagggtctcactgtgtcacccaggctggtctcaaactcctggcctctacctcccaaaatactgggattacaggcatgctccaccacacttggctattatattttaagggttactttctaaaccataggaaaattagctgggtgtggtggtgggcacctgtaatgccagctactggggaggctgaagcaggagaattgttgaacctgggaggcagaggttgcagtgagctgagactgtgccactgcactccagcctgggaaacaagagtgaaactccatctcaaaaacaaacaaacaaaacacacacacatacaccctgaaatctctaacactgataccgggcaggggtagtggtcacggtatagagaacagcatattctcaccatcaaaggtgaaatttcacaggccaattagggtactgatttaagatgataggaccagggtctcttttacatagatctgagcctggcctaggaaaaatcctagaaaaaacttacatgcttgtacctctgacacagactagatcatatcaatgggggttggggacaaaagccaactagcaaaggataaaacgattcctctgtctgatcttgtcttcagtatctatttctccctcatggtttatacaggaatggtggcagccatgagagataatgggttaagatttaagaactcaagtgtctgcggtcctggggcttagtaaaactctggttcaataaaaactaacatactagaagtactagaaggatggtagcattggcagcatagtttacaaatgtcccttaatccccacacaaaaacagattagagagtcaaagcaaattcctgctgacacacaacaaaattcagaaataaggcatctctacaaaccgcaaaatataagcaggttggaagggataaactaccatcagccataagatctctggatatgagcatctgcacgagagaaaacagaatcaatcaatgagatatgggatacagctaagatcaggaggaccgtaaaatagctaccaggcaatgaggaaggccaatgtgtgaagagcagctgaagcctggtggggttgcccatgccgacagcaggtcagaacccccagagaccttgcagggctaaaggggctgaagtcatctagacacttttgaactcttcaaaactggcccaccatagctccctgccggcacaaggagccaaggcaggggagaaactaccagtaatggaatataaattctgcaaaaaatacaaaataatttaaattaattaaataatttaaataaattaaagaaaaaagaagatccaaatgaaagtgaaggagaggaacagagtcagaaaatcacagcaagctgccatttttttaacactgcataaaaacaacagaagggggagctccgtaaagttaaaaattcaggaaaattaaattcgcataaaaacaagcaaaagcaaagtacattatacaaacctcatataatgttactattttaaaaagagaatacagaacagaataacacccctacagacaaggacagtacaacaactgggctcataaaaaacaaaaaactataatgtactacttcaaaacatgctaaagatattattaaataaattataccagatattagacagtaacaaaaatcagaaacaagaaaattcagaaatgaagtgacagacataaataatttcaaaaattaagactaaacccgaagcaatataaaagtgagtgaacacagctggcaatgtcttaagaaaaagagaagtcagaaagaaataaacatttaaaagtcaaaagaaataaaaaatatgaaaaggactaaggagaaagtaacaaatattaaaaataggcactgggcatggtgacttacacctgtaatcccaatgctttgggaggctcaggcaggaggacaggagttcgagaccagccttggcagcagagcaagaccctatctcaacgaaaaataaaaaaaaattatctgggcatgatggtgtaggcctgtagtcccagctactagggagtatgaggcaggaaaatcacataagcacaggaatttgaggttacagtgagctatgatcctgccacggtattccagcctgggtgacagaatgagaaaccctgtctcaaaggaatccattagagaacaaacttcagaccacaaacaaaaatgactacagagacagctacataaggactagtggtgaagatgaagtatatagtgacttgaagaactaagactaaatgagggttaaaaagactatagtgtgtaatctaaaaatgcagacattctattatcatttaacacacagaaggagaaaagggagagtgcaaacaaaaattttttattttactgtttccagaaatcataattggtggtgtcagtactagtattgttactctgaaactactgtataggtagatgagataaagaagtaattatgagtccaggcccagtggctcacccttgtaatcccagcacttaaggaggccaaggcgggtggatcactttagtcaggagtccaagaccagcttggccaacgtggtgaaaccccgtctctactcaaagtacaaaaaaattagccaggtgtggtggcatatgcctgtggtcccagctactgggaggctgaggtaggaggatcacttgaaccagggaggcaaggttgcagtgagccaagatcatgccactgcactccagcctgggcaacggagcaagactccatctcaaaaaaaaaaaaaaagaagtaattacgggatagtctaattctgtcaccccttgtgtccttgagaaccagaaatctgtctgaaagaaaagagatagagatggaaatagctgacgttaaataaaaactctgtaatcctggatttaaatgagacagcgtgttgtatcagtataaattgtaagacatcatatataatatttcccagctctgtccactccaattatagatattttaacatcattagtatataaatcaagaggcccagaaataataaacagcccagcagcaatgagactcaaatgttctagattatgctcttgcgataacatctctcactaaaagaaaccagggatttgagaagagatgctaattatgtgtctgctgcaagacatgtacaagatgaggatggaacaccttggcatagagatagtaaggaaactatcaaagattcccaggatcatgtcagaaggactcaggagccaataagaggttcctactaaccaaaaatgggacaatctggcttcaataaggattaggaattgcaattagctgaaatccatcaaataggtttaagaatactccaatgtattatttgaaaactgggtaaataaacggaagcaaccaaacctttattctgtctttcctatataaattgtgcaactgggtaacaagacagtagatgacagacaacactaccatataaaattattctagctaataaatgaaactgaaatcatataattaaaatcttacaattttgaaaatctcaaggaattaatggatacaggctaacaaaaatcagacattatacacttcctgataaaaatatcctacaccacctgtaatcttgcccaaatggaacagacctgagtctcatcaaacctctggatccagctactaatacacaagaaatgcaggggtcagaggcacatctttaactgtactacacaatcaataaaatccagattgcagtagattatctaggtcaaatgacttggaatcaacaacaaacaaaatttaggaaagtaaagcaacgcagcgagagatctgcagagtattttataatagattcagaagacatatcatatgcataactaaactatagtgtacagacatctacacctgggtgacaaaactataatggaatataattactgtatatcaagatagtgatgaattccttagggaaagaaggaattgtcattgcagaggacctcgaagatggctggccacgtcctgtttcttgacctgggaggtaattacacattataattcattaagctatacatatgttttgtgtggctgtatgtatctgtgttttattctacaatcaaaaggattttaaaaagaaaacactaatagcacagctcacctgtattctgcttagaaaaatgcatcaactaaagctatggcaaccacagaaagaaactcaggagaagggaagcgaatctaaaagacaagtcccatcaggataaaggtgaacttcctgactcagacagacttcagctggagaccagatgccacagatgcactatatgagcagataaaagatggattttaaccaatgctcacaaacttaaacattccataattatgtggtttctagctgaaagacaaaatagcatccaaaccaaaagaactaaattagaaaatgtatgttaagaaaatagaaacacaatatgagaaagcagctggaattgtcacaggatcccacaaaaggaagaatagctgcttaacacataatagataatcccttcccagtctggagtgatcagaatgacatccttggattaagaatgcagcccaggaaactaaaatttaagaataattcggaaatataaaaagcaaaaaacatttatgggagaacttgcattaactcataataaatgccacagacataaagcttctgatagaacaagccccttcccagcctctaggtctgaaaagccttaaaggagtcctcatttccctcctctttcacacatcaaacagcaagtcgaaaaccaggaagtcttcaattgtcctctatagaaaattacataggaaaagtttaagcacaggctttaaaattatggagacttgggttcgaaatctggctctcatactatgtgacattaggaaaattactgaacatctctgagcctctattcccaatctgcaaaaccagaatcatttccattgacccttacaagggaacactacaaggagttccttccagccccagtgcatctaataattacctcaaattattccactgaattctaactgttccctatctacaatacaaatcactgacagcaaagacacatttttgttgcaaagcagataaacactgcttgttaacttcacatccctcccctccaccactaactctaacagcattctgggtcagacccctcatacagttcatgtgaactgtctcagtagcttcccaatttgctctatctctaatctttcttaaagaggaattctgatcacatactcatctgctaaaacacgatcttggctccccagtgaccaacaaataaaatctagtttctcagctttcagagctcagcacacctttccagttctatcccccaccactctctttaccaaaccaagctggactccaacattcaacaaaaatattctgcctctattctttgtctaaaaagtttttctattctccagtcaaattctttccaaccttgtgagtcccaccttaaaagctcgtactttgactaagtccttccctcagaaaccactctcacacttccccaagctctgttctctgcagggtatgttgggaccctgaaagacatgtttcattagtgttactcgctttgaaacactctgcgtgcagatgccgtatcttactcatattcttacattcaacaaacacacattaagttcccactatgtgccatgcactgtaaagcctgaagccacagcagtaaacaaaacaagcagatgtctctcccttcatggagctggccattcttgataggcagactaattcatttcttttccctcctgcgcaatggactgttcttcatgcagtatttatttaataaatgctggctgaatttaataaaaacatttcaaaagaccaattaacacaatggggaaatttaaagtaaatcattgaaaactctcatttatattctaatctgcaaatttaacatattctagcaggccttctctttttcagaaacacgtctgactttttaaattcatcaaaagtccctcaaagtgcctgggctggagaagtcccaaggcctacccttcccaaacccctcatcgaagggtcgtcgcctcgtccagtctctctgggtggccatgcttggttttatgtaactctggcctagggcatcccactgactctatgaggagtgaccccctgacccaaaaggcagccaaatcttgagcagacaaaaacacatacattacaggataaaaagataagctggcccaaattctgtcagtaacttgaaataatggtaactaagtaatatcaggaaagaagaaataaggatgcaagatgccaaacaaaatctttatgaaatacttttgatcatgaacttatctgctaaatcatccctcaagtagaaacaggagcccagagcttctctcacagaacctccctttggacatcttccatagtgatcccccaaaatgtaccaccttaaaacatggcttaagaaactactgactgaggctgggcacagtggctcatgcctgtaatcccagcacttcaggaagccaaggcaggcagatcacttgaggtgaggagttcaagaccagcctggccaacatggtgaaaccccatctctactaaaaatacaaacatcagctgggtgtggtggcaggcacctgtaatcccagctacttgggaggatgaggcaggagaatcacttcaactggggaggcggaggttgcagtgagctgagatggtgccactacactccagcctgggcaactgagcaggactctgtcccaaaaaacaaacaaacaaacaaaaactactgacaaggccaggcgtggtggctcacacctgtaatctcagaactttggaaggctgaggtgggcagatcacctgaggtcaggagttctagaccagcctggccaacatggtgaaacctggtctctactaaaaataaaaaatgtattcaggtatggtggtgcatgcctgtaatcccagctacttgggaggctgaggcagaagaatcagttgaatctgggaggtggaggttgcagtgagtcaagatcaagccactgcactccagcatgggaaactgagtgagaccctgtctcaaaaacaaacaaacaaacactactgaccaagtaatagataaaaaccaaataatcagcttgctaaattccaagtatttactcacatttttatttattttttatgcattcatttggcgccctatttattgaatatctaactaagtgctaggtcctgtgatagtcacagaataagacagattaggtcttgctctcaaatttattttattggagaaaggcaaacaagagtttgccccctagttcctcccactttctttctttgtgctgagaaacacagggtgccttcacagttctgtgacctggacagctgcaagttttgccttgaaggcttgagcccaagctgagggcttagccattcccaggcactgctgaaatactgcaagaccaaatgtggcaaaactcacagaaactggttccgaccacgaatcgaattcctcaaaccctcatataaactctataacctgacccctcctcatagacacatctaggtagaacatctcttgtctcaatgtctatcgcaagtgtggtacagccctctgtgtgtaagttcccctaataaatgctttttttgccctgctgtttagtgcttctttctttggaatcctaatcagcaccacctcaggactaagtcagtcccttgcaggaacactcctaccaccattgcttttggggtaaatccatctgagagctggccagacagaacaagtaaacaaaccaacaaggtaatttcagatgataatcagtgccataaaaacaataaagatatgaaaactgagcagtatcttagaaaatgactaagaaggaaaaggggtggggcctgaataaaatggtaagaaaaacctcccagaataggtgccattcgaacacctgacaaaaaatgagtcaaccactcagggatacagcacaaagccatcaaatcaaaaagagtccacaatccacactcaacagtactatggaccacagagaatgtcagaaatgtttaaaactgttttctccctcaagaggcttaaattccatttggggaggtaaattaactcaggaaacaaattttatgaaactgcagagacttcagctgaaggccagagatgccctgggaacaaatggaaatgcagtgcggcccaccggtcatgttccctcaaaggccaagttagtgcctctggtattctcattctggtacctatgctgctggaaatagtatacaaactatgcctttaagctttccaaattggaacctgaaattttaaaaatcttaattagtccacacttacgaaatacgaaggcttccaggcacactgtctgtttgctgttctggaaaatctagtccttgaattgcatttccttcacttacctgtgaggttccttgacttcttcccactcttgcagccttctcagccacgctgattcacagctgctgcttccctctgagggaccacacgcctgctctcacccagaatcctctagcagtttctttttctagaaacagctgaagaactgctgagtagaaagagtctgcaaactatcccgactgcactgtattattccatcagtgtgtggagcaactgaaaagttacttggctatatcagatgttaagaactgagcacaagcttcccaaatgtgtgttcactataaagaggaaagccagcagacctcttccaactgagactctgaagagaaggctgcaagagatttctgtggcgctgacatcagatctactacatcatgtcccagcctccacggggcaacaagaaagtaaagatcaaaccacctgagctgccagataaggaacgcctttctctataaataacttactgatgtgaagaggcttttctgggataaaacaagtagaaaagttatatattgtacaaaaagaatggtcaagagaaagatggtgtaaaagcaagaaaaatcttgaccctcccagaagccactggctgtttttgaccacccattgacagtgaattgcaaatggccatcagcactctttttgctttaaaaaaaaaaaaaagaaaagaaaagccaatttatgccattagatgaaaatccaagtatcatcacctattttcaatgcaaaatgcaaactgtctatatagccacctaatgaaccctgccctaacatgttcccacaatccaaatccagttagtgactggaaattatccacaggacgacaactccaggaagcagttgcctcctggctaaaccaagaagacttaggagtactagtttctacacctagaatccacttttctctccttttcaaacctgtctaagccaactccaaattcactccaaattctcctccttagcattatcaactgacaggttccatcacgcatgcttccttcgcagttcacacttactatgccaaatgcactgctttcttgtgaaacacatctaacgtatgtcctgcccttcccacagaaatctgcacatgctgagggaaagaactcagatcctgtcttaaagatgctgctaccattcatttaatcccttcctctaaaggtgcctactataaaatgatacgtaaggtgagggtttaataaactttggcttaacacactgaaaggaaacaaagatttttatagaaggaaaaaacactgtaatgctaatgtgaagtagtaccttcacagtaaagacattttacagtacttccctcctcaatgaaaaggaacaaagaaatacaactgaaaacatcaacaatttaactaaatcacaggccatttcatgtttagcaacttgtctttaaaaccctccctactacacttccaccctaaatgcatttacatgcaagacataacaggctcctgcccttccaaaccagcaaaaggtactttttttttcttttttaaagacaccgtctctgtctgtcacccaggctggatggagtgcgatgctgtaatcttggctcactgcagtctcgacctccccaggctcaagcaatcctcctacctcttcctcccaagtatctgggactacaggtgcataccaccatgcccggctaatttttgtacttttttgtagagatcgggtttcaccacgttgcccaggcttatcttaaactcctgggctctagtgatccacccgcttcggcctcccaaagtgctgggattacaggcatgagccactgcatccagcctaaaaaaaaatcttttaaaagccatctttggctggtgcagtggttcacgccagtaattccagcactttgggaggcctaagtgagaagaatgcttgtggccaggaattcaagactagcctgggaaacatagtgagatcccatctcaaaagaaaaaagtcatctttgcgcagagttctacttttacaccctatcctaggagaatcaaacttaatcatatttgcgtggagataatccatgtttgtttaagaaaatgaacagaaattcaattcataaatttagttctaaatcattaaaatacaaatacatgtaaaacgtgttgaaactgttcttacctacaatcgccatgtaatctcttctatcattctactctgttttggtattcttcacatgtttttccatctgagatatgcaatagttctcctaatcccaagaaatggctacaaccttggggtcattactactcaggaactgggctgtttgtggatctcattctgtgctgaatggtgcgactggtttcagacatgtccaactgtggcagagagtgcttgttccccattcaacgtccattctccccattttccataataacagagcacctacgttactggagcacagtaaaccaaagttgttaggcacggctactggaaaagctctggaatgggcctaaaatagcttttgctgtgtgcccctctgataagggtcagctgtgtccccacccaaatctcatcttgaattgtagctcccataattcccatgtgttgtgggaaagagccagtgggaggtgactgaatcatgggggtgggtctttcgtgtgctgttcttgtgatagtgaatacgtctcatgagatctgattgttttataaaggggagttcccctgcacacgttctcttgcctgccaccatgtaaaacatgactttgctccttatttgcctccttatttgccatgattgtgaggcctccccagccatgtgcaactgtgagccaattaaacctctttcctttataaatgacccagtctcaggtatggctttattagcagcatgagaacagactaatacaccctccttcagctgcctggctgggatggaggaccagtgtcccccaatccactgcagagcagtgatttttacaatgttaaacggctagaaaagtttctaaacagatactttcagcttctctattcatctcctggtggactggtagcaaacagtcctattggtgagccaccatttgaatagcactggtctagagcatggactttaggggctgtggctccagccaccatctgggaccatggcgagaccttgagaagaaaaccatgcaccggggcagacaggaggagactagatacctgaggtttaggtcactctaccaacccggggcagcacaccctgaaaacacctcattttatatgagaacatagatgtttatcttaaacaactacgatttggggttatataataaacagccaatccgaacaacaactgacgctcccattttgcagaccactacaaaaatgtcacagcactacattatcgctttttattctcacatgagaataaccctatgaagcatgtagcatgggtattattttggtttgacagctatggaaactaatgtcctaaaaggttaaatagcttgtctaaagtaacacagccagcaagtatagacccgcaaacaaaagccagctaggtaccctttccaaaacaactcacctctccatgaagtgaaatcatctcatcacgactgtacataaaatacgctgtaaatgatcagaggtgtgtacttacaacaaactacataaaatgtgtatgccactgggtagaaagatacaacaaaaatgtcacagtcaactagttaatataaaatcagatttaatggctacagtgagaatgtactgcattttacagtggtaacaaagcatctgtgaaagtagacagaggcgcagaaaccacagacaatttttataataatttagccagcaatatagcaagtgaactatgagcaaatactacaatatagtctcaacatttgagcctctacatataacatatagtctcaactaatactagatgtaaatacaatatattaataaataataatgtttaagacagtttgaataataatgtcatggttaatagtaacatattatcctttagcataaataagacttctgagaatcactggcaatcagatgcgctctgaaccattcttttgatggtaaagaaggttggcagagagccatccccactcacttccaggaggccctgatgagcaaaagcatattattaaaaagctgcgggggccaggcacagtggctcacacctgttaatcccagtgccttgggaggccaaggcaggaggatcatttgaggccaggagcctgataccagcctgggcaacatagtgagacttcatctctacaaaacattacaaaattagccaggtgtggtggcatgtgcttgtgtggtcccagctactcaaaaggctgaggcaggaggatcgcttgagcccaggagcttaaggctgcagtgctctatgatcacaccactcattccagcctaggtgacagagcaagaccgtgtccaaaaaaaaaaaaaaaaagctgctggtttggatctaccatgttatctgtgactgtggactaacttttctttgggtaaaatttctttgcctatgtgggtatcaaccattttatttcatctgaaaaaaaaaatgctaaagcatttgtccatatccatacttaactgttaaatattaaacagaaaagttatatttatcattaaataccaataaaaacttttctgttgtcctgaatattttgttacaacattaaaaaaagtacacacacacaagaaaaattcagacaaactttaatgtattttattattaatgttttatttttatgtattattttaatgtatttatttttatgtatttatgtattttatgtatttattttaatgtattattttaattgtattttattatgtacatattttcctgtcatattttcccttcagaaacaaactgccaaagaaaaaagatgaaaaagcatgtttaagcaatatttaattgctcctagcatttaaacatgttataaaaatccttaaagatcattagtaaaaatgagttcttacaatacctatccactagtacactatacaaaaaacaattaatggaaggaggagtggttagagggatgtattggtagagatatagatatattttaaaaaaggatgcatcaactcaaataatataggaaagaagaaatgcaattcccactaactctgcaaatgaccctcaaaccttacacaggcacaaggctacaatgaagaaagcaagtaagttttggagtgactccttcagggcactaatccccaaaagtttataccagctcaggcttcagcaaactacaggcccacaggccatgtccagacaccacctggactctactgatccactagaaataaagtgattcagtaaaataaagtttcactgaaacacggctacacagtcatgctcatttgtttacaaattgtctatggctaagttgagtagttgccatacagaaaataaaactgaaaaaactatctggcccctaataggaaaagcttgctgtccctgagtacaaaaataaccaatagtaagaatgttcagaatcagctggctgagcagcagcaaaaaacaggatagctctcctctagaaactggtaggagcaagctttctgcctcataaacactttgctgtgtatacacatgtagtcttaattcatgagacataagatttgtcttttaaaaagctgacccaaatacaaaccatctccaatcagtttctcagacacaagtcagaatatgacattaaaatccagtgaattgcactgatattttctcttacagacaaacctagtctgtaggaaaataaattactctttctctctctcttttaatttaactaagggtcttgctctgttacccaggctggggtatagtagtacaatcataagctcactataacctggacctcctatgctcaagcaattctcttgtctgtggcctcccaagtagttgggactatagccacaagctaccatgtctggcttttttttttttttttctggtagagacaaggtcttgctaagttgccagggctggtctcaaactcctggcctcaagtgatcctcccatctccaactccccaaagtgctgggattataggtgtgagctaacacacctggccagaaaacaattttctctaatgaattaactgaaaagatttaccacacagcgtgtctatctttggaaacagcgctgccacaaggtacctggtggtgttcaagtacaaatccccctgacctgcaagaaatttcacctttaataatctttaagaaaggtcaaaagcattaacatgacagatgcccagggcacgagccaataaaaggaaaagttaactgggttatctctctcatatgtagttaaaacagcaaatgcttaatcatttaatttgtactgatgctgatttttttttttttttgagacagggacttcctttgtcacccaggccagagcgcagtggcgtgatcgtggctcactgcagcctcagcatcccaggttcaactgatccctctggcctcagcctcctaagcagctgggactagaggtgtgtgccaccatgcccagctaatttttatattatttatagtgacggggttttgccatgttgcccaggctggtctcgaactcctgaactcaagcaatccacccgctgcctcagcctcccaaagtgccaggattacaggtgtgagccactgtgcccagcccctgatgctaatttttaaatggacatttgaattctcaaagaaatttgtgttgcctcttgtcaaaccaggtcactgaaatgataacccacacaataagccaatgagaaggaaaaaatatatgggattggaaaacagaatgaaaatcaacattaaaattccataattaaaacacgcagatagaaaagaatttatctgacaacgtgctaagaaccccctgtcctgtgtttgctgtcatggggagggaagaatgtctgcagcacaggctttcccagtctgattcacagccctgttatatatgaatgtgcacactcgaaacaagatctgatctggacaatagtcaagtctctaaaagcaagggagttcaattaattttttaaataaacatttcactggattttttttttttaatgatcaatcctgttgacagttttcccgtccatcttccagaagaactcactactcaaccaactgcctggtattcagctgtgactgtgaggatggataactatatttccttaagaaatagcaggaaggtatctcatccaagcagaaaataagaccaacagttgtccaggtctcagtggttctgcatttcttcctaaaagagaaatatgtctctaaacatctctttcccgcctcatggggttgggggaagcaatatgctcagaaaaattttaactactccaggcagctgaataaaacaagctgaaaaccctagatgtgttctccacattactgtgacagaatgcaagtgtgtattcgaaagatttcctcgctggaattataaagcgtacagcaagccagcctgctgtactgccacctcgctcttgctcccagactccctcccatggactaagcaggaacgaacatacgagctgtgaatctggtaggggaaacaggaaacatccaaccaggaacacactggagagaagagaaaacagttaaccacctatgagaagatggcgctgattccagcaggtgacaggtgggacgtgaagggcattcccggccctccagcagaagcaacgtcacggagctgggtgctgggtgggttgcaccgttctgaggcagcacggttctctccaatgactctcacacaggaaccagacctgactctgtttcttccaggacggtcctccctcactccacagcctctcatggcagctggacacccaccagggctggattccacacacagaaaccacatccaatgctctgttactagaagtcgaccatctggatttcaaagacctctgtctctttctgtcctttgttaatcagtctcccttcccactcaaccctctcccctccatgccagagaaaaggatttttaaatctgatgagtttttcagggaagcagaaatgtgagattacactgttctttagcctcacctcatggttttgctacagagatcaacgtcttctaacacagctttgcccatactcttcctgaggctgaaccaaaaaatctttcatgaacagtactgtctccaccagcagaatgtaaatataccacagcactgacttcaaaacactgaagtagagagtcttaactctccttagacagaaggcagaaggctgcaaacatcccccagcagactgcaattgtgctgttccaactgacaagcccagtaagcactgcccatgacaggacctcctgcagaacttctcccagcctggcggacagcggggcaggggtcaccctcagaggctcgccttctctttgctccctagccatcacactacactgggatgagacacaacaagcacccaaatgacacagtgaccatttcttttggtcactgaggttcacgagatgggctgtttttctttttcaatcgaggagctgaaatcctaccagccacctaacaattaacaaccccaaccctgtccacggttaaaatcaacgaaaaaagcaaggccaacttcttgtataacttccttcatacgggaaaaacatcaagttcaacgtgtgttaatcaagtgtcaggtcaatgtaccacgcaaatatatttgatgttttttgctaaggccaatactaaactgttaaacacagagaatatgaggaaaaacaaggttaaaaaaagtgtatagatgtccaaccctcttttaataattccaaaaaaacacaaagctacttaggcaaaaataaatcacaaatctattcaggagcactgtaaaacggaagagaattatctaaagggattcaccggctactgactaattttaatatgaaatgcctcacaaatctccctgtgccaccaacaaatcaccagctgaggcaaatcccagataatgaaacattgtaagaagggctctttttaatagtttagcccatcaaggagtgagtattgattcttattttcagcagaaggagacagtcttatctccagccttacagctcagtgacaacatcagagaatttaatcacagagccttttctgccatgcaatccttaaactgtcacctaggattctgtgccattcctcatccatttgtagagaaactcctggtctcacagatgtgtctgcctacttaaaccacagtaaccatattatatggttggctgtgtcccacccaaatctgactttgaactgtaataatgcccacgtgccaaggacgggggctgggtggagataaatggatcacggcggcggtttccctcacactgttctcatggtagagaatacgtctcacaacatctgatggtttcataaatgggagtttccctgcacaaactctcttgtctgccaccatttaagatgtgcctttgcttctcctttgccttccaccatgattgtgaggcctacccagccacatggaactgtgagagtccattaaacctctttcctttataaaaatcacccagtctccgtatgtcttaattagtggcctgagaacagactaatacaccatagcagcacttcaagtcctacagattaaacacatctatctatcaattaccatttgccagctgtttttctttaagaattttttaacaattcatcagatatctttgtgcatttccaacttgtttgttaagaaatctgctcagtatcttaagagcagattgaaaatcataataatagctgtgccaattctctggacatctgtggatatttgtaatatatccaagacaatgccagtaacaaaagaaaaagccagggggaagtgatagcgaaatcagtcattatttccttatcctgacataggaagatcagaaagtcccccaccttccagagaaaattaaccaaatactaaagttagcagtaatattaattcaaaagtgtccctgcatctttaaatactaaaaaagtactcaaaacacagaaaaaattacactgaaaacaagccaatacttttttttttttttttttttttgagacagaatcttgctgtgtcacccaggctggagtgcagtggtgcaatctcggctcactgcaagctccgcctccagggttcacaccattctcctgcctcagcctcccgagtagctgggactacaggtgcccgccaccatgcccggctaattttttgtatttttagtagagacggggtttcaccgtgttagccaagatggtctctatctcctgaccttgtgatccgcctgcctcggtctcccaaacttttttttttttttttttttgagacagagtcttgctatgtcagccaggttggagtgcagtggtgtgatcttggcttgctgcaacctccaccttctgggttcaagcagttctcctgcctcagcctcccaagttgctgggattactagcgtgcgccaccatgcccggctgttttgtatttttagtagagatggggtttcaccatgtgggccaggctggtttccaactcctgacctccagtgacccaccctcctcagcctcccaaagtgctgggattacagggatgagccaccatgcctggccaagccaatactttttaattcaagtacaaatcaaactacatcactgagaggaatgttccccaatccagttacactaccctactatccattatcactgttgctgtgaataattagtacccccttccagggagtggggggtacagaccacgtgacagtgggtgtcactgtggtgacaagactgtttgagagtgggaggtgggagcaatcatttatgctggtaatttgccttaagatgttattcccaaacatccttccatgatcctttggattgagataccttaatcccaactgccttcatgtccaaggtcaccacacacacacacacacacacacacacacacacacacacacacacatcttccttccatgatcctttggattgagataccttaatcccaactgccatcatgtccaaggtcaacacacacacacacacacacacacacacacacacacacacaaacacacacacagacacacatcttctattagagagaaccgaaggcatttgacagctgcctttttaggtccttctgcctttccatccaaactatccatcgttaacaaggccctatggcagtgcagcagcgctctccattctaatcaggcatcgaagagaaacttcactgtctgtaggctgcaaccaagggcagcagcctcacaacaaaagtgcaccctttgtgtggcaatcatttacctgttgtaaaagcacagtacccttctctctaataaaaattcgaaaggccaaaaatcagcattacataatggccaaacataaagaaatgaaaagcagtctgggtgcggtggctcatgcctgtaatcccaacactttgggaggccgaagtgggtggattacaaggtcaagcgatcgagaccatcctggccaacatggtgaaaccccgtctctactaaaaatacaaaaaaatcagccaggcgtggtggcgggcgcctgtagtcccagctactcgggaggctgaggcaggagaatcacttgaacctgggaggtgaacgctgcagtgagctgagactgcgccactgcactccagcctggtgacaagagttagactccatctcaaaaaaaaaaaaaggaaaagaaaacataataaaacagcctcacgctatgttcactggaaaatttatatgcatgtatatgttttataagttatagaagcccataagaattccaatagttcaggggaaaaaaaaagaaaaaaaaaaaactaaacttgagctatataccgatgtctacccactaaaattactaaaactatagccaggaatacttgtttggtttcgtgcccctctcctttacaagggaggtagaaagcaaggtggagagacacccaacagtcacttccgttttaaaaaacaaaaacaaaaccaaaaaacttacacacagcagatttttctggctagtattggccaatctttctcttgacagtattaagtgctatcctttgtgttaacagtcccatgcatttaatttattggtttaaaagaaatatttcttcatctgattaaaaaaaaaatcaatctgacttttctgtcttgtaattaaaacaaactatcaatacaatggatagggggcaatttctctgaaccaggagctgttccagacactggggacaaaaaggtgaatgaaacacagccccttctcttaatctagctaagaggacagacacgtacagaggcatgatgtgagaatgatgctggctgacagtgcctctcaggcagaagcgagagatgactggaagtgggaggtggagaggagaggctcacttttatttttcatttcaatgtataccttaatatttttaacatccatttttggaattacatgttttacaacttcattaatagagttcagaggcacaagattttggctctaagtttacatataactaagtagtactaccataattatcacaagctggtaaataaacaagatggcctcaatgtgccaagggcacatttatgccaaacaaaggcaaagtcacttcatggcaagctgtatttacactgatggtttctgagtggcaataactgaaagaaaagcaacaggaaaaccgagtcattacaaggaatccagccgtctacacaaaccaggcaccatcccagcatccaagaacatgggccataaggaagcagtaacagttacatcacaagcggctacttatttcacaacatcatcgcccagtctattaaattaatgttggtagtcagaactttattggttttgtagtttggtttgaaattaatttataaactgccttttatagctgcattagggatataagcacacaaattatacctaatttgtgtattggggaagggaggaaattaagtaatatagaagaacacaaaaactatttttgaagtaaacatactcaagtttcaaaaacatgaaagaccctggaactgcatcagaagttccacatcctcaacgtaagcaacataaggaggagaccctgtctttacaaaaaattttaaaattagcagggcatggtggcccgtgcctgtagtcccagctactcaggaggttgagacagagaggccgaggctgtagtgagccctgaacatgccactgtactctaggtgggtgacaaagcgagaccctgtctcaaaaaaaaaaaaagaaaagaaaaaagaagaagttccacatgctgcaaaggacaagatcagatctacttttacactagttactggagttggggacaagccttcatttgctaatgctggccatccatcagaatctcctgagaagtgcttcaaaggagtatggattcctgggtttgactctggaacaaatgaatcagtattctcatcttacatgtgaagacagtgggactctgaaagattaagtcacctgatcgtacaactagtcaatgggtaaccaacatgattcaaaccgatactatgattttaacagtaaaaacgtgaggttttttaactacctccatgatctgggggaagggtatactgcagttccctgaactactctttcaacttctctgtaagtctgaaattattttcaaatagaaagttaaaaacaaaaactaaaaagaatagacagcaggctgagacgtgttaagaggtagaggtgggataggaaatggaaaaggatgaggcagaggcctctgaaaggagggcagaggcagagctccatctccacacagaggaggtcggctggttttcagttttgttttgttgtgggggaagaggaggtaccagtcaatagcaagctgaggagtttaaaaaaagaaggaaggaaggaaggaaggaagggagggagggagggagggagggaggaaggaaggaaggaaggaaggaaggaaggaaggaaggaaggaaggaaggaagtccacatatctgtaaggtgggcaataaaggaacgatctttctgtatttctctacattacaaattcaaactagcatttacgaacttgccaaaaaaaaacctgtttatgtttatagagaaatgcattctgaagtccaaacaactgaccacacaacaatttctaaacccttccactactacataaaacatctgcttctgtgctaaacttttgtaaggcacagtttctgcttcaagaaaatctgtgatgcttggaattgaggtttatcttactgaagaaaaatctgaagaaaagtgtttgccacccatacagctgataattttttgtaatcctaatggatcagtgggaaattgtaccacgaaatctcttgtcagtcaatataacaatgtctctaactaatttcagtaaagtgaaatctacagttattcccttgaaaaacaggacaaatcaactctttcccaacttttttcttttttttcccgcaagacggagtctcgctctgtcgcccaggttggggtgcgatggcatgatctcactgcaacctccacctccctgattcaagcaattctcctgcttcagcctcccaagtagctgggactacaggcacatgccaccatgccctgctaattttttgtatttttagtagagatgaggtttcatcgtgttatccagtatggtctcaatctcctgaccttgtgatccacctgcctcagcctcccaaagtgctgggattacagatgtgagccactgagcctggccttcccaacttactttaagaggtaactaaaggacgggtgcggtggctcacccctgtaatcccagggtgattggattgggaggctgaggcgggtggatcacctgaggtcaggacttcgagaccaccctggccaatgtggtaaaaccccatctctacaaaaaatacaaaaattagccaggtgtggtggcacgtgactgtaatctcagctacttgggaagctgaggcaggagaatcacctgaatccgggaggcaggtgatcatgccaaaatcatgccattgcactccatcctgggcaacagagcaagaccccatctccaaaaaaaaaaaaaaaaaaaaaaaaaacccctaaaaaaagtgataatagattatctccattactggcagcagaaaacaaatttaagtgttaaataccaaactttttttttttttttttgagacagcgtctcactctgtcacccaggctggaatacagtggcatgattatagcacactgcagcctcagcctcctgggctcaaacaatcctcccacctcagccctaaaagtagcagataacttttgaattttttgtagaaacaaggtctttctttgttgcccaggctggtctcaaacccctaggttcaagcaatcctccagtcttggccgcccaaagtgttgagattacaggcatgggttaccacacccagccaataccaaagttttacattacataggtgaagctagtatccaactattttccaccaattaccatgtaatatggttgaaattacacgacctttcaaacttccagatacaggtgacaaagaacatttttaatataatttctattttcaagatttaaaaattctatctacttttaatgtctacctagctgtcacctcaaaaaattcaagacagattctaaattttaaaaattttccaatttatgttccaggaaatttaagtgaaagggaggaaagctataactaaaatttactaatggctagtagtactaatatacatactttaaaaaaaaattaccaaggaataaatatttaggatgctccagagaaaaattatatctgtaagcagtttcaatctcctcattttatgaatgttttggttacttcagctattaagttttaatcaagctaaaaaataggcctttttccttccatcttaagaatgtcaatgggatgaggagggaaaagccaaaaggtgggaggaatagagtaacaaacttttaatcagctagcatgatttaaaggacacacacttctgtcctttaacacagcatgtttcttgaaaataggttactagttcctaaaaaagaacacaaaagctatttacaggctgaaaatctaagattttctattctcaaattttcatttagagaatacattttgggacaagagggaaaaactacattcattttaaggggataggaaaagtacctgatacgatctaatcgtaaaacatgagatcaaagataagaactgaaaatgcaacttccaggcaccaggcataataatttatatagactctaaaaaaggattaactttaagtgtattacttcaacttcactccagtccttagaaacatttaatatccttgggaaagagtaccatctcttcttccattgaaggccttgatatttatagaagatattgccggccagacgcagtggctcacaattgtaaccctaaccctttcagagactgaggcaggtgaattctttgagcccaagagttcgagaccagcctgggcaatgtggcaaagccccgtctctaaaaaaatttaaaaattagctgggtatggtggcaggcgcctgtattcccggctactcaggaggctgaggtaggaggatcatctgcgactgggaggttgaggctgcagtgagccattatcaggccactgcactccagcctgggtgacacagggagataccctgtctccaaaaaaaaaaaaaaaagatattcccatcaaaaaatactacgatatcctaaaaacaaagttagaataagtaaaaccacaagcttacttccatggcctgaaatgtctttggcaattctattgctaaaaataaagcctaggagaagccccgcatatttgtttttatatatatttctttttttttttttttttttttttttttttgagacggagtctcgctctgtcgtcgaggctgcagtgcagtggtgtgatcttggctcactgtaaccttgaacttctgagttcaagtaatcctcctgcctcagcctcccaagtagctggtactagagcctggtactatcacagccacacaacaccatatctggcttttttttttttttttttgagatggagtctggctctgttgcccaggcttgagtgcagtggtgtgatctcggctcactggaacctcttcctcctgagttcaagcgattctcctgcctcaacttcctaagtagctgagattacaggcgcccgccaccacgcctggctaatttttgtatttttagtagagacaaggttttgccatgttggccaggttggcctcgaactcctgacttcaagtgatccacccacctcggcctcccaaagcgctgggattataggtgtgagccaccacacccagcctaacgtttttgtttttgttttttttactttctgtagagacagggtctggtcagagactggtctgaccagttcaacctggtcttgaactcctggcctcaagcactcctctctcctcagcctcccaaggtgctgggattataggcatgagccaccacacccagctgttcagatattttttcaatcaactagtacggaacaagggctgtgccaagtggctttgtaatcttagcactttggggtactgacacaggaggatcccttgagtccaggagttcaagaccagcctgggcaacatagggagaccctgtctctacaaaaatttaaaaaatttttaaattttaggtagcatacacctatagtcctagctacatgagaagctgagaaaggagaatcacctgagcccaggaggttggggctgcagtgagccagaatggtgccactacacccctgcctgggtgacagagtgagaccctgtctgtaaaatcaacaaaaaaaccccaaaacatgaaacaccccaagaaaggcagggctgaaagtcctaacagtgcctgtaagtaataaagagcaatgcactatccctgaaagaacaagaagctcaataaaacttgcaaaggatcattaaatctaatatatgcctatggaaacaaaaaggcatttaaatcgtaggcagttataaaagcataggtttattgatatttgtgatctaaaaatgcggcttgatgccccttttggaaaaaagatgatgaatatgatgaaaagacagtcttaagaataaattgactgggcacagtggctcacgcctgtaatcccaacactttgggaacccaaggcgggaagatcacttgaggtcagtttgagaccagcctggccaacatggtgaaaccctgtctctactaaaaatacaaaaattaggccaggcatggtggctcattcctgtaatcccagcactttgggaggccgaggcaggagatcacctgaggtcaggagttcaagatcagcctggccaacatggtgaaaccctatctctactaaaaatacaaaaattagccaggtgtggtggcacacgcctgtaatctcagctactcaggaggctgaggcaagagaactgcttgaacccgggaggcggaggctgcagtgagttgagactgcaccactgctctccagcctgggcaaaagagcaagaccctgtctcccaaaaaaaaaaaaaaaggaataaattaactgacaattagcttttatggggacaactgctccaggtgaaaggaacagagctgaaagcaggcccagccgggttctctgatgccagtagcagtcagccttggcattataggtcagctgggtgctttcagaactttcttaatttgttacattataagtcgacagctagtaatcatctttcatttagggtagctggattaatcccaacatttgtattagcaattcttctgaaaatccagccatcttaatatctttcactaaaatcaaatataaaaagcaatctctcatgatctttatcgatggttatttttggcatacttaatggggagtatgccaaagcagggaagccacagtaaataatgaaaaagcaatatagcctctctaaacttctgcaccactaaaaaagcaaccagattggagttctttctaagcaacaagtaggtaacaaacgtaatacaatcagcatttccaaaagagcattttataataaattttcttttttaattcttaaatggtactatggtatcaagcatggaaagcactaatgttagaagtgatacttactaatggtaagtgccttacttcagcaaaaataactctattaacaccggtttgactgagttcaatcgagcctcccacctcagcctcctgagtagctgcaactgcagacacatgccaccacacccagataatttttcattttttcgcagagatgggatttcaccatgttgtccaggccagtcttgaactcctgagctcaagtgaccgaaccgccccagcctcccaaactgctggggattacaggcgtgagccatcatgcccgggctgatttgaggttttaaatgacaaacagcagaaccttcgctgtttttaatcttaacttttaaattattttcaacacctaagcaatctactgattagcatccatagtcaaaaagtaaagatcctctttccagaaaaatgtacatatatagaagattttgccagcagtttcaggatgttcacagaccctctaaaactttcaagagactttatggatttcagattaagaatgacgagaatttgggccgggcacagtggctcacgcctgtaatcccagcactttgggaggccgaggcgggcagatcacaaggtcagcagttcgagaccagcctggccaacatagtgaaaccctatctctactaaaaatacaaaacttagccaggcatggtggtggacgcctgtaatcccagctactccagaggctgaggcaggagaatcgcttgaacccgggaggcagaggtgcaatgagccaagaccgcaccattgcactccagacgttgctctgggcgacagagcaagactccatctcaaaaaacaaataaataaaaaaagaatgaccagaatttgtataattcaagtcttacaggataatagacaatgcttattgtatgcttgctatatgctaagtatggtgctaagaaatttaatgaattattttatttaatttttgcaacaaccctttgtcatagatagtattattattatacccatactacaagtgagaaaactaagagttagaaaggttaattaacatatcctatgttaccaagaaacatgtcaaaagaaaaaaagttccctaatggaaaatgcaaaacaaaaataatgatttaaaaaaaaaaaaaccatacaccgggcacggtggctcacatgtgtaatcccagcactttgggaggcctaggtggggggatcatgaggtcaggcagtcaagatcataccggctaacacagtgaaaccccatctctactaaaaatacaaaaaaaattgccaggtgtggtggaatgcacctgtagtcccagctactcgggaagctgaggcaggagaattgcttgaacccgggaggcggaggttgcagtgagctgagatcatgccactgcactccagcctgggtgacggagcaagactctgtctcaaaaaacaacaacaacaaaacatacacagccaggtacagtggctcacacctgtaatcccaacactttgggaagccaagatgagaggatcacttgaggtcaggagttcaagaccagcctggccaataaggcaaaaaacactgtctactaaaagtacaacaactagccaggtgtggtagcccacacctgtaaccccagctactcaggaggctgaggcaggagaatcgcttaaacccaagaggtggaggttgcagtgagccgagatcatgccactgcactccagcctgcatgacagggtgagactctgtctcaaaacaaaaacaacaacaacaaaaaaacactactcaaataaaacagttcaaaccacccctacaatactgtcctactatgtgtgttaaccactcaaaagaggtcaaacacacaaaaagacatggctaaaagaattaaaatgctaactaactaatatcctcactagtccttgatcttctagtgaggaagaggatgggtgcagccaacatgagtcctctgctgcagagccacacccttgacaatggagataaatgtgcacgtatgtccccttgaaaggttgcacctttcctgctttggctagagcctctgtcatggtgccacgtggtttctatgtaaatcagctggcgggtagaatcatttctgaccagtttagggaggttctgggcaatgttatctttgccttcctacctccctcactactccctccccaccactgaacacagtactttttactagaaaacatccaagctaacagattctcagtacaagtaaaaatgttgcctctccagcagatagaaaaatgaacagataagttaaaacttacaaaattaaatctgatgtttattccatcattagtgtagaaacacagatcacatatacctgaatatgcaaagaaagttaaattatgatgcaatcaatgctatcctataaaaactaaattaacaaaaatagtctattagggaagacatctggtgtatcatggcaagaaatgttaatgatattgtctgcaaccctgtaatcaattttttctcccagcagctctctcattacactgtattagatctgtgtgccttgcaggatttatgagaactccacatatggggaagctttgccaactggatctgattcagatccagctcaaatgactttggcagcacaaagcatcattaaagaacaatcaatacagttagctttatgtagcatcatcttgactgaaagaagatttatcctttcactacagaatctcttacacctacatataatgtacccaagtgctccaccagtcatgaacttatttaaatcatcagtagacacaaatatttttattgctaaaaaataaatactaatcattaattctaatataaaaagtttacaaaaaaattaatgttattatggggaagacttaaaatccattcagcaattcctgttgagtattacagtaaataaaagtattaataatagcatccacattgattaagaaaatatcagcctgaaagtaaaacctactttttagatatatgtggaaataagacatatcggtaaataagacatattggtaattgctaaaggctgaagctttagaagtaggtagtcacattgggaatctactaatttgtcccgtaagatgtcagtctttctctgggaattaaaattagacttttatctatactacactgggttctgtcttccactgtaagacagagaattccaaggtttccataatgtgaaacccccatccctttttttggtatgacccttgagtaattacatcagcaaatatgtaaacgtgttatgctgttgcaacaattactcctgatttggttacaattatcaatatatcatctctactgtcttggtcctcttcatcttacccatgaatggcggccctagccttctacttggaattttcaccatctttccccgttccacactgcaaactgctacagtcaatcttcttaagcagtggcctgcaagatggcttgcctagagtaaaaaagcttacacaggctctctactgcctattacacaaaatcttaactttgctaactttgaagatcctctataatctagccccatttatatctccacatctgcctcccaaaatccactaacctgtgctcttcagtgacgtcctgcgggtcatcttctcacaactcccagactcgtcagcctcactgcctgcgttgcttataaggacaggctgccatgtacacctggaaggctcctacactctgcctatccacttcttattgatgtatgaaaaacatacccagctcctcaaaacctacccaccctcacagaacttccccaagtgccacagcccatctggagcactttcttttctacgacccaagatattaatattctacactgcagctgaacaactcaccatatattgacagtatcttgcattgtgtgtgtctaagtgtgagagagcttgctatcctcttgtattatttgctaattcagtatgaactggggcaccacagtcacttctttacactgacgtcaatgtaactgcaactacacttctttcatattaacccactagtcattcagaataataaatactcgactttcagaaaacactaccattaaatcctccattaagtcctaccattacaggaaaaaaaaggaagacaagtgtgaactttcctaaaaaaagggagatgtactaaacgataataacccctatgatcacccacatgggtccctgtgttttaagggataaagcactacagatacttcatcctgctgcctcttacacatccctcaggaccaccactagtaacagaggaataaccaagggatagccgttaagaagtatagctacagcccgacccaagcctcttgaagggcatattctgcatctagcactggagaaaagcctcgctatttctgagcaataccctacaaaatgtcacccgagaggacaacacccaaaatagtttagattggtgggccatgagtcccaatgagcctggggaaacgcacattccacacttgagctcaaacttacccccttttttccccatttcagttgccaacatccatactcgctgctgattgccagctcctgctccttgcagcagcccagcatgctctctgctggtgccaaaatacccttccaccaaaccccgctaacttctggaactgtcctagaggggtaaggcaagtcccgtattttgcttcctctgtgcatgtacttgttactcctttaaaaacacatataatacagcacattttaaaaggggctctggggagggaggtaatattcctattttataccctatgggatataaaatactgatagcttttaaaaacgggattctccttacccctacaggccctctcccggcttcagaaagatgctgtggtggctgtgatgccaccggcagagagcatgctggggggtcacacaaagcaggagttggagatctgcaacaggcctgggagttgtggacctaaaaaagaaaacagttttaagttaacgtgcccaacgccccatcatgccctggttattaggggcacgcagcacacaagtcggtatctgcaaaaactctttagcagatgacctctgaaacctcagataatttgttctaccactaaagttaacctttttgcattaatcaaagctgttaccttatttcagtgtgaacaaacgtatgacccttctggctccacactttaatccaggtcctatcataaagcagtatggtgtgtgcccctcaaaataaccaagttaagatgtgagatagtgccaaagcacagttaacagcaacatgctatgcttataataaaaacagaaatgcaatggtgtcagatacaaccgtaaaatgaatcacaagtggacaaactgagctttcagaagagtttctaatgacagaagctagagacataagacatgtacttaataaggaaatagggcatttgggtggccaaagaaaggccctgccattttctcaaagttcaagtttaactgtataaagctgaaggcaaagtaaatagacaaaggccccaaaacagagggaaaaagacaatattcacatgagttataattttctccaaacgcccacaaggtgagtataatgaataggcacagagcataaagttccagaaagacattacttatttttataggcaaaactagtttagtatgtatcacgtgtctttttaaaattaactttgaaaacatttaaaaaccaggaaaaaaaagactatagagcaacttctgaaagctagcacagtatacctcagataacagtttgagtatgttccttttcaaatattttagacagcacataacatttttaaaccaatttcatgtggttttgaatgaactaaaaaaaatccataaaatcccaatacttatataagaacctgtcttacggttgtctaaaaattacagatgaacaaccttttaatattagatcattattagggtgtcctgttacacataattccctttgaaaagcaaagagcaattaacaactttctgtaaacaaagattttaatatatttcattatctatttttgtaagtctcttaagctccctacacatagacacacacacacacacacaaaacaaaacaaataccaggaaaataagctaatgttcagaatgttttatcatgatcattttcttttctttttctaaagatgaccatctagagtacatcctgggatctacactaaaatttctgtgcagtcagtctctgattctcatggcctcagtgatagtatagctgacagagtgtcagtagccacaaccttctcaccacacaccttctccccaccatcaccaacactgcaaactccaaattaaagattcaattgtgcacttgaatgtacagcatattcaatattttttgccagaagcatcaaaataaaaatggacttctggataatctcttccactaggaatatgactgcccaaaccactcaaatccttacattcaaattaagggttttaaatcaaaaacacctggtaaagcatttccagacactttggcattattttaaacatgcaaatagttcaagtaattattaaaacattttatatattttaaagaggcattttttcaaaacaagtcattgttctcacatacgaaatgagaaaactttgacagtatctgtttccctaatttttttttagtacttctaacaggtttttcttggactattgagttggttcttaatgcaagcatccatatatacatacaaattacaaatttccaattgaaaagaattaagtttgaacaagactttaccaatattcttgcacagtagatggctgcaaatatcagattgtctcaacctttcttaagctcctttaaaattagaatacctagagttttctgcattgaaaaaaatttcacatatagataacaattttagtaaataacattttcagaaatatattttatggaaatatatataattaaacaaaactttttcaatagtttcttagagtcccttgacccaagtaaattagaagaaaatgaattacccaacctcacagtagtagttaaacactaaaacttaaaatcccaagtgcccaaccctgactggcagccacgagtgaagacaaattgctggcaagctcagaaaatggggccagcaaaatgctgggattatttattcccaaggcctcattttgatttccacttatgttaataccactctgtccactagaggttgacatcagtatcatgcaaaaaggatgtggtcgttcaaaaaactttcaacaccattactccataattgtggcgggaggggagtatagatatacaacctcctctgactcagtacaccaaactcagggctaaagaattccatcttgcttgatgcggtggttcatgcctgtaatcccaacactttgggaggccgaggcgggcggatcacaaggtcaggagttcaagaccagcctggccaatgtagtgaaaccccgtctctactaagaatacaaaaacatagccgggggtggtggcaggtgtctgtaattccagctacttgggaggctgaggcaggagaatcgcttgaacccagaggcggaggctggaaagagctgagatcgtgccattgcactccagcctgggtgacaagagtgaaactctgtctcaaaaaaaaaaaaaagaattccatcctacctcttaactcttaaagaattaaacaaaattagaaatcacaaatttgtatgtgaaaaggccacttggtccttggatataatagctgaaaatacttgataacgaactttaatgtaaagtttttacttcattatccaacactacacaacaagtcacaaaggtgtaactgggtgatactgacctttttatatggtacaagccaagaaagtaaagagaagaaggagctatagaaagaaatactcaattttgcaggcctaccttgaaggactgtcaaaaacaaaaacagaaacaactgatgtgtcacacaggaacaaatcatcatagcgtaaggcatttttcataacacatggccttttctgggaggttcacacgtatactaggccctcatttatctttgctgaaagtcagtcatatggaaaactcaaaacaatataatgatgcctaaaaaatgttatgactttggctacattcattcaaattcgtgaagaaaacaagaaactgaattttcttcaagtattttaaaagaaataaagttttattatttctatacattacacactgcaggctaaccaaaggtaattgagtagacttctttggcttgtttaagagaatgttaatttgtgttgatgtatgcactgtatcaaacaactactactaaagttttttaaaaatacttatccagtgaatttattccagttaaatgttacttcattcagtattcaataaatacttactgtggacattacagccagccaatgtgctaagcacacaatatatacatcagtgaataaaaagcataaacctaaggtaccaactaaacatcaacatcacaatcagtgtcattctatggggcactggacactttgtaagtctgaccttttaatctaaaaacaatctacttggcaaggtaggtactttatatcccaacttcacaggtaactaaagaaagttaagaggcttaagtgtatttcctaaggtcaggaaagatggcaactgatggatggagtatgtgaactcagacaacctgatgtcaaagtccgcgctctgaacctgggcaatctaccatccctcatctcaatcccagaataacagatcctaaattctgaattagccatgttcaaattatgtgcaccttcctgcccaccccccaaccaaaaaagggctctaatgcaagatttacctccttttaaacgaatgcccattccgtgaatgtccatacactacaccttctgtgctaagtggtaacagccaagctgggactaaagaaatgcagtcgataatgcgtaagtctgataattaagtcactgtgtgtacacttgaatgtgtgcacaaagagtatgtgtaattaagtcgctacctgatgatatctcccagcatcatctatggtcctaataagacataattactcatcctcagtaagtttttattacaaaggaggagaaatagcttcttgttacttttaatccatttttaagaaaataaatttggtggagggcgggcaatctcaatggcaagtggaacctaagatgaagttaatttctctgcagcccttctgctgttgtactgtcagggaaggcatgaataaagggtagtgagtagcaaacaacttatgagtacagaccaggcataagagagaaattccaagtgtttttcctccaactgctcacatttgacaatgaaacaacgagagggatatggtattaaacgataaataacttggcccccacattcacagcaataatggaaatgtgcattctccaaggtaactagtagtatgcatccttagctattccacattcagaaccagcatttagaaagtaggctgttagggacacaaatgatacagcggcattctcatctatgtggagccgtaacaatatgtcgagcccagctaaccatcacctgagacactttaacatccctaactatcacccccaactctaaggaatctctgtatctggcttaactttaaggacaattttccaagttttaataaaacagttaaggaaccaaaatgaatcaatatcattaacccaaaatagtacttatagctacatatactacctagaaactcatttggtataagtaacagctgaaacacctatgtaactttaggaaaccaaaagcatgttttcctctactgtatgaatgacagcaatgcaagaatccacactgaatttccatggagactattacaggactgagtttgcttacttatctgtgaataaagaaaggtagtaactgctacaaggaactacttactatacaaggaactcctcagtgctatactgaatgaaaattagtgtctccatgaccttgttagcattctcggactccatgattacttccagatggcaaattatttgtattatacttcttaatgcctgggtttctataaaaatatgattttattgtttttcgtaaacaaacaaatcatttcttttagaactaaagtgaatgcccttcttgtcaatcctattcagaatgttctccaaagaagactgacatccaataatgccacaagttgtctgtccacttagaatctaagatcactgagggaatgaacaatattttatacttcttcagtctccctttaggtgctgagttccataaagaacacaaagcaggtattcagtaaatgcctgtggaagtccctgattatagctcaaaacatttctatttgcactctgtgatataatgctcctcaatgatattgactcattcagaacaaaaccctaaaagtaagtaagtcacatggtgacctataaaagctatgggagggcagcagaagggttggagatattaatctaggctctttccattgcaattcatgaagagccactcaagctagccaggtgagagctctttactcagagcgaacaggataatctaagaatcctgtgggaagaacatcagtgcagtgggacccaggagagtcaaggaagagacggctgtgcacacacttcccttggcagtctgctgctcttcccacagcttgcctgtcctctgcttttcccagtttcctaccctagcaagtgagcttgcctatgccagccctaaccttgctcttgtcattcaggtaattcttttatttttaatttttacagatatattaggggtaattcttgaattatctattcacctttcccctctactaactgcctcagtctctcagtttctcaactctaaattctaaaaatgaaatttggctcaattaatcttttcatgccaggccacaaggatcacagactgtcattccgtattactagtccttcaaaaagctaaataaagactttgccagctattttactatttagttcagaaatctacagtgcgaagcgacctttttaatcaacaatacttctttctcctgcttctaagtacgtgctgtccctaattctaccctgcctcttctgcttgcctgagctcctgcttttgactacttcttccataaatactttggtcagcgcattcaaacaaaatcagacctctccatttgtaaataagcccaatcaaatgaatacttcctaagagaatgaaagcttcctaatagaatacataattcctacctttaaaacctcagctcagttaggaacttaattgcttgatactatcatagcctccacctaccctgtggaagtgtgggctcgaaatacacctaccagtgtaggacggtggtgtccctatgtgttttgatggttgaatattaataaagcagaagccatggatcttatccccataggcaagataaccacacaacctatcatccacactcaagacatttttgagagtgaaaggggaggctgtttaatagtctggcaggacaacagacagggatcaggacatagaggcagctgtgttctataccacagactcgattctaagggaatgcagcagcagagtagagaagacaacccaggtccccacataaaatacaaagacccttctccttatctcataaagagctatttcatgaaatgtgacccaaggcccttggttcaataaactgccattattctagcctcggtgactggcggtagatgtctcctcctccccacgcctcacctcattagcttttgttatctttaacatcgtaatcgtacctactaatgtgtatcataacgggcattcacccagttacttttacagtgcccaaacatcctttatacacaaaatttcaccacggcaaagggattctcatttatagtataaacaatgaaacacatctctcagttataaccccaaaccaactttttattttatgattattaaaaagataaaatacctaattactcaacatttcaaagccatcgggtttttgtttctttcattgctccactagtcatgttatttgctgggagcaaaatcaaattcaatttcttcttcttcttaaaatcttgcagagaaacaaagcttatttccttctgctcatcttttacccttatagcttcagtaaactgaaggagaaaaaaatcttgatcattctcatctgattatcttttaataagtacagagaagtaagaaaataagaaagtggaaataactatatttattcccagagcaaatatttcatcatctgttgttcttacacaacaactatgaggatgtgctgaatacagaacctcaaacaaaaacatgagaaacagcagtgtgtgatttagaaaaaggtatctaaacatactgcaccctacttcccacactgtttttgtagacagctttaatgtgttgtattagaccaatactgacaacagaagctttagcttttattgctgttaataccctgagcaattaccgtaactcagcaggaacctctgcccagaacagcaactatcacattgtaatcagcatttcataagagatgctgttcaaacaggaaggcacctgctaatgtgcaaaaactgtacaaagggggctcaagatctaataggtaaaataaaaatatttacaattttatttcacagctatatatttttcacggtgcactgatgtttggtttagtaaaaatcacacaaaaagacaatgggcaggaaaagggcagtagcagcagccactaccaaaacaaaactcttcaggaataaggctacacccgtatttcaggtgtcagtgctgtatctgtttaaaaaaaaaaaaaaaaaaaaaaaaacacactttggaaggaaagatataataagtagcaaagacctctaaaaatggtttttaaaaattcatatagacataaaaactggatagaaagcatttgatttacaagattaaactgcaaggccaccttgcaatgcaaccaggaaagttaaaagccgcttatcaagaatagatccatcttagaagtaaatagcacatttgacttcatcttaaaacagtaagcatgcaataacttaagcaataactttttaacaaagaaaaataaaatgtgattttttttttttcttactgaatatactactttggtacttgggccattaaaaatgataaaaaacaaaggagatgcagagaaagatcttttcaaactacatttctttagactgaaatatcacatacaacatatgtcagaacacaaatattgtcaaattacaaagggtgttggaaataagagcattcacagatagtgatacacatctctacaaagctaaggaattacgaattctctaggcctaagagcacagacagtggttcacaatcttcaaagtactaggatcccttgtaagatcaaaatgtttcaaaagattcccaaatgatactacttcagtagtatttcaaataccaattgtttgaggaaaataacaaacaaacagtggttcccggctggcatggtagctcacgtttgtaatcccagcactttgggaggccaaagcaggcaaatcacttgaggtcagaagttggagaccagcctggccaacatggtgaaaccctgttctctgctaaaaatacaaaaaaaatcagccggttgtactggcacgcacctgtaatcccagctactcgggaggctgaggcaggagaatcacttgtttccgggaggcagaggctgcggtgagccaagactgcaccactgcactccagcctgggtgacagagcaagactctgtttcaaacaacaacaatgacaaatagtggttcttaactgtgtattgcttttaaataagtgaaatttttaaaaatcataaaagcatactgaaaacaggctgaaaaatcgttgtccagacgtgtgagatcaatttatttacatcaagcttagcatgtttatttgcagacctctgccaaatctctgcagacatccagggatccaaagcctaaagtgtgagaaccactggccctaaaaaagcgatttcataatgaggaacatcaacacttatatattcaggaagaatttttaatgagaaagtacagtagctatgtccttacttctgcaacacatgcactaaaactggaaagaaagtataacaactttaccacgcccaagccagacttctttcaaccgctaccccgggaaacccccacaacaatttcaacatcatatactccacacctgccgaaatattgaaggaagtgacaggtttccactggaaactattctctgacccgtttatattatttcccctactcatcaatttactgaatttactttacttcaggctcttaacaatggctgagaagaaacaagctacttcagaaattcaagggactatctgaaattgtcaaaagttactaaagggataaaaacttcagaaatattgtttacaatataagcattatgagagtaagtgttacaaagctgaaaagatggaactagtaaccctcatttcagtgctactgccacgaggcagttagcactcaaaaggtgaactggtaaccacgtcaacagcgatggaggaacaataagagatagccaatggaactggaaaaagagagaatacagagcagagtgaacagcacattaaaaacgcttaccagtttgaagtcttgaatgctacagatgaaatacggtgtgtttggcctccgactctcgatatacacacagtctttaaaagaaaaagaaattttaaaacaatggcatttacctttaaggaacaaagacagggcccataaagccactgcataaataaataaatgacaaagcacatatcttttattgtaaattttttccaaaagatgatattaaattgcaaatatctttaggctaaaggaaaactgccctttggttctttctgattatttttctaataatttaaagaatctgatgaagcctaaattattttcttcagagtccctgaagaagaaggggaggagtccaagggattatccatattcagatgaagacatttagataaaagaaaccgcttgctcaagatcacacatcaagatgaaatcttgagtatcttattcagatacatgttcacatgtcttcgaaaaagagaaacggctttgccacgtgctactatatttgtaataaatattttgtgaggaaataaatgaaatacgcaaagatgactagcttgaacatgctattacaatgaccttttcaactaatcaaaaagagaaagaaaactaatctcttacagacaatttgccattacattgtaccctaaacacattttattttctaactgtaaacaaaaacaatgccactaatcagagatggaataaagtaaaccaaattgcattttcttcagggaagaagggtgctttcttaaattacatttgacatggcagtggttggaaaataatttttgatgctctcaatgactggagtgtaaagcgttgcttttgtttgtttgtttgtttgttttgttttgttttgttttggctggtctcctctccaactcctgggctcaagcaatcctcccacctcagccacccgaagtgtcaggattacaggcatgagccaccacgcttggccaaggttgctttttaaaatgccatgttaagacacttaaataaaaagcaatgattttaaggaaagcagtggctatagagagagttaacctcctcctacccccatatcacaacctaagatcatcataaagcttaggtcaggaaagtctacgtattatttactgaaaagtaaaggcacagtcaatgaaatctaggaatagtgaccacaatgcctcattcattcattcattttgcatagacagggcctcactatgttgcccaggctagtctcaaactcttgggctgaagctatccccctgcctcggcctcccaaagtgctgtgattacatgcataaaccaccatggccagcccataatgccattcattttatacttcctctggacccttcagaatgagtgtatcttacaataattcagatgcttgacaacactggcaacttcctctattgtctcatttgtcttatgtgttgagagcgaagaaaaagcacagaagtagcaattgggagtcatcacaaaccccaacagaccaactaagatgatcaggaagaaagtcctcacaaatgagtacattccaagaaactttctgcagaacatcaggatctttgtacctacccaaaaggcactctagaaaaagaagaaatctcaatgccaactatttaggcattcagaattccccaactgatttctctactcaaagatggactcaacagagatttaatccctgaatccacgtaaaacagtagctcaggaatgaactgttgactaagctttccctatcttgttccaaggtcccagatgctaaataactgtgcttcagcattcaggcaacatcaacttaacatgctaatcatcttaagggacaagcaagagaattcttcccaccacagtagatcattctttcatactcctaccttggtattcaagtaaaaacagaagaaactcaattccctagataaaaactgtagctccaaattacacaattttggaacaacccaaagttcttagtttcctgtgtttcagtccctgttatacccactgccagcatttcagatctctagttatcaattatttactcaccttactcaactcaacatgccctctcctttctgttgcttcctacataccacatttcatgacattaacaccatcatagcctagctactgacagagcaggagcatcaccatcttggacaagcaccaccattttcaagttccccttgatcaaaaactgcctaaatccaacccaaagggcatcagcctaatggctaatgacatcatgaccataaaccacaaatgacatctccaaccacaaacattccaatcctaagataaacccctctctgaccacagacatgccagcccagagataacgtcccctctggctggagagatgtcagccccaaaacattccaaccccacaataaacttctcctccacacagaaacattccaagcctgtgataagctctcctgccctaaatccttaagtaatactcttggtctgtaatagacagtgctcctgaccaaaatcagccagaagcccctctccggtttattctccaaaatgagcctgtctttgactgttaagccacttttcgcatttctttcctcattctttaactcttacagctactactcactggcttcagaactaataggtccctttctaattaattgcttctaccttcttaaggctcaagtgacaaacttactgcattcaatggtctggtctcactccacaccccatcttcccctaggctgcattcactacaagaaaccccaactctgctcccagtctgcaaaactcttcttctctccttctactagcccctgatcacaccaaccttagaattagttatcagttccatatggagtaactcctcatggctcctctgtaactaaatggcaacacctcccttcttttacataacattaacaatttacattccttgtcaagttatttggcagtaaggtggtctgcactgtccactaacaattactatcaatcttgtaggctcagagaaatgtactcaattctaccttccccgtactcaccaaggactaatgtctgccattagtgtgggggttaaaaaaaataaaaaataaaaaataaggccaagtcaggtggatcacctgaggtcagttcaagaccagcctgaccaacatggtgaaaccccaactacactaaaaatacaaaaattagctgggtgtggtggcacacacctgtaatcccagctactcaggacttagaggcaggaggattgcttgaacccaggaggcggagatagcagtgagccgagatcacgccactgcactccagcctgggtgacagtgaaactgtctcaaaaaaaaaaaaaaacctgaaataaatgggagacacttggaaagcaaagactacgcatgtttttctttttacacaaagaaaagctttatttatatatactttaaataatccataggatcattactacacaccatcttactgtgagatataaagctaacttacatacaaaaaagctttccagaaaaaggaaaaagaacctatgttctttcatttcccgctgcaaagttacattcaagaaaagtgcctgtaaatacactaggatatagctctgttagagaaggaaggaaaggaacatgccggtatgtcaagagcagccaagcacatctgtttgcctaaacacttctcagcagttgtactggagctgcctcacacacctggcctgagaaatgctgccatgagggataagcatgagagagatcctcaaccggacatacggaatgaccactgttacttttccttagattaaaagccacctctttttgtttaaaaaacgaccatggcaactcaaactgatccaaagctatgaattcatatcagacagtccaatacacaaggttaataatctgtaaaatgggtgagtgcatcaagtgagctctatcagtactttgaaacacatatatgaaaaagttagagaagctcactgcaaaattaagtgacaaaacttacagttttgtaagccactggagggtggctgttaaaaaaaaaaactttacatacatagtcatgaaacacagaatggctaagactggagtaataagaactaaaaatgtttcacactatgtaaaacttgccataggaatggggaaaaaaatacactgctttgacctgatttgtctaattcatttttaaaatcaaagcatgacgaactattgtacagtcaaacttttctttataaccctctgacaaatattaggatgacccaacaaaaaataaacacaatttagaattcaagtctcacagaaaaaaattctactttatattactcttaaaaatattcaaaacaaggttcaattaaagccaaattctcatataaaaagcatttccccttggctcattaatcaagcagctatttaagaaaataatttatataaatgtttatagcacaaaaataaagtgctttatttgaaaagggaaagataagaacgtagtcaagagcaatgttaaaatctcagttggaatatatgcccagtaatcttttaaagccaaaatgatttggcaagattttcatgcaatttatgagtgcatgggatgtctgaagctggttataaaattggttttagtcagtaggatcaatgattctcaatctgaaaatctcccacggcccccaagcactgcatatacttctttttttattagaaagctagcagttctgaaagaactgcacaaagctgatgtgatccaccaaatgcataatgcacatcttcagaatcacccatgtaaaaacacgtatttaccagaattgagcaaacggttttggcagggcaagtatatatattttttaaatcttcaaatcagcatgcctgtaatgggccagaaaaatgagtgaggctattaccatcaatatcaattagtccaaacaacacatgataactaatgtgtctttactagggatgtctagaaatgaaaccatgggtctaggttgagacctactctcttaacacctaacctctgtctgggaatggatcacaggattaagtgacctcaaatccttgtgaacagggagcaacaaaatccgtaatttgggcaatgatactgaacagaggtatttctggctgtttctcacaacctcagcatagcttcatgtccaaagatctattgtgccatctgtaaacaacagagcatttgctaagctggggaaggaagtcagccaaaacgtgaaggcagattctcaaggcaaagaaggccctctctgctttttcaaccctcagcaaatcagcaggtttatgtaaatatagcaaaagcacagtcccctcaagggtaaaaatctcagtctgaagcattaggcagtgtgtcattatgaaacacaaagaacctgtcagcatcttttctgacagcctcctacagagcagagtggacacttacctcacccactaatttagcaagcagtgccacacacgccagtactaaaactgtggtcacaacatatataggcaatgctcagccactgctccacctcataaagaattttcctttccatcaatgtgtctccgcctattaatctttgaaataccttctcatccctttgcaaagcatggcagtgccactctgatataatttccaatagaaaaccccattgtaaaaagcacgcatgaacaaagactttctcacaaagagatttctcagagaccaagctgggtggcacagcggtgaaatgggaagttgactctcaggactgcaccgctcttctgctttctgtttctcctctacatgactcctccaccctcaatgcttggaggtaacagtcaatgaggtacagtatgttggtctaatattgcagaataaaaaatccacaagtatctctctacagttaaaacagatgtcctccattttccaagacacacaaagagtgtatatgttatgtgtgtgtgcatgctggaaacaacgctgaaatcccggtacccaaattccaatccagagtctctggcatactgcatgtcctccaacaaaccctcccagttctagtctcccaaaccataaaacagccaaacccatcaccattcctcaactctataaacaatgcactgttcttcatagtaaacactcaaaaattatatgaggaacaaacaaactaaacagagacatggtttaaaaaaaaaagaagagagagatcctagcaagaaagttgctacgctctatcaatatgaacaaaacaaatgctgtattctaatacttctttaggaaataactcgattgccaggtaacctactttagtttcctgccagaatcttttgctgtgaggggtactcatattgactgtaacactggagaatttaaaagggaaaaggactgctgctcaggaagctcaggtgacagcatcactggagccctggagttcaaagctgcagtgagctatgatccagccactgtactccaatctaggtgacagagtgagaccctgtcactcagtcatacatacatacgtacatatatacacacatacatacatggaaaaggaaacaaaaattgggaaaagtgcacctccataaatgaagccttcccagtccttacccttactctgtttatcaactgttatcaaaatcagctgcatcatcttaaggattctaaacttggtgggaaaagatcccagataacatatatctttgttcccctcttttttaaacataataattacattccatgtattgaaatgtctatagattcccaagtagtgctacaaagaaagcctcactaaacacagaacactaaatatttctagcaaacattcatctgtctttatcctcattgctaacaaggacagttaaataatgagaacaaacaagttgaggggaacaggtcataataaactaaaagggattttgttgaaaattcctacatttctcttttctcctttaaaagtcaggaaatctcccaatgtattgaaaacttaaaaactgatctcagataattatcttcccaactttaaaaaataatgctgggccaggcatggtggcacatgcctgtaattccagcactttgggaggccgaggcagaggactgcctgtgccctggagtttgaggttacaatgagctatgactgtaccaccactacactccagcctgggtgacagcatgaaaccttgtctcttaaaaaaataaaaaataacagtgatgtggatgttttggactaactgctgcagcatgaagcatgacccccgcttcccaaatcaatcatatgctatacaaacttgcgaactctgtggaacaagaaaaagcaaaattatcctgccagtagcagaaatcttattagttatactgatatgctaaatattagccatggttggacacttatattacccaagcaaagaacactgtaagcactctcatctccttattttactctgaaaacgttccttaaatagcaccccttgtcagctgtgttggttgagtccctatcatgaaagtgagtttagccaatgtaacatccaagttccagttaactgatgtggatctctatactagtataaaacttgtgttcatatacagcttatgtgctgtaagagaataaaagtaatccaaggggggaaatctattttaaaattcagtgacagccatctacctattgaagtagtgcttgtggcaccacagacacaaaggaagagaacttccaggcttcactcactctttctgtccccttgatacttcagagtatctaatttcctaaagcttaaaaatgcaggtgacaattctatcctcaatttaacgactcatcccctcccccaaaaaaactatgctctgaaccctattaagtagaggatgattactaatggaaatgctgacagatccttaacttaatgatgagaactgatatatggctgaaataatgtacattcaagaaatcaatgcaaagagtccaaacacttctagaacattgtgcccagtatttataggaaaacatcatcagtgacaggtaggctgggtgaaaattcttctctccccgtatggctgacaacaaacaaattgctcgtctgatcttctggtgtcacatcctgcagcgcagatttcaagcaacactgcttgctccttttcagaaaacaatgcactaggagcctgggctttacaataaatgattcaaccaatttacagggctcactggaaatacacaggacaattcacaatgcgtgtgttataattcttatttggcaaatgattttattataaactagtaatccattttctttacaggttttctgctactgtttaatagactgtcagtataatttagatttcatctatttaaactcattcaagcctggctcctgattgtacagtaaatggaacatatttctattcaaagaaattaatgacagttaactgtagtctgcagttctcagttttgtaaatgcaactgttccacagtccaagcatcaagctacaaaatttcccacaccaattattttcctgtacttcacaggcatcttctatttcttggaagccttccttgttaagactaatgtacatattcatttaatattctttcccattcaaatatttacctccaactttctagaaagttaggacttaaatacaaccaaaatgtcagaaaataaaagtttaattgccattctggaaagatgttctactaatacggatttttttaagttagcaaaattcaagattaaaagacatttttaaaaacatactcttggatgattttcttatatatttcaaatcagttacaatgtcaacattaagtgaaatttattaaaagtaggctaaatatcctatatggatttaaatatacaaacaaggcacatggcatatattaatatatactgaattgcttctgagattgatattctgtttaagagaaatttacttatggccaagcttagtggctcacacttataatcccaacacattgggaggtggaggcaggaggatcacttcaggtcagaagttcgagaccagcctgagcaacatagcaagactccatctctacaaaaaaaatttttttaaatagctgggcacggtggcaggcacctgcagtcccagctgcttaggaggttgaggtgggaggatcacttaagcccaggaggttgaggctgcagtgagctataatagcaccactgcgtgccagcctggggaacaaagcaagatcctgtctcttaaacacgcacgtgcgcacgcacacacacagacacacacacacacacacacacaaaaatgtacttctgagtgttagttactagaaatcacaacaatcccgtgagtgatttttcttcttgagtgattactctttcatggaagaggaaacatccacacagctgtgtaagacatgcttaaagcagaaaaaagcatgcaaagatgcaccttaaaagaaacttattggctgcgcacggtggctcaggcctgtaatcccagcactttgggaagccgaggcaggtggatcgtgtgagcccaggagttcgagaccaacctgggcaacgtggcaaaactctgtctctacaaaaagaaaaaaaaaattacccaggtgtgatggcgtgcacctgtggtcccagctactgaggaggctgaggtgggaggattgcttgaccacaggaggcagaagctacagtgaacagagatggtgccactgcactccagcctgagcaacagagtgagactctgtcaaagaaagaaaagaggaagagaaatgaacttatcaaatcaacacccaaacagtaataaggtaaggacccagaatttgctgccccaaactataaccaccagggtcacacaatgacagatgagaagtaaaggaaaaacagagacacccttttcattcagcaagcaaagtctgctcacctggctttgtttctcctctcctatagacacattcaatcaagaccaagccatgcccatcctcacgctgctgctactacaaccgctcttcccaaccaggtcctatcacaatcctgctcaaccttcaggacccaaatgccaccaacttacaacctgttctattcagttatctgcccactcaatgcctattactaacgtatcacttccctaaatgagagcaatttctccccacaaaatgaaggatcaagggctaaaatcctttctactttttttatcttgcagtaccataccactataaaacatcttctacaaagttgcaggcacagaagactgtgctcttgttttattggctgattgttaaaatgctactaatactatagctgacatctaatacacttcattaaattctaccagcttacttgaaatctattacagtgtcagcaggcttcaaatttaattgtttgctttagtttatataaacttgaaagggcaaatgaaacctgttccctgactctcgaaatctacccatacctactccttctctcccttaaatcgttgttgttttcattcgggtttttgttgtcattgctgttgtttgggcaggtcttacttcttctaattgaagtcaaagaataaagatttacttatttatttagagacggagtcttgctctgtcacccaggctggagtgcagtggcgcgatctcggttcactgcaagctccgcctcccaggttcaagccattctcctacctcagcctcatgagtagctgggactacaggtgcccaccaccacgcccggctaattttttgtatttttagtagagatgaggtttcactgtgttagccaggatggtcttgatctcccgacctcgtgatccgcctgcctcagcctctcaaagtgctgggattagaggcgtgagccaccgcgcctggcctgaataaagatactttaagaataatttaaaacatcaagacactttcctatgacaataaatattgagacctcatttttcctttaaagatcttcagcccactgtgaattacaaatgtcattttacaactattcaacaggtattttgaaaaaacaattccacctacacagtaatttccaatcatctatctccttatgattgcaatcatccatctccttatgatacagtgattttgctttctgaaatatacaatatactcaggataaaaagaattctagggttgtaagggattttgtctggtaatctgctgtccacctgtcactttcataatcaaaattagcacagatttcagcaaggtcatagtatttaaagtatctaaatgcttcttgattcctaaaatgagacgagagcttctgtttattgttcaagccctaagaggctctggatgctttctatatgaaaccgtattcacaacagacttcgttcaacaaatgagtgcagctgctctaggccaatataacacttaatgagagtgttgctttagcatgctccttttgtaatctgtaccttggaaaaattacgttttgaacatctgcgaagacaaaatgtatgagaactttgggaggaaaaattaagacttccccattctaaacaaagtatatgaaagaccctttgtcttataggcaagtcttgtcaaggttacattaaaaataaagaatatgaaggattctataaggaaaagaatcataatctcataaaaacattcacacacaaactgactgggcaccactaatgtgccacgtaagtgctggagatgctaaggcgaaaaaaacactgtccttcccttgacaagttcacaatctaatataagaggtagacatggaaacaactgtatgtcttcaattattattttattttatcttatcttatcttatcttatcttatcttattttattttattttattttatttttaagactgagtttcactcttgttgcccaggctggagtgcaatggcgcgatctcagctcaccgcaacctccgcctcccaggttcaagtgattctcgtgcctcagtctcccaagtagctgggaatgcaggcatgcaccacaacacccggctaattttgtatttttagtagagacagggtttcaccttgttggtcaggcaggtcttgaactcccaacctcaggtgatctacccacctcggcctcccaaagtgctgggattacaggcgtaagccaccgcacccggccatcttcaataattttaatggttacttattttttttgtctctgaaacagggactgctagctgggcccaatatttattctccccttcttccttattaagaaggctgggcatggtggcacatgcttgtagtcccacatactcaggaggctgaggtgggaggatctcttgagcccaggagtatgagcctgcagtgaactatgatgaccactgcactccagcctgggcaacagtgtgaatcctcatctcagaaacaaagaagcaataataataataacaataataatattaaataaaatataaaaaaataaaaaacatctggtacacagttggacacatggcctctcagaataaagacacttcccagcctctctaacagctaactcggtcatgcaacaaagtcctagccataaaatataagcagacctataatatttcaacttctggaaactgaatcctgaaaagtggaagccttgctcttcttactcttcctagtagtctgaaggcaaatgtgtgggctggaggtggagcaggagatagagcatgggagaacaaagagaatggaggccacatacaatggagtaacagaagctttgcctgtagctcaagaaccaagccgagaatccacacctcctgattcacagttcagtattttcggccactttactcaaatatttttataaattatttttaaatcggcaaaatatttaaatttcatccattaaatttaaatttctagatgccctagtggcatccagaacacatattttggggaaaatattctaatttttttaaacagaaaaagctaggaacagatgatgcattaaaaagtagaacacagagctcttaatttagaatgatcaaaataggttgattcaactattaccttctcctaggattatgaatcaacccctagcagcagacaaagtcacaacttcctcccctaagagactttacagtgaagtcaagttcctagcacgactctactataaggttgcacaagtaggaataagtgatgttaacctctcctgcagactgcctggcattctttgtgagggcaggtggatggtgtctgctggcactactcagtctcccctctttcatactccacttctgtacaggtttgatcaggacttgagagagaatacatgactgttcttccacaaaaatatagggactaccgacaaacaaattttctagaacattgtattatttataagagttaaagctgaccaaaatcatactatcctaaattctcagattataatctatattttacttcatattagaaggacgatatcctctgtgataccacagctctacctcctttccacacccttaacccggggaccaaaagaagagcacaaaaatatgtctgatccactcatggtggcaaagatttacccttcaaagattatacaaagtctcctgttctattgacacaacatttctccaatttctcttttttgttgacattaaagttacataaggacatttcttcaatttcaaaactacaaattcagtcacttttataggccaaagccctacgatacactagggctggttagaaagaagtgtgaaacctttaaatgtccagacatactaactcagtaattccattccttaggaaagtgagctgaaataaatttatcgatattcatcactgctgtttagaacggagaatatttggaaaacatcaagtccaacaacacagaactagttaaactgtggcatatagccattagcgtgtgagcatgtcatatttttttgtgccatggatgactttagcattctatatacctgttcttaaataaattttttaatgtacgaaagcaacatatattgaaatacttatcataatataaaaaacttgtaatatagtaatatgtgtacttttttgttgattcattaaataacaggatttactagaggtcactccctgaataacctccatactttcaaagtaatgtggaatataaacattattttgagatgttttttccatgtgatgtgataggagaatacctataatttatactgatgtcataggcactgccagtattgctgtgcttatcacctagcttcataaatgaagtgaatgctgaatgtcatttgacatttgatgaactggtaaaaataaagatgcaattttttcctcacccaagttcacaatcccttaaatttgccttggttggccatataccccaggttatgaatctcagcatgaatggcatacaaagcagccagaacagttcagatttacaagtggtggcatggaaataaattcaggacatgttaagaaccacatcacaaaactgcgaatagcttaactccatatacgttcactaagaaaactgaccatacaacaaatgttaacagtggttaagtagcttctattttaacttttacttgtccacatttttcaattttattccttgaaaatgtattatttgttcaccaaaaagggaaaatgcagaaggaaactcatagacgaaaaaaaatttttttttttttttttttttttttgagatggagtctcgctgtcgcctaggctggagtgcagtggcgcgaagctccgcctcccgtgttcatgccattctcttgcctcagccttctgagtagctgggactacaggcacccgccaacacgcccggctaattgtttgcatttttagtagagacagggtttcaccatgttggccaggatggtctcgatctcctgatctcattatcctcccatctcggcctcccaaagtgctgggattacaggcgtgagccaccgcgcccagccaagaaaaatttttgaagtctatagccaaatattataaatgtactcaaagggcaaaagaagaagcagtaagtaaattcaggggagagaacataaaaatggaccacgcttaatcattacagaagctaagttagagaaacaacactgaaaagggtgctggaaatccgtacgttcatgtatcagatgccacagcacttagaatcctgacaactgggagataatagaagtaaaacatatgacaaaactgatggtctctacaacagccagcctccaccaatcctgacctaaatgccaactgcaatctttaaaaagcttgcgctccatgatgccaaatatctattttggggatagctgctgcagacttcaaaatcattctggtttataaccctgaaagatagctccgagtttttctccaaccaaatatcttccagccagtccagagaataaactggaaatcaagtctccattgtctagttagaaactgagttatataactccttgcaaggaagaaatatcatctccccaagtctgagtgctaacagagtaattaccagatgcaaacttcaaaaccttatgtgtatttctatgctgtgaaatagtggtaattaaactactacttttcagttaaactgttcctaaggatgtaaaaatacagcataccaggtgagacctttttgtgacatttcctttccctctactaaaaaggaaaaattataattatacacagtattactaacattgccacaatcaatttggtaactgcacagtagctatgttttataataccagcacaatgggatggccaggacaagtaaagtctaaaaactaaatactgtctaataataatgatagcctgctttagagccaagttatacagagctttacaaatagagcccaaattaaaatgttaatgaaaaaattaagaataaaaagcacagctaggcatggtgatatgcacctgtgatcccagctacttgagaggctgaagtggggaggactgcttgagcctgggaggtggagggtacagtgagccagagattgcaccattgcactccaacctgggtgacagagtaagaccctgtctcagaaaaaaaaagaataaaaaacaacatattgaaattatgctaaaaatctgtatcataaactcactccactttccctttctaaaagagaggtataactataatcaaagctcccctcccaacttttttttttaaactatatgaatctctattgatcagtctacagtgagacactaacactccatctgtcaagtatcaacatctgtccaacacaaagaaagccagaacaatgcctgcagccttcaaagggatataaaactgtacctttgccttttaaagtttggtttatcattttacacattacactatcactctgtacataactgaaaaggcattccttgcaaacataactgaatagggaaatctagagatgtaagtcagaaaacacatttaggggttaaatgagtgaacagtggtggagtatctttcatatgtaacatatactatgatgcctaattagcttgagtacatttttaatggtgaaataatgaaaaagacttaaaggtactggatatttaatgcatatataatgacaaatagtcattatgtatgaattcaatggacttggtaaagtgactagaaatttacccatttccaggcatttaagcattcacttaaaagaatgaagtgactaacttaccttctcccatctatctctggtacttacaatacgcattataaaactcagactaatactaaggaaggagtaaaatagtgaagcatttatcctcactttttctagtatttagggtattcacatagctccaaagtaaaattcatgcacagccatctattctgcagtatttaaaactttttaaaacaacaaatcactcttgtccacatacattttaaagtaatttaacaaacaaaatacactgctccatcttcatagacagtatttttaattttggaaagtctggttttctcagctggtgaagctgtcagaataaatagaaggcaatatctggaaagatgacaaacacatgggtcaatgtcaaatacaagccaatctctgtcaagaaaaagagccaaattcctgcatttccatttaaattacgttatccaactcaaataccaccatgccacttcaaatgaaaatagtttccctttaaacagagctttttacaaaactgatagagtataacagattaaacaactctttcagcaattttcttagctactacaaagtaaggcatctatgtataattataataaggggaacatttaacaattaattgagccagctaaagctaaatctccagagcttaggagttcaaatgcttgctcactaagaaaaaaggacagaggattttaatataactgcaggaaatctcagtccaattagattctaggtaaatataaatcttgttgcactgtgattggaactctgtcacagtcctccggactgattttagcatctggcttggagagtcaaaccaaagaactccttgccccactgtttctctccacacactactgaattaatcaagtacctccaggttctgtgctgaacaaagaaggtcttctgaaggctgtcagcttgcttttacaaccaaccaataagactcacagaacatatcatacaactgtgaggcagtaacatctctgaaaatattcatgatttaccctagtttatcatggcgacaccttaagtaattcactgtctttcctcattcagaattagatcacgtgaggccaggagccatccccttttggagttttgataatggagacttagcaactatctttcaaaccaaggaggattaaaaattaagtaatcaaattaactagggtggcagttcacttccttaacttaatatacatcttttatctctgtgaagatctagaaaagtgcagaaggatttaacagaatcaaaagtatcgtattaacattttgggggtcaaaaaatcaggatatattttatattttaaataattttatagttgaaagaatttggtctgttagaaactggccttgtaaccccaatctaaaaccccaatctaaaacagtaacacttaacaaggattttaatataggactggccctttctgagttccgcacctatgtgcttgtgtatatacttatttaatccccatcacaattctggaggtaggtactcttatccccattttattgatgaaaagacaaaggcacagaggctgtcctctactccacgttaacccaccagcagtggggtactagattatgctgtcctttctccctctgtgtaactgattcagatttgtggtcaagatgaaacctaaggaagtttatgcacaacactgaaacatctaagagaattttttagggctgtttcacttgtaagtctaattaacttataagaagagttaagtacttgaggtttgtgttaatagactttttaaaaatagaaaccaaatattaaattagtaaaggcaagcttaaatgttgaagatattaacgagtttataaacaagactaatttgtaattcaaaatcccttaaaagtgattaaaatgtttaatttataaatgagatttataagctgaattttttaaaaagtgtaacagtgtccttcaatttgcaactttaacaaattgaatatcaatttttttaaacctaggtaaaccttctggacagtcatttctgcatataaatatcaatcttaaggactcttcccaaaaagtcctcccatcaactgctctgtgcacatgtctcctactcaactgctaaaggaagaacagctgagacaatgctacccaagagaggcacctagggctaagcactcacatctagcagctaactctgcctgcgctaataggtatctagggaatgagtaagtgcctagaatgtgctagacacttttccaagtacctgggatacatcggggaaaaagatccctgtcctgctggaaccaaccagcatggaaaaagacacacaacagaaatggaaatggaagatgccatgggtgtgagtgactgtgaaaggtggggggatccaagaattgaaaatcctagtgggctcaaacaatttctggatcaattggccccaggaaggtggaaagttaagaggtagaagagtggaatccatgagtaggtcatcaccaggctgcattcctgaatctgatcattaattgctcataaaaataccttcaaagattgacctttcaacatgtttttgctcattattgagcccaatttttaaacagccacctaaagaacatttctgtttcctctggaacacagtttttgaacacactgtggttcactgcttcttatgtagatatttctgctataacacaatatatgttactgggaagaccacatattcagcaaaaatgttcactaaaaatgaaaggacttacgtaaaatacagggtaaaaagcagactactcaaaccctatgcaactctgaaatcagatggctattttgttaaaaatcaatacttaagaaataagaaacccaggcagttacccaagagtggctgcacgctgccaaaggtgatactgagaatacatgaaaacaacagatgctggcttgaaggcaccaaaacaatgcagtaatctgggggtttttgtgaaggtgagcacagcagacagggcaacctgccacagagcataatgttagcgtgtgcctctctggggagggaaccccaggggacaggtgttcatttttcatttcattttcaatagaaatgagaaagctcctgctgatgcaacagccagagtgaaagtttaaattctcacctatttttttcctttcctgctaaaatacaatcccacattataccattaaagtatatattataattctattccatctggtcacactcctcttgcctagcaaaagttgcacatgaaccagcataaagtgcacattctattgacctcactgttctatttacttacctatcacacacaaagcaaaacaaactattgctaaatatccatatgcaataacaaggtctcatggccagcccacatctatttcccctaccaaactgcttcccaagctcattgtggggaataactttagccccatcatgtgcaggcttgggaaagcaatcaatccaggtttctgtctttttttatacaagacatgtgcatgcaattcaaggtagacatactatatttactcttttggaactgtgaatcttgagctgagtgacagcaaggacaggaagatcctgaagggccctattccagttatagcatgtggttggaacggtcagtagttcccgccaaccaagtacctgaacgctctcgttccaagtaggttttggaggcttttttccagcttcccaaccattatgggggaagcctgtaattatgtgagccactctaacaacacattgccctttgtgttatgtgatcaatgtacaccaccttgcatcaaaaaacttttcatgcatacaacatgcttgctttttattagatcatagaaaaatgtgtatttctctttcagttacttagggttcaaaatccagtaatcaccattagcctatgtattcttgaacaatttactactcaccttctcagcttacttcccatagtttccttatggactatgttgcccaggctagcctcaaacttctgggctcaagtgatcctgccaactcagtctcctgaggagctgggactacagatgctcaccactgtgcctgactagacatacaatttttggcaacaggagagctataaataattttaggagtaaaaggagaaaagagaaaaagagcaaagtaattatatcacttgcattttcgaagaaatcagtctatctcttcttttttcttccacacaggttatttgttttttgtattctcttcagggttttatgcaaatgtccgttcattcttggctttaaccagttctcacaggcccataccattttacaaaccagctgtgtgactttggcctccatgtctttgtttcctcatctgtacagcagggaaacaatgtctaggttgtataggaattttctaaggactagaaattacacactcaaagcaaatccagtagatagaaggtgctttaaaactggttgtcacccatgttgtagctcccttactatttacagccaagttcacagtgccctttgcaatcaggcactttagaagatgcaaattattcccaataatttggccagaatgtaattctgcagccacctctgttcttcttgaactgcatgcatcatattttaacgtcaaaatctcaagccatgaaatcacatattttttctctaatttttgatctgcctaatttgtagtctgccacaggtaagtgacaagcatgctgggtactaatcctctcacctcatgcaatggactcattttatatctgcgttagcttgaaaaagactgggaagcactaatgagtgattagtgactctcaaatctaaacgtgtgtttaaatcacctggacatcttattatataaaacatggattttgattcagcagattgggggcggaatctgagattctgcatttctaaccaactcccatgggatgccaatctgtggccaatgcttggtgcagagaacaactacagtacaggtttcatgatacttaatgatcctttccctataaaatcaaaaaagatatgattaatttgtctcaaatatcacttcccatttctctaattagaataactttagtattttctctttcctctatcctcacgaagtaataagtttttatgtgctaaagaattgtctttcacatacgtggaatttgaataacttcctaatatacatgaaaaggcaatcaactaaaagatgaaataaaatttcaaaagaaacagaagaaattaaaagttaactaatgtaatccataactaaaagttcactataatgtgactgaaaataagaactacattttcccaactgttccaaagacatacaactaagagaactgaggagatgtcactcaaatgtgaaacacctgaacctgagtctacctaacaacaaagctctcaaatgtgaaacacctgaacctgagtctacctaacaacaaagctcttcctgcctgttacaggatgagtttgtccttcccaaaattcgtatgttgaagtctttactcccaatagctcagaatgtgaccttattaaagaacaggtaaggccaggcacagtggctcatgcccgtaatctcaacactttgagatgctgaggcaagactcctggcttgagtccaggagttcaagaccagcctagacaacaaaacaagatcccttctctaaaaaaaaattagaaactagctgggcacagtgccgtgcacctgtagttccagctacttgagaggctgaggcaggaggaccacttgagctcgggagttcaaggcttcagtaagccgtgttcatgtcactgcactgttgtctggacaacagagtgagacccttccccgccactcaaaaaaaaacaaacaaacaaaaaaaaaacagggtcatcattgccaatgtaactaaaataaggacacatgaaaatataattacactgtaggtgtgattagttaacattaagtaaggtgagccctaatccaatatgactggcatccttacaaaaaggaaaaatgtagatagacacagagatatgtacacaaagagaatgctatgaaagatcaccactacgctgccacaaagcagcaaactactgtaagcaaggacagaggcttgaaacagatccttccctggtgccttcagaggtaacatgaggctgggtggagtggctcatgcctgaaatcccagcactttgggaggccaaggtgggcggatagtgtgagccaaggagttcaagatcagcctgggcaacatggcaaaaccttgtctctacaaaaaatacaattagccaggcatggtaatgcatgcctatagtccctgctactcaggagattgaggctgcagtgagcaatgatcatgccatagcacaccatcctgggcgaccctgtctcaaaaagaaatgaaaaagaggtaacacgaccctgccaacaccttgctgttggatgtgtggcctccagaactgtaagacaacatacctctgttgtttaagccactccatttgttatacagccacagcatccctaacatactaacacacagccacattgtgtttcctcccaaataagattaacgttgattaaataacattaaagatgattgtgcagataggcaactaggtcacagagggtctacagtgccaggttctgggaacaaacctgctggtgaacagggaatacactgaaaagctttaagcagattaataataggtctaataagtgcaactgaatttgtcacatgtcggaaaaaaaacattaagctctgcctaaagatgcctttatgctatgttacacaaaaatattcttgccattatcaataaaactaccccaccacaaaatatgaatgtttcaagaagacaccttcatttgcatgtcacatctattaatacctaaaattcttctaaatattgagatgtagataaaaagttacagatcaaatgagcttctatttaaaatatgtatgtgtgtgtgtgtgtgtgtgtgtgtgtgtgtgtgtgtcccctggaacaccaaataccacatcttggttttgttttattttgggaaggaaatgtttgtctgagtaattaattgccttacagaagctttcgatgattcagagaactaaggatgtgacaccacttgcagcctccacagacctcagtgaagacgcagtagctaaatgttaggaccatttgttaaaatatcggggactccctccccactttaaacagtaacttgattgaatggaaattttccatttagaaaatagttgcatgttatctttactttttcttttaaggcaaacttttactgaagtgtaatacatatacagagaagtgcaaaatgcagtaaattttcacagaacaagtccatgtaaccagtaccataaaacgtaacatggccagaacctgggggtccccttaatgttctgttccctgtacccatagggcaatctctctcctgacttcaaacaccaaagattagttgtggctgttttaaaattttctataaaaggaattatacagtattatgctcttctgtgtccactcaacatcatgtttcatgttgaaatcatttacctgtttttgcgatggggtctcactctgtaacccaggctgcagtgcagtggtgcaatcactgctcactgcagcctcaaccttccatgcttaagggatcctcccacctcagcctcccaagtagctgggactacaggagcacaccaccaagcccggctaacttttgtattttgagtagagacaaggtttcgccatgttgcccaagctggtcttgaactcctgggctcaatctacctacctacctccacctcccaaagttctggaattacagacgtgagccactgcacctgacctatagtcatttactttaaataggttttagaaataacgtatattccatttttattcaaactagatcctcaggtttcattttgcctagtttgaattttttccagcttaaattccatttgcatcaaaagaaaataacacttaagtgatcaaagtaaacaattctagtttccagggcatttttcctcaaaattgtcaaataaaatggtcaaatattttgcatcacctaagatttcacaaaccacaaacttatatacataaatacatgttttgcactatgttcatgaaagtagaaggaacacatattctaggactatagggtaaataggacaatcaaacaaaattatcagttaatatgacaaaatgttaaaaaattaatacatacttttgaaaaaaaaaatacatttcattatccaaatagcaagcaataccaatatgccaaaataaaaaaaaaaatctcacaataatatgaagttagttttttaaccagttctacctacaccagaaataaaggaatcaaatttcctagaacctaactgaaaacagtagaaagaaattaatatgccacctacagcaaactccagaaatcaatatcctatgctaaagaagcccagaaggaaaatctggctgcacacagctgtgtaataaatcaatttgttaccgtgacagtcatctcaaaacaggagtaatggctgacagacaacaaagaagttagatctgactcaaggacaatatacaatagagccccacaaggtttttgttttggttttatttttaaacaagtctgttaaatcattcattgggaagtaatacaaaacagacttccagaagtcttattctaattttaacatcatcaatgagtcaataattttttttaatgtttctagaaatttctttattcaacaaatattatggaatacaggctgggcgcggtggctctcacctgtaatcccagcagtttgggaggccgaggtgggcagatcacttgaggtcaggagttcgagaccagcctggccaacatggtgaaaccctgactctactaaaaacacaaaaattagccgggcgtggtgtcacacgcctgtaatcccagctactctcgaagatgaggcaggagaatcacttgaacccaggaggcggaggttgcagtgagctgagattgcaccactgcactccagcctgcatgacagggcaagactccgtctcaaaaaaaaaaaaaaaaatgtatatatattatggaatacacactatgtgtacactattgtcagtagatggcaggaattcaatgatgagtgggggaaaataagaattgctgtttttttggagaagggagacttattaatcctaataaaattattactgttctaagtgctagaagaaaagatacaaaaaaggctataacagtatttattaaggaaatgtatttgactaacctgggagaaaggcagtgacactggggtggcagagcttaagaaaagataagaattaagtgtgttaccgagacgagaagagcaagtgcaaaggccccgaggcaggcgggaacatgggcagtgtaagtaacaaaatctattatgctgagctcctaaggacaaaattaaggtaatcccagagtttagcagcaaaggtgaaaaagacctggttgtgacaacgcatgagattaaaccgtagtgataaattctaaataatatttaatttctccataagatcacatgcttctaaacactaaacaatttaaatatagcttgggacagaaaagtatgattatatgaaagcctacctttatcctcaaagtatccctgctatgctcattctcagtgacatttcgagaggtccctataatttatacttattctgagtagtaaaaccaattcagagatgtagaaagcaataaatatttgaaaaatcttaatttgtgctttatatcccatagaaataaatgagtattaaagatctattcacttggaagcggtggttcacgtctgtaatcccagcactttgggaggccaaggtgggtggatcacctgaggtcaggagttcgagaccagcctagccaatgtggtaaaaccctgtctctacaaaaaatacaaaaattaggccaggagcagtggctcacgcctgtaatcccagcactttaggaggccggggcgggcagatcacaaagtcaggagatcgagaccatcctagccaacatggtgaaaccccgtctctactaaaaacacaaaaattagctgggcatggtggcacgcgcctgtaatcccagctacttatgaggctgaggcaggagaatcgcttgaacccaggaggcggaggttgcagtgagccgagatcgcaccactgccctccagcctggcgacagagtgagactccatctcaaaaaaaaataaaaattaaattaaattaaataaataaataaataaaaataaattagctgggtgtagtgccacgtgcctgtaatcccagctactcaggaggctgaggcaggagaattgcttgaacccaggaggcagaggttgcagtgagttgagatctcacaactgcatcaagcctgggcaacaggctgagactacgtctcaaaaaaaaaaatctaccatttaaaaactagtaatttggccagatgcagtggctcatacctataaccccaagactttgggagatggaggcaggaggatcacttgaggccaggagttcaagaccagcctgaataacatagcaagaccccatctctacaaaaaaattgttaataggccaggtgtaagcacacctgtagtcctagctactcaagaggctgaggcaggagaagcaattgagcccaggagttcgaggatgtggttaactatgatcacgccactaccctccagtctgagcgacagagtgagactctctgtttttttttaagctagtaatccattgaagatatcctttacaacattctccacagatcctaagcttttaagatacaactaagcacacaggatctctgcaagtgggtgaggataatggtttttcatcactaacaaaggatgttattgtagtagtttatatcaagaaagtaaaagaccaggtgcagtggcttaggcctataatcccagcactttgggaagccaaggcaggaggatgacttgagcctgggaggtcaaggctgcagtgagctgtgatcataccactgacagcctggatgacagagcaataccctgtctcaaaagaaaaaaaaaaaaaatcaggaaacaaaacaaaggaaagaaaaaactcaacccccatctgggaatctaatcacagtactctgctggtttttttggttttgttttttgttttttaagagacagtcttgctctgtcacccaggctgtaatataatggcatgtagttcactgcagccttaaactcctggcctcaagtgatcctcccacctgagactctcaaagtgctgggattacaggtgtgagccaccttgcccagcccagcaccctacttctgattcttcagtttaagtaaccctaaagaacagacaatatttaacaaatactcatttagagaaaaagctgtttggagaaggcagctaactcagcttcaaatccatcaccaaaacgaaaggaaaccactgagaaggtcaaagacagtctccttaccaaatagacatccactggacctggcaggatgcaaaggcacagcccccactcaagcaaaagggtgcctcacatggagctgtcttgctctgggtgccacggaaatcttccaaaccatgtgtggcctttatagatccttcataatacacttagctttcagagacagcatacctttctcacatgtcacaaaggttttcagattcactgaaacactaccagcctccacaaatacatagttcttgcccaagcactttaagaaccattctgtaaataagtccttagcaatctcccttcacatattcttccagactcaagaagggaggtgtattagtccattctcacgctgctataaagaactgcctcagactgggttatttataaaggacagaggtttaattgatccacaattccacagggctggggaggccttaggaagcttacaattatggtggaaagagaaacaaacacatccttctcatatgacagtaagagagagaagggctgagcaaaggtggaaaggccccttataaaaccatcatatcctgtgagaactcactcactatcataagaacatgatggcggaaactgcccccatgattcatttatctccacctagtcccgaccttgacacgtggggattattacaattcaaggtgacatttgggtgaggacacacagccaaatcattatcaggaggacttcctataatcatagttcaccacgcccagctaatttgtaaaaatttcactacaatcatagagcactgcaaccttgacctcctgtgctcaagagatcctcccacttcagtctcacaagtagccgagactaaaagcacacgccactgtgcccagatccaagactgtttgtggtttgttggtttatttctatttttagggagatactcagcagaaacagggtgccacagtcccataaatgggaaaaatagccggtgtttttcatgttaaagaggtttccttaactgtcgggcttcttggagtcactaattctgactctctcatgagggagactgtacaggcagcattttccacacatatttgactactatttttggtgaaatgtccccactgacaccagaataacgttccatattataaatgctgagaaaggttagcattcaatactgcacaaggcagcttgccttttgacagtgatccaaactgtattaccacattaaattgttatcaagagaaaggataataaaaaagtaaatctttccttatactgaagttatcataatgtaatctatatctaaaagagttggccaggcgcgatggctcacgcctgtaatcccagcactttgggaggccgaggcgggtagatcacgaggtcaggagatcgagaccacggtgaaaccccgtctctactaaaaatacaaaatattagctgggcgcagtggtgggcgcctgtagtcccagctactggggaggctgaggcaggagaatggcgtgaacccgggaggcggagcttgcagtgagccaagatcgcgccactgcactccagcctaagcaacagagcgagactccacctcaaaaaaaaaaaaaaaaaaaaaagggttaacatgttttgttcctttcccatgatttagatgtgcgtacgccctaaacaagcaatctgtggtaactctgagagattcttcagtcactaagaaattcttactgcccaatagctgagtctacatcaaagataaatacagacagtactgtaacctacacacatcatttaatcgttacagcagatttctaactgctctaaaacctccactctgatcaatttatatcacacaaataccttctcagttaatctccaaccaagaaattgtagctgtgaatgcaaatttgtctgtattaagttctagcactgactttttttttttttgcgggggggaggggtggagacagggttttgctctgctgcacaggctgcagtgctatgatgtgaacggggcttactgcagccttgccctcctgagctcaagggattcttctacctcagcctcctgagtagctgggactgcagtctcatcacactcccagctaattttttactgttttgcagagatacggtctcactatgttgcccaggctggtctccacactactcaagcaatcctcccgccgcctcagcctctcaaagtgctgggattacagtcatgagccaccgtgcccagccccactgacatcttttgaaatttaaaaaactcctgtgtgggagaatgaaaatctggaacttgacgtgaagttcataacagtaacagcattcctcagtaaaatgattgttccagattatggacataacacagtgaagtattttaatctccttctcagaaaaacataaaaatgggcagctttaatctgctaattacatctcatacaaaattcatgtcactcttcaacagtaaaagtaactcaaacaaaatgatttcacctaggttttactggcttctgtaagaaaggatcttgttttgtttttttttgtttttttttttgagacagggtcttgctctgttgcccaggctagaaagcagtggtgcaatcatgcttcactacagcctcgacctcccagactcaagtgatgctcctgcctcagcctcctgaatagctgggactacaggtgtgtgccaccaggcccagctaatttgtaaaaattttttgtaaagatgggggtctcactacgttgcccaggctggtcttgaactcctgagctcaagcaatccttctgtctccgcctcccaaagtgctgggattacactgtgcccagcctaaaaaaggtgtcttaatacacacaatacatcaaatgaaaaggaaaggctttgctagtgttcaacaggttttgactcacttgtttccctgatctcatctaaaagttgagtctgtctttttttgagcaatgctataagccacaatatactggtgtgaccataatacattttctggaaaaccaagcaggttagatgactacttctattattgttgattagagagcctgaagctcaaatttttggaaaaggaagttagcaggagcaatacatctctgatcttcagggcttttttttttttctgagacggagactcgctctgttgcccaggctggagtgcagtggtgtgatctcggctgactgcaacctccacctcctgggttcaagcaattctcccgtctcagcctcccaagtagctgggattagaggtgcacaccaccgagcccagctaatttttgtatttttagtagagacagggtttcatcatgttggtcaggctggtctcgaactcctgacctcaggtcaccacccgcctcagcctcccaaagtgctagaattgcaggcgtgagccaccatgcctggcctaaaggccatttttaaaaagtacctctctagagtctggtcgatcctgtcccaaggtaaaatttcctgtttccaagaatcttaaggtttacttgtctccaccaagcagtcaattctgcagggtcaccacagtctcatttatgattgaagattaaaaagcaagcatgaattcaaaagacaaaaaaatactaagcagatggtccagttagagaacaagcagcacaggaaaataagaaaagaactcatgaatgcataaaccaggacacaagagcaaattaaggcagacacaagcaagaagtgggtgaacctaactgaccaaaagtgggtcacatgtttaccaaattaagtttcctactcttctagattccaagccttccttaaagtgtacaaagcgtatttatttcaccataatgccaagatcattcccccactgtaaacattggcaagacccaaacgtaaggctccttacctcctggtctgtagaccacatcatcttcagtgatgtaggatgttatctcaccggtatctgtcctttcataacgagacttttttttcggtggtttcttcttattcttcttcgtggactcctctgcggtggcactattgttgtcattgtcctcgtcttcactgtgatcactctcagcataatttttggctcctccttccaaggtacagctccggcgtggccttgaattctcactctctcttgctttgtctcttttctctctctctcggtcccggtctcggtcccggtccttctctttgtctttgtctttgtctttgtccgctgtcatgattcgccacgtgccttcttctgtcctctcacggctaggcctccgtgaaaggtagacagtaagcctgggcttcagtcttctgaatttctcactcaattccagggaaaatccaaccactccaacaaccccaacgtttcaaaaatgctaggagagaaaaaagaatggttttaacgctttttcatatttgtttcctaaaataatgttttgttaaatgaatctcttacttattcatgctttacacctaaaaacttcgcacaagccacaggagaaaaattaagtgttaaaatttaaaaactacagtttttggtctcagcaaatggtttggggttttttatgacaccaataataaaaactgtctgaatgcctaagagtaaactacacttcctccaccttacatgttttctcctttttaaagaaaaagcaaaccaataccctggtagacaacatataatgggtattattatacaaaaggagcttcataactcataatattaatttaaagaggaaagaatctgtagtaaaaattatttccaggccaggcactgcggctcatgccttgtaatcccagcattttgagaggccaagccagaaggaccacttgaagccaggagttcaagaccaaccctggcaacaaagcgagatcccatctccaacataaaataaaatatttctacctgaaaaaatagtaatagtttgcagcactgtcaaaaatgtctcaggataggccgggcgcggtggctcacgcctgtaatcccagcgctttgggaggccgaggaagatggatcacggggtcaggagatcaagatcatccttgctaatgtggtaaaaccctgtctctactaaaaaatacaacaaaaattagctgggtgtggtggcgggcgcctgtagtcccggctactcaggagtctgaggcaggagaatggcgtgaacccaggagacggagcttgtagtgagccgagattgtgccactgcacttcagcctgggcgacagagcgagagactccgtctcaaaaaaaaaaaaaaaagaagaagaaaagaaaaaaaagtctcaggatatcgcatagagcactatattctaaagatattttctggctacttctacaaactcccagaacttccttcaagaataaaaataatatttaactcaaacgaaagtgagagcttcagagcaagatttttccaccttcagttacattttacacatcttttcatcctaccattttcagttatgttccaaggaaaatgatctctctaaagatgtattactggccaggcgtggtggctcacacctgtaatcacagcactttgggaggccaaggcagggggatcacgtgaggtcagaagttcgagaccagcctggccaacgtggtgaaactctgtctctactaaacacacaaaaagtagctgggcacagtggcacacgcctatagtcccagctacttgggaggctgaggcaggagaatcgcttgaacctaggaggcagaggttacagtgagccgagatcacaccactgcactccagtctgggcaaaagactccatctcaataaagaaaagaaaatgtattgtctctgccttaacaaaacataacagcttccagaaacaagcttccatctttcgggaatattaagtggtttttacagtcttccagatttctactataaatggtatccctaataaagtactccccaaaaagaaacccaacaagaaaagtcttgaggtttttaagcgtctgcaatgggaaaagtgaatcccaaactccaagctaacacagttcttacagatattttatagcaggaaaaaattttgtctttctaagtcagttttggaatagacctaacaataaatttataaataaataatttatcttttgtttttcttatgatcttccccaataccctatctcacttattcaacaaatctttactaaatactatgtgccaagtgttagaactaaaaccacaatggaggagaaaactcatggtccttgttctcaatgctcaaatgcaacaaaaggaggcaaccgatcaatctaagaagcttctgtttctcatgcaactagggtgagaaaggaaacagtgcatataaacaaacaaaagattggtcctctttacttgacaaccacaaacaaatcagtttgcagttacatgcttcagatgcagagaaaattctctttggtcagccaggcatggtggctcatacctgtaatcccagcactttgggaggccgaggtgggcagatcacgaggtcaggaggtcgagaccatcctggctaacacggtgaaaccccatctctactaaaaatacaaaaaattagccgagcgtggtggtggacacctgtagtcccagctactcgggaggctgagttaggagaaccgcttgaacccaggtggcagaggttgcagtgagctgagatcgtgccactgcactccagcctgggcaacgagagagactccatctcaaaaaaaaaaaagaaagaaagaaagaaagaaaaaagaaaattctctttggtcatgctaaaaccataacaattaccatatattctctgcagcgctcttaggtcaaacctcttaccagaaaagacctcctcataagcatctcaaatatccttagacattcagcaaaatagaaagtatttagtctttggaagataggtgatgaaggagcaatcatgcatcataagctacattagaagaaggaacgcatgtagcacaaaactagattacttccttctatgtaagaaacatgctgtttcaaacaggatttccattttctaaacatatttcaagaaaaggaaaaattatcactgcctacaaaagttttgcccagatgaaccgtctgctaaacagatagtcataaactcccaagtcctggtaggctactagtgctagcaactgaaaatacagagacctactacttcctcgacaagtcttaagtttagagcatgaacgagccaatcatgaaagaaagaaaactatcaggccaggggcggtggctcatgcctgtcatcccagcactttgggaggctgaagcgggcggatcacctgaggtcaggcgttcgaagccatcctggccaagatggcgaaaccctgtctctactaaaaatacaaaaattagctgggtgcagtgatgggtgcctgtaatcccacctactcgggaggctgaggcaggagaatcgtatgaacccaggaagcggaggttgcaatgagccaagattgtgccatggcactccagcctgggagacaaagcgagactccgtctcaaaataaaaaacaaacaaaaaacgatcagctaacaccattgttaaaatgttcctctttgaccctgaaaactcatcagtgtctactaggagtccaaaaagaatgaaaagcttgggctgaaaacctctccactgcaactgcagtttcagacagaaacacttctgataactttaagaaaaaaaatcattctccctggggttaacaagataactgctccagaaaactgtgtagaaaacattttttcagcactcaaagagaaaaaatagtaagtccaaattgtacattcaacactactcactacaaaatcatacactgtttctatttacaaagaaaatagagttgtttctgccaaaagtgagcaagaaagttaaaaattcaagaaacaataaagatgtctataaaacaaaatccagtatatgtgtatatttataaaatcaatgttctgatttatctgaaagttggctctatttatatattacataatctgcatgttatattaatatattaaattatatgaataattaataccatatcatttatatattaatgacatatttatataaccaactttcagataagtatgaacattaataatctaagcaaaagtcaatccaattaccatttacatttggctctaaaatacagctcaatgggaatatatttttttcctctatgtttagcatatgaattataattcttctgcgccttagtgtacagtgatcaacacataccaatgatgtgacagataaagaaagggacccagagaggaaccagatggcactgagaaggagagttgtcacttcaatttgctagaaatgatctacaaagtagacgatacaacaacagcatctttattatagcaccatgaggtttacagagcaagtccctcatttgattcttccaactcatgaagtgaactggacagaagttgtcatcctcgctttacagtctacagaactcagaagagatcatctgcacaaggccacgcagccaatgggcacgaagtaggattccagtgcagctgtctcagagctcaaccctatctggcttgcacaggaactcctgctgcctgtgctgccaggatctccagctcttcacaggcaccaacttctcctacattcatccatgctgatgattcacgcagacagatttaagaaacacactcactctgcccccaaagctatttttctccagtcggaaagccaaaaacattgaaaatatctgtgtcaatcactacccaacccagtgaaacaggaaacacattataacatgctttaaataagaaaaggaagaaaatctaatgtagaatacatttcagatttacaacaagcttcagctactcagtgaacaaatgtcaagtgaatgcctattatgtgctatttacagctccaggtgttggtaaacagcagaaaactcaacataaaacccctgcccttatcttgagcttatgtgctcagcagtggagagagaccaccaacaaaaggcaccatacctaatgagaagatcttacatgggaaatctaagggggacacagtgttgcaggactgcaattttaaacaagatgttcagggaaggcctctctgagggggctttgaccctgagtaggagcattagagagaaagccaaggacacatgaagggaggtgattcctgaagaggggaaaaagtgcaaggtccagaagcaggaatgagccaggcccactcaagacacaggagaccagaggggcaggaatagcacaaaaagggggagagaggtcagagatgagttcagaggttgaaggggcagggggaggaggacctggatcctggcaggcctcatgggccagggaaaggactctggcttttactcaagtgaaatgaagttactcgaatgacactttagcagggatgtgagtagcaaagaaaggcatgatctgacttctgtttaccggagatcactctggccgctgataaaacctcaaggagcgcagtggggcacgatcaccccgggaagacaagcagcagctgggaagggctggggtagtagcaacagagaatggggaaagtctcatgtttgtatgttttaaaggtaagagtcaaataaataggatgtgctgataaacttgagaggtgagagagagagggaaaaaagaaaaaggacatctggcctggatggatgaagctgctgtttgagtttcatggggagaccaggaatttggctttgaatgtgttaagcttgatcaagaagcctagaaaatcacagagtcgaagttggcagaggtccaggctggagataataatttagtttttaaagccatgagactgaatgagatcacccaggaagtgagtacaactttttgacaaaacttttaaaactcatgagaacatttattgctcacgcttgagtgcagaggatattcaaaatagacttatgagttacacatttccaaaggcagtacccttaggactccttttaagtatattcctctcaatcatttcctgattagaagattatacatcatcatttcatcttaagtaagaatatgtgggcagttgccaaagctcaaaaaatggcagcttcacctatttagctgaaggccagattcctcacagttttttgatcctattagattccccacttaatctaggggaaagaatcaaagctttcagcagagccaatatacagaattactcttcattttaggttacttcagcctctacaaacaccatcttacctcttcaaaatgaagccaacaccacccccaaacatctcacactacttctcaaaaccaattcagacaaagcacaaaaatttcagtcatactcatggtccaaatctcatttaagagaaccacttcctggctggatacagcggctcatgcctataatcccagcactgtgggataacaaagtggagaaatcatttgaggcaaggaggcaatcatttgagaccaacctgggaaacacagcaagaccccatctttacaaaagaaaaataaatttaaaaattagctatgcgtggtggtgcagacctgtagtcctagctacttgggaggctgaggtgggaggtgggaggattgtttgaggccaagagttcaaggctacaatgggctgtgatcaccaccactgcactccagcctagggaacagagtgagaccctgtctcttaaaaaacaaaaaaagaaaaccacttcctgtcagtacttaagcttaaggaaggggcccaggacagaactggggatactggactgagaagccaagatccaagttcttagcactgccgcttgctgcactgccttgggcaaatcactctacctgtctgagtcgcagtttcattgctgtaaaaggggacaagacctacctatttcacaatgctgctgttgagaattacacaagtatactatatgtaaattgtacttatagattgcaaagtgctttacaaatgtaaaatatcaataatatgtatttatttcagtcatgatttacatctactatggtagataataagctatggaagatataaaggtagccaaaacacccctatcctcaagaaacttaactatttgggcgggggtaaaatctatccagttccatgattaagaaacaaatcatggagaattaactacaaatgaagaaaaaaattaaaaatatttcctcttgggtcatgtaaaattcacttatccatggaaatctgcccctccctcctgagttcccaatcctcaagctctactcatctccattgctcaagccaggctatttgttaggatgtttgacttttgactaaatacagtgagcgaagtcctccagttaattcttcctcactcaaccacagtaagacatacttatatttttcaaatgcctgaccatactctaggcatttttgcttagcacttagtctaccagacacatcctgaacacctctgtaatggacccactgctccaactgaatcttagcttacctacttcaagccatcatcatccctcatgcagatgaatacaactgctttctaacagatctttgtgactacaaaacattgtttgccttagccttcctcccatctgtcctccagtgcagccagccagccagcatatctgacgtcccaccactttttttcataatagctcaattcagatataattcacgttccatatgaatcaccatttaaagcatacaattcatttaaagcatacaatgcccactattccttttcaaagattatggggctgccccttcacctctccagcctcacctctcccctactgcttccacctccacccctcctgcatgctcctcctgctgcctcaagacactccttcagtccctagaacccaactgctgggaatactgttccccgcccctttgtctgtgtaccttctactgaccctcagagtctccagtgtttctgctctccaattccaggaggcctcccagacctacccagagtccagccttctctttgccccccaatcctgcctgtaaaatggccctcattgatcccactagtgttatcagttgttaacttacatcacttccccactaactgcaaagtccacaaaggcaaggaccatgtctaccatgtcatattccgtgaagcaactcccactcaagcaatttcctctctgcagcaaattcaggagagcattttcctcatcattatttgattattcagtagcagctgacaggggctggccacacaccctcctggaaggcctcttttcctttcactttctagacacgatcctctccagggcctatctaactgctccctccacttcttatactaggccaaccagtgtagaagttctgttggggcactccctcttttctcatcctctactttctacctggccaatctcatatataatgcgttcatcaccaatcagataccaggacacacaggaggatccacacaagtacatgtctaccagatctccccttcagcttcagacacatgtgaaaactgttcacctggggtctcttcttggatatctcaaaggtacctcaacatgcccaaaccaaaggcatactctgcgtgcaccaccatgcctggctaatttttaaaattttttgtagagacagggtctcattttgttgcccaggctagtcttgaactcctgggctcaagcaatcctcctgtctcctctctttaatccctacatcccatcatcaacaaattatctcattgttaccttataaatttctctcaaacttatacctccaaacacctccaacatcacaaatcttagttcaatctactagtatggctttcctggaccacttgaatcaggttcttgattagtctcttcaaatccactcctctgaactcctacaattattttactgtactgcagccagggtgttcctttaaaaaggctaatgacattatgtcaatccccactttacaatacgtcagtgactcttcactttggtacattaaaaatccaaatccttatcatgatctgcaaggtgcttatccttttttcgcttcatctctcagcactgtctttcagtctacacccagccacactatccctccctcagttcccagaacacaccacactccttcctacccagagtcctttgctaaggttcttcctaccctttgtaatgctcttcgtctggcctaggtgcctcctacccttccttcaagtcatagctcaacagcaacgtcctgaggatagctttcttgttcaaaacaggttaaattcccttcatagcattttccacaactgtaactttacatttacttgtgtgatttggttagcttctatctccacctcccagctagaagttccttgagggactgacccttgactgttttttgccctttgctgtatttccaattccttaactcactgcctggcacagaaagaggaataataaattatttcttcttccttcccaccctctcacacatacgttggatcagtaaagagggcattatgatgagacttgtgttggggaaagaaaatatttcatgaataaataactgaagaggtacttgatttggttcataaaccatgagtaggataaggagacgcaaagagaaggcgaaagacagtccaggtgggaggaacttcacttaagagagtgttcagttaaatagcagctacaggggaaaaagagcagtacaaagtaaatttaagtagagcaggtggaagggataatggaatgcccccaaaataataaagcagccaacactcactgggcacttaatatgcactaagcactttacacatgttaactcatttaatcttcactataacaaaggtgacaatgtaatttatgatccaaactggatacatctgagagagaaaaaagacacaacaaataaccatgcaggaaaaacatatgaaagccaggtcatatatcctagctatacccttattcagtcagtactactgttatgtatatcttatcaatgcaaaagtaagcactgagaggctgagcaagttgaccaaactcacacaactatgtgtgagacctaggatatgaacccaagcagctgactccagagcctatatgcttaaccacaaagccatcctgccttaaatgacatggccttaaaagccgagttatccaatacagtaggttaagtgaaaaaggtgctgccaggctactgagatgaaaagagcagtctaggaacattcatcttatctggcagtaggagatgttttccaccaagagttgttagtgtcggccaaacaaacttactttcaaatccatattctctgagagcctaagtaaggaaccgaggtacctcaagtacttttgcctgtgccatttctgcatttattgtgtatccaaaaaatgtgttagcatcctcctttaggaacacaaggcaaggagacagtccacgtgtggaagacctacatgaacatcttactctgctagccctgcctccaagagaagcagctgcagccagcatgcagcagaaaaccaaacaggcaccctacagctgggcgacttgcttccaaagggaaatcaattttcctttcctgttgcctttcatatcaacatgcctgggaaagaagacgtaatggcttttgctctggaaagggaaatgtcactctaacacttgtattcactgaataagaagtaaggcattctcataaacagtaacctgatgtagagaatacttcaaaatatgccagagaattgcagatgaagctgcaagatatcactgaaatatgaagtcagcagatctgcaaactcagacagaaataaaacagctttttatctgaaagttatgtggtattgagagtttttccatgttttaaagttcttccacctgacccaaaccaaccacataagcaaagagctacatatacccctgcacgattctctacctctgaggttaatgagtaaactcaatcaatcctgctaagagtttatatactcattctcagaatatacggcttatttaaggaacctaaataactgcaatgggatgcccaggtcaaattcaaagagcagcctttgtggtatcagagcagaaggcagcaaaaaataaaccctttaatgaggactgggtttaatgctgatagtagcacttcctcatctcctttgagctttggggaaacaactgagagaactaagattaaaagactctaataaataaggcttctcaatttcttccaaaaagacatactaataacaaaacacaagaccactgcagagggtgcaaaagtacccaaaacagcaaaactcaaggctacaattaacaacccaattaaaaccaagtaagaaacgatatataatctttattatttgaagcaaaaattcccaaagatgaggtgccccaggaggtttccaataaaaatttaaaatcctgtctttctttaaaaaacacacaaactcggctaggtgtggtggctcatgcctgtaatcccagcatgttcggggggccgaggcaggaggatcacctgaggtcaagaatttgagacgagcctggcccacatggcgaaatcccatctctactaaaaatacaaaaaattagctgggcatggtggcacgtgcctgtaattccagctacttgggaggctgaggcaggagaattgcttgaacctgagaggcagaggttgcagtgagccaagatggcgccactgcactccagcctgggcaacagagcaagactccgtctcaaaaaacaacaacaacaacaacaaaacccacacaaactcattcatacaaataactgctttcatatacttttaaatgtgaagcttttccaattatatacagttagcttgtacactgccaacagttgtgtctcttctactcagcaggttaagggaaatacactgctcactctaaacagggcttctcaactgaactacaattaacatttggggacagataattttttgttgtggggggctatcctgtgcattgtaggatatttcgcagcattcctggcctcaacccatacagattctaacaacgcaacccactgctccagtgagaactacaaaaatatctccagatactgccacatatcccctggggagcaaatatgcccacagttgagaactactgctttaaacaaattatttgcctattgcagagatttcaaagggttaagcatctgtgttgcttcatgcaaaattatgcttcactaatatgcaatccataaaacaccattacgaaaactatagtctgccatgttctttgttctctgaaataaactagacaaattcaaagtattgcttgaaacagtaattccacagatgtttgagggtgaattaggagaacataatcaaatatcctgaaaattctgttgtttactggcaagtcctgaagcttgctaggaacagaattactcataggtgacctgctctggtcatggggtcaagtggaagcttccgctgtcacacaactaaagagaaaacctggtgtccacaaatgccaagggcaagggaagccaaatgccgatgaaaccaaatccctgatcttgaaaggggaaaagaatccctaaactcactttcccaaagcatggctgtaaacagaaaaccaagtggaaaagataaatgcaaaacacaagcagatgggtaaataaagtgtagtatacatacacacaataaaatatccagcaataagaaatgaggtacagatatatgttacaacatgggtgaaccttgaaaacattatgctaaatgaaaagagccagtcacaaaagattagatactatatgattccacttgtaataaatgtacagaaaagacagatccatagggacagagagcagattacttgttgcctagggttgcaagggtaaatacagagtaactgctatggttatggggctgcttctgggaatgatgaaaatgccctaaaattgattgtggtgatagttgccagtatctgtgaatattctaaaatgcactaaactctgtgtgtgtgtgtgtgtgtgtgtgtgtgtgtgtgtgtgttgtgtttttaagacagggtctcactctgtcttctgtgaatattctaaaatgcactcaactctgtgtgtgtgtgtgtgtgtgtgtgtgtgtgtgtgtgtgtgtgtgtgtgtgtgttgtgtttttaagacagggtctcactctgtcacccaggctggagtgcagtggcatgcgtgatcacggctcactgcagccttgacctaccgggctcaagcaataccccccccaactcggcctctccagtagctgggattataggtgtatgccaccacacccggctaatttttttgtattctgcaaagatggggtttcactgtgttgcccaggctggtttcaaattcctgggctcaagcaatctgcttgccttgccctccagcaatccgcccgccttggcctccaaaatgctgggattacaggcataagccaccatgcccagccaattgtacactttaaataggtaaattatatgacatgtgaattatatctcaacaaagctgttttaaaaacaaacacacagcagcagcagcaactgaattacaaactaacaagaaaaagctcaggcttcactacagccaaacaaaggtgcatctggctacgaaattcacaaggatgagctttacctctgcaactgagaaaaaccaccttttaaagctgtaaaaacacagtcaattaaactagtagagttttatttcacgtaatgctgagaatgaaagagagccttctttggaccacggtaatctttaatatacaggaattcttggtcaggcttactatctctgtatagcatgttcaaaagtagattaagttggacagggtttctttcagtttgcaaagctctaagattcaaagtaatttgcaaccatggcacataagctctcagcgtgtgatgaaaggaaatgacagggtgaattttatatttaacttaatacaattacacttcacacctatagaaaaaaatcaaaagcattcaaaatgcacttctaatccacaggtacaaattatatcaaaggaaaaatggaaccacaaaactcatcggagcagctcttttaaacacttagaatctctaagtctaagataaaaggcaaactggctctgactaaaaacacaagtctcagtcaaaattcaatttgctgttttctatgtctgagccattctaactgggtgtgattctaggttgaccaaatgtattaaccctgctctctctgttaacctgatgtcattcaaaaagaaaagcagaagagccactagaacaactcaattaagatgccagcaactagtaactaaccagggagggcaggagaagtcccaggacctagaacataacacttaaatgtagttataacactgatcatcaaataaacatcaatctccagaggagattctgtcagttcccccattatttcagcaaatgtttactgagttcatactaggtggcctaggagctatgtccagaacacacacaatctctaacctcagagagattacaatctagtgggggagagagcagacaataaacaaacaagtagattactacagacacagtctgtaagttggccataagatgtgctatagaaaaaaaataaagctgggcaatggccatggagaggtcatcaatttaaggtaatcactggcaagggatcactggacctaaacgaagcaaggtgcaagttacatggttaaagtgggggaaagcattctgggcagagagaaaagcaagcacaaagttctgactcaggcagaagcatgcctggcatgtccaggcaacagcaaagggacatggtggctgaagcagtgagcgcaagaagaattggagatggagagatagctcagtacttactcaaataagggaaaagccatggtggagttttgcatagagaagtaacaatccgaggtacattttaacagactccctctggctccttaggaaacaactcaggcaaggtcgtagcagtgaaggtgttaagcagtggtcagattctagccctcagaagtggctaacagagcgcacgtggtgtgagaaaaaaggaggccaaggaagacaataaggtttaaatccaagcaactacagtcatttactgacatgcaaagagaacaaaaactgggaattctgttggaatgtattaagatgtatgtgttgagtggtcagaaagctctgggctagacctaaatctaggagtcctcagtgcacaagtactaataaccatggggctggatggtatcaaaacaaactactagggatgaaatattcaagatggcaaagaatgctttgcaatgaatattatggacaggccaaaaacgttctgtaaactgccaatgaagttgaaatggtagaatgatggaaagactacatgacgatgctctgaaaagaatacacttttttattcacagagaagccgtctacataggaaacgggtgcctatggacaacttctgtattaatgatgttaccaaatactgcatttaataaaatccaaaccgctgaagtccttcctggctgatttccacgctagaagacacataggatggaaacacctccccctgctgtttcacagggaaatacaccagctgtccaaatgacttttgccaggtccttctgggctaacgaattaaggaaggaaaaactatttgaaagattcttgccttgtaaattaattctaaaaagagttgtcagatttaaaaattagctttgttaacatttctgagggcctaaattaaaatttttaatgtccatgtgaaaagagaaaaagaaaacatgtagtgactaattatatgaatttaaaacaaagttcaactctagaaaaaatgaaatttaatgggttcgctagtgatatttagctggtaccacaatttgaatccgaaataattcaaatagagcaacatttatatgtctcaggaaggcacactgttttaaagtaagtgatatgaaaaggtaaaactggatccaaaatctgtgagcattatcatgagaaatatatgattacatctgtaagagaaaggggaaagctgctagatttagaaaaaacatctcagccgggcgtggtggctcatccctaaaattctatctagcactttgggaggctgaggcaggaggatcatcactacaggccaggagtttgagaccagcgtgggcaacatagcaagctcccatatctccacaaaaaataaataataatttttaaaaagaaaaaaagaataatctcactccggaaatatattttttgtttgtttttttgagtcagcgtctccctctgtcacccaggctgcgatgccaaggcatgatcatggctcactgcagcctccatgtcctaggctcaagcaatcctcccacctttacctccagagtagctgggactacaggtacgtatcaccacacctggctaagtttccttaatttctgtagagaagggatcttgctaggtttcccaggctagtctcaaactcctgagctcaagcagtcctcacaccatggcctcccaaaatcctgggctacaggtgtgagccaccatgctcagcctggaaatctaatttaaagagatcaaattatcaaattctggctaatgacagggaagatgtttccagcaacgagagaaaatgcagtattattccatcactttctatctactcctgtgcaaacacatttcttcactgcaagtggaaaaaggaaactatgaaaaagcaaagaatggcgcataccttcaaaaatgtcacttaaaattactactgcaggtgtcaacaataacctttatggttattcagcctcagatatacttggcttctggactcaatcaatatgtcaatcttattgtaacttcacactttacagtgtctccatgcagcaacagcaacaacaaaaaaaaactcaagaatatgccagcatccttgtatcagatgtttactaccaaacaaacaaacaaaatctttaatactatttgctcagggtaaaataccaattctatctgcaaaacaaacaaacaaagctctttaaatatttaatcagcagtaattagaatcggaggacagaatgactagaatcagatggagggaagaaaaggttttcatttctaccctcctgataaggaaaacagccatacattcaagaataaaataacttttatcatttagaggagcctaattcatttatttatttatttattttgagacagagtttcactctcgtcacccaggcagttcaatggcacgatctcagctcactgcaacctccacctcccaggttaaagcaattctcctgcctcagcctatcaagtagctgggattacaggtgcccgccaccacacccggctaatttttgtatttttagtacagacagggtttcaccacgttggccaggctggtctcgaactcctgacctcaggtgatccacctgcctcggcctcccaaagtgctgggattacaggcgtgagccactgtgcccagccaggagcttaatttattacaacaagctctcaaggatgatataatgaccccatatcacagacaatacactccagtcctgtttaccatgtaacatattctctaataaaaattcataccccctgacaatgcctacctgggaataaaaaagagaatgtcttcaagtctatgtcatgggttttcaacataaatatgattcccctctaaagcaagcatctgtcaagatcttggaaagaaggtcattactgagaaaagcatttatttgtgaaataaacaaagggctccaaaacagaagtgccaaaataagaaaaagtcaagtatcatgtttctgtaaaaaatggagtgaaaaagcttaaggctataatattttttggctggcgcagtggctcatgcctgtaatcgcagcactttgggagccaaggcaggtagatcactcgagcccaggagtttgagatcatggccaaatcccatctctacaaaaactacacaaattagctgggcacctggtggcaaaggcttataatcccagctactctagaggctgaggtgggtggctcacttgagcctgggaggttgaggcaacagtgagccataattgcaccactgcactccagcctgggcaacagaataagacctatctcaaaaataaatattttcatattaaaaatattcaaattattaaaattgtaatatttattctttggtattatttagctcccatttataacaaaacatacccaaattaaatctatagcaaatgtaaaatgcaagctttcattaaataatatgtgcaaagttgcagctttttccatagatcaatggcctaagagaggcctcatcttgacatttataaattattaacacaggcctgttaaatatcacaaggctaaaagagagcctttgatttatggacctggacattatcatcagaaggaaagtaatacatacttctttttcaggattaaaaaaacaaaaaaacagctacgtcttcagaggtttaccaaataagttttcttaaatatgaaaataactgaataggatcacacatacaaacaataactgtgataacaccaagcaggactgaaggaggcagagactccatttcttccgcaagccagcggatctcccaacaacacttgtactggtcttgtgttggcaaggcttaatcaataccacacagctatttctttctaagcttccatctcatatagtgtaaaataaagacagtagagcaactgctagattaaataaggtctgtattccaactgtttaaagtcaagtgccccaatgttgacttgacaaacttcctcaattttgttgtcaaggaaaaatacgcatttcatactccattttacatactcatacttcattttacaagcaaagtaatcatttcatactccacaaccacaaaaatatcagaagctcagtttggtgcccaacgtaagcatatactgaagaactctagtctctagtgacccttcagctcacctggaaaaaaggcaatatacactaccagagaacataaatcccaaaagcaactgacaaatgcaacctgggaggctgaaatgtaaatggagcacacagttaaaacagcattctccagagaaatcccctttctcacttcagcaaacagaggtcttctcaaaagctttcagtggaaaaactgccacttctgattaaagttaatttgatcaaatccatggggccctgggggaatgcacagatccctcttttctctcctccctgctttaccttgcacattctaaagtgactaacaatatgactaactgcctagagacgtgccattttcagcaactggtaaattacagtgtttttttaaatcagctggttatgatatgtgctgctttcttccctatatataggcctgtcactttcgatatagttttaaataaacaaatgacatgatatgatacagataaaaagcatttttagaatatcagagagtatcagaattgtgcagaaaaggcccagaatggtggctcatgcctgtaatcccaaacactttgggaggccaaagttggcagattgcttaagcccaggagttcaagaccaacctgggcaacgtcgcaaaaccccatctctacaaaaaaaaaaaaaaaaaaaaatacaaaaattagacaggcgtggtggcaagcacctgtggttccagctactcgggaggattagccaggtgtgttggtgggcacctgtaatcccagctacttgggaagctgaggaaggagaatcacttgaacttgggaggcagaggttgcagcgaactgagatcacaccactgcactccagcctgggcgacaagagcgaaactccgactcaaaatacatacatatatacatacatacatacatacatacatacatacatacatacatacatacaggttgagtatcccttatttgaaatgcttgggaccagagcagtttcaaattttaggtattttcagattttggaatacttgtattatacttactggttgagcatctcaaatcagaaaatctgaaatggtccaatgagcatttcttttgagcatcatcttagcacccaaaaagttttgaattttgaagcatttcagatatcgtatttttggatttgagatcctcaacttggactcttaaggtttacactatatattaccatataaagggtctatgaagtctatatgtaagaaaactgttcaacaagttagtaatcaacaaaattaaatacccacagtaaatttcccagtgtaattcatctccacattacaaaacttataaatgatcaatgccaagtctcttccttagaatagaatgtgagtcacagattagaataacacaaatcttacaatttaactgcacttaactatcttaggagttctcagtgggaatctgacatctgtcacatcaatatgtgccttatctactgatggggtttcagaaaagtaatccaaaaaagcccaactgacctttcttttcaccttagagactcagctcacatgaagaaccatgtaaagaatgattctgtcacaaaacattcttaaatggcaagctgaaggactaaagtaagtcacatatttttttacactaaaaaaaaaagaagaacctgacagcaatgagagaggtgtcacctcccaagtgtgacattaaatcaaaatgttcataaactaaactaccaagaaggaataccagaaactcaaggaaaaagagactcttaatgcctaaaaccaccttagggtcccaaggcaaaagtatctctgccctcaatgagccctcatcacaacccaggctccaaactagggacaaaggcagaatccctctgtggtccccagggagttccaaccacccacagggatgagtaccaaatagggcagttattgctggtcactaacttgaactggaggaaaacgtctgaggcagttctgtgaatctttttctccattcaaagcgccctcatttgtcctagacctcagttcctgctctctgcaaatgccacctacatttgtctcagtttttaatatcttcattcaaaaacttacaaagaaaaatcatgtcaggcccaatttcctccttcaagaaaccactcctccagtcctccctaaacagcctcccccttgactctccaatacaagccttctctacagatcccctgtgcttgagctcaccctttcacctttgctcatgcgtccttgccactagcccaagaggggtttttgataaatgcacaccattcacatccacttcaagtgtcagaaaagtaatttggctgggcatggtggctcccatctgtaatcccagcactatgggaggccaaggcaggtggatcccctgagatcaggagttcgagaccagcctggccaacatggtaaaaccctgtctctattaaaaatacaaaattagccaggcgtggtggcacgtgcctgtaatcccagctacttgggaggctgaggcagaactgcttaaacccgggaggcagaggttgcagtgagccgagatcacgccactgcactccagcctgggcgacagagtgagtctccgtctcaaaaaaaaaaaaaaagaaagaaagaaaagaaaaaaaaaaaaaaagaaattgttgatgcttccaacccatgccatgccattccttaattccttttgtaatcacacggtcagtatttcacaggttagcgttctaacataagaataacgtaaaaaccttattattcactaattcatatgtttcatgtaccatctcccctcacccttctctgtagggctccactgacagaacatacccttgtccttgctagttttgtaaacatgagctagtcaatttctctgtctagacttcagtttcttcactgacaaaatgaagataataatatgacgtatctcatggagttgtgaggaataagcaaaataatccatgcaaacttaccaatccacacaatgctagcagatacaagatgctcaataaacctcaacactgctgatgacaaaccatgttattcacatctttagaattccacagcacagaggcaagcaataaacattttgcagaaaacagtatctaaaacacatcaatctggtcccagaaaaactatttgtttgtattgcttaacaggaagagttgtttgttctactcaagaagcctgccttgactcctcatatccctccaaagggcctgcagccctccggaagcctggtttcccaagccaacccttctcaggctgcagaagcatggtctcctggttgctgttcagatccacgagaacaggaactgtgccacatttacctctgaaagtaatgaaatatttggtcatgaataaaatcaatttattagatttcatttttcattattcactaacaagctttcctcttttataatcaaagggcacagattcttaagtaaaaacaatatggttttcattaacgtttttcttaaatacttaaaaaaaacaggcgacttttgggtcttttgttttaaaaattaaattatggggccagacacagtagctcacgcctataatcctagcattttgggaggccaaggcgggcaatcccgaggtcaggagatcaaaaccatcctggctaacatggtgaaaccccatctctactaaaaatacaaaaaaaaaaaaaattagccaggcatggtggcacgcgcctgtagtccctactcgggaagctgaggcaggagaatcaggaaccgaatcgattgaacctgggaggcggaggttgcagggaggcggaggttgcagggaggcggaggttgcagtgagccgagatcgtaccactgcactctagcctgggcgacagagcgagactccatctccaaaaaaataaaaataaaaatacaaaaagtaaattataactctccaactcacatgctaatagtctttacattcccctttccattccaactttctctaaagaaaaaatgtagaaataatcatgtgtccacaaaaccacaaaatgtctagacataagagaatgctctcagatattattcctcttacagccatatgacccacttaagaactttaatctagggccatgctgtccagtatagtagtcactatctacatggctatttaaataaatttcaattaaataaaatttttaaaatgtactttctaggtcacactagccacatttcaggtgcttactagctacatgtggctagcagctaccacactggacagcacagacacagaacatttccattgccactgaaagttctattccacagtgctgatctaaagctaaatgtatggtaagtacaaatattaagattctcatttcctcaataagccactctcttttaatcaactctaatagcctcaagtacaagaatatgcataaacatgaacccaggggactttatctttgactctcacaaaggcaacagattacaattcttcttaggaaagacagtgagacagtcccatagcaatctaaggctttattcttccatttcttcagcaatttacacaacgtgacccgaggaaaaaagagcaagaaaccatttttttccactacctttatctatcatagtcacatctgccaagttttagaatcacaggttccattatcttacaccgtcagcactcttcctttataaattcccctctccacactgatcttctctgactcactcaacatattataccatcactctgaaatcagggcctagagtctctggcagacaggctatatgtaatgacagcctgggtacaatcttaagtctaccctccctcagaggatttcccaaccctatgcaattgtcatgtgggtaggcagaaggctgcacatttttcttcataataaaaacaaagcttcaatttctgtaaaatcaataaattacctccgtatttataatacaggatgatggcagagttctgttttctacaaaactagagcttttaggagcacatgttttcaatcacttatttttcaagaatgattgaaatatctccaagcgctccctgagaacttcactggtgtgatctgccactcaagttaattatcacaggctgcttatacacaggaagagaggaagcgggaaagaactcatgaccttgcacagggatgttttataaaattctctaaaatttaaactacacacgtttttccataatgcaacactatggtactgccttcaaaataatcatcatggaatagctgttttcttagtgatgtatggggaaggtggtagcgggtaggggtgcaagagattctgtacacataagaaaggcagtcacgtgacaccaatgtccttttcctatacacctggtggaaaatggagaaagccagaaaaacctgttcagtgattatcattctgattttttggttattacttcactaaaagaaaaaaaaatacatctgagtatatgcataagttgcatttctctggagtacttccttctgccctctgagtccaggtaccaatgatctctgaggggaaaggtcagccatctgccatgagaagaggccaaaatgtgggcaactattcctttctaaccaaagcacttctgaatctgagaaagcaagcaaacgtagtgtggtgtataaagcaaattctcgcccggaattctagcttgaatggagaggattccatagaaaatgtttccagaaggactctgacaacagaaagaagcaattcaagaacaaggacgtaatgccatatggatgggggaaagaaaggaaaagaaggaagacagaggaggagtctgagaaaatcttagttcttaagcatgagaatcagaactgtgggcttcagggtaaaaaggaaagagagactgaaaagtaacatctatgtttaaatgggtcctttagagaaaagaaagcactcagctaggattaaaggaaaagaattgtacctcctcaactccgtttcagagtataataaaccttaccaatttagaagctacacaccctttcacagttcacattcagctcagactgggagtcggaaattgaaaaacactatagcccgggagaaagagacaggtaaacatacaaaggactgagacaactgcttaccactaatatgggtcaatctcgcaggaatacttgcaaaaataaaaattaccaagtgccctctacgaatgctaaatacaggtcaaaatttccaatggctcaaccacctgagtggagagccggagaatgggagtcagaaagcatgtaaaaccatcgaggtcccgggaaacaaatttcctaggcttttaaaaccattcgtcttttctaacttacagaaaacgcaaactgaaaccattcagaaataaaacaaacggggcagggggcaggagagaaacggccaacaataagctactattctcctaccactttctcactggtgcaggcatctccaaaccaaaccactcagaaattttatatacaaggaataaatcataaggatctcatataggactattcatatactaaattatgtataataaccggggagtctttctcttaatatttttgtcaggagctctgaaaatgaggttttagaagccacagcatacctattcatcttaaaaggtaagatggcttgctttcagtttagctaagctttcatttctatcgtaaatatttgactttagaacactgaacaccatggcaaaaggcaaatatttacttagcttaattattccatatatactgttctacttcccctgtaaatacaaaatatgagttgaaacctcaaatcattaatacctaaatttggccacagattaaagtgtgctattaaacatctcaacaaattgagattaggtaacactttaagttctatatcacaagtcttaaactaaatcaaaaaaagtaaatgaaatttatctataatactagagatcaacaaagaaattaaactgaaataggtactaacgcaatcaccacagatttccacagatcccagtagaaataaagaagtttaatctttagttgaaattttaagagtagccattaaataagtaggacaggaatggaaggcgaaattgattcttttatatcctaatattcatattgagagatctgggcaaatatagtaagtcaacttggttctgggtttgagaaataagcacttaagtacaataaactccacaccagaaatatttttgtatattctactctcatttcaacataaccatgcaaagccctaatcagactaagggcttattttgatcataatctcctttactctgaaccctacctaccctgttttggctaagtgacagattttggccttcctctacccaggcttaccacccccaacctgtactgaagctctgtcgtatcatgagatgaagtctgcttagtaataggtgaaatgggacttgttcccttctttatattataggctgtctataacaaagtcaggctctatattcttcataatttcatgactaataatttcaactaaatcctatctcatttctttccatgatacaataaattcttcacatttcaatataaatctctttatcaataccacagcctttgaatttgcttaagccacacaaccaattcctgttctgaggtactatgaaaatattatgtggcttgttttattgtttaaatggaactttcctgtgggcactgttgttgttgtatgacattaattatctgtccagttcagttttacccaccataaactttctcaaaatgattgggaccatgtcttgttttatgagtgtatttcttgatttctttgacatttcagtgtccactagggactggtaataagccttccaatgtataggtggtaaaaattgttacctacacaataaaaataactatactaattcacgaacttctctatacctagaaatgtgaagcatgtaataatgtttaacaagaaatgccggctctagtactataatgcagaataaaaattaggcaagtgatgactcatacttcacaggtatgccagcctcaatcaggttttcaacccagtctttattagaaatgacaagtgattctttcgcatgccttaatttaatccaaagagcaatcaaggatctgagtgtgaaggtaacagattcaatgatgggaaatacaactactactcaatgctatacttcggtaaaataaacactggtatagcccaaagaccccaatcagaagttagactccataatttaccaactctgcctcactgtctttaccaaaaaaaaaaaaaaaaaaaaaaaagaatggaactcaaaaattctattagtataatcatcaagcttcaaaaaccaaatataacaaatgttacaaattatccatattttagatgccaaatgcctgaagaattaataacatcaaaaatggaatattcaaaggggagaggatgcaggcccagcctcacgccaagccatcctcctaggaatcctacaagtctataccacacatgtaccttcacccttttgttttccttttaatcccactcctccctccagacttgttccttcatcttttccccaattctctgcttgagaatggcataaaagggcaccacttagtagaatctaatcattctacttaaagactaaagaaatgaaatggctggaccctgctaaagagaaaagacggggagggatgggacacctttccaaaaacctcttcagagacacacagaaattctacaacccatccactgtagactgtctaagggaaaactgttccccacagttactggtgctgcttttaacagaataccaataaaggtataaaacacagaaaatattcatttatggcagagattaaaaacaaaatatatgcatttatatgactttatttttaaaaaataaattgaccaggcgcagtggctcaggtctgtaaacccagcactttgggaggccaaggcgggcggatcacctgaggtcaggagtttgaaaccaatctcaccaacatggcaaaaccccatctctactaaaaatacaaaataagccgggcagggtggggcatgcctgtaatctcagctactcaggagactgaggcaggagaattgcttgaacctgggaggtggaggttgcactgagccaaaatggcaccactgcactccagcccaggcaacaagggagaaactccatctcaaatcaatcaatcaatcaatcaagcacagctaccaactccttggggatattacaacctaatcttaattaaaaaataaattcacatcacaggttttccttcaaagccaggttaacaatactacttcacaggttaaatgccagtttttttggtttttaccactggccttaaatgattgcattaaaacacaccaaaaggatcttagtaattaaagatagatactaaacaaaatttccacttaaagtcatgctaaagcaggacaaatttttcatggttcaaggtgtgcaaaaagccttcattttaaagaatgcttcaatgaccaaatacattttcaatgaatcaatgtaccaaataataattaggtatattaaaatatccactttaattacaggaaattttgttagaaaagctagtatcatgaagccactgtcataaaagaagaaataatttatcattaaaaaaaatcctgggcataaacaaaaaaccccgccctcctctcatatgatggaatcaatgctgaaacacggaagcttataaaatcattttaccaactgttacagaagcactaagtatcagacacaggaaaagggggcttaaaaccaacatatttcaactagagatttaaaaacaaacaagaatgattaattaagcaataatcaagttcaaaagtatttggtgaaatagtaagtatagctcctacaaaggataatcaaacccaagcacaatctgatgcctgttaatccacctctccctatgagctgttaacccacctctccctatgagaagccttcctgtcaccaccatctttgcctcctgcaattgcaataaacaggaaacactaattggtcacctccagaagctaaataccagcaatgggtgggaaatccctttactcattcatccattcattcattcattcattcattccattcatttgagacaggatctcactctgtgatccaggctggagtgcagtgcacgatcatggctcactacagcctcaacctcctgggctcaagcaatcctcctgcttcagtcttccaagtaactgggaccacagacacgtgccaccacagccagctaatttttcaattttttgtagagacaaggtctcactatgttactcagggtggtctcaaactcctgggctcaagcaatcctctcttctaggctgcccaaagcactgggattataggagtgacataccacacccagcccaaatttggattttaaagaactaatttgatgcttccatagagaggaacttttaaactacacatttcctgattcaacagtttacctactacacacagaaaggctttccaggaagcattttatatttgctaaataacggtaagtaaaatattttaaagtcatccaagtttcaataacaattatcattacttccttactttgaaagctacaaccatatttccaagtattaaaacaacaaaatacaaataatcctaagaaatccacaataaagatttatctattaaggccgggcgcggtggctcacgcctgtaatcccagcactttaggaggccgaggtgggtggatcgcgaggtcaggagatctagaccatcctggctaacacggtgaaaccctgtctctactaaaaacacacacacaaaaaaacaaaaaaaatcagccgggtgtggtggcacgcccctgtagtcccagctactctactgtttagaatcgttttcaatgtccaaaaatgtgactgctttagagatgccaaataagactaatttaaataacctaagattgctccaattaccgctggtttttcaggtggtacaatgtataaaccaaagaaaagaagctggtgcataaaactcagctggctgaagaagttaaaaataaaactccacaatgatatgtggtttggggaaaaacatcagagttccatttagacatgttaagtgttaggtgcttactggacatgtgagtggagctatatcttctgagtggagatacaaggaaggcagctaagtaggtctggactaaagataacattttaaactctttaggtaatttttttttttttttttggaaacaaggtctcacatccatcacccaggctggagagcagtagcacgatctcagctcactgcagcctcgacttcccaagctcaggcaatcctcccacctcagactcccaagtagctgggactacagatgcacatcaccatgcctggctaatttattgtatttttagtagagacggggttttgccatgttgcccaggatggtcttgaactcctgggatcaagcaatccgctcgtcttggcctctcacggtgctaggattacaggtgtaagccactgtgtctagcctgcatttaggtaatttttaaagccatgcatcctagggaattacgtagaaattcaacaaatatttatcagacacctattatgtgctggagatagagcagtaaaccaaagagtcaaaattctctgtcattcaggactttacattctggtggaagaaacaagacaataagcaataaaaataaagatgtagccgggcacggtggctcatgcctgtaatcccagcactttgggaggccaaggcgggtggatcacctgaggtcaggagttcaagaccagcctggccaacatggtgaaaccccatctccactaaaaatacaaaaattagctgggtgtggtggtgggtgcctgtaatctcagctacttgggaggctgaggcagcaggatcacttgaacccgggaggtggcggttgcagtaaactgagattacgccattgtactgcagcctaggcgacaagagcgaaactcagtctcaaaaaaaaaataaaggtgtagtttgtgatgaagacaagtactctaggggaaaacagagcagagtaaggacaaagtagagccgagactgagggtcaaggtaggcctctcactgagactcgaaagcgggacggtgagctacagatatttggagaaacatatcccaggcagaaggaacagtcagtgcagaggccttagtgatcatcacaagggcagtttccctggagcaacaacggatggatttaagaggaaaggagaactggagatctgggtacagaaaactcttgttgagaagtttttctgcaaaggaagcagagaaatcagcaatagctggcagagtaagtgggatccaaatacgggagtttgtatctgttttaagattggagaaaagcggcatgtttgtatgctgctgggaaagatccagcagagaatgaaacatcaacattatgagagacaggaaattactatgtgagagggcacgggtggcgcctcagagagttccctgaacagctggtctatacacaagcagtggggaaagcacaggatgccctggaaggtggcaagatgtggtaggagtctgcagaagggctcttaagactgttctgattttctcatgcaagtaggaagcccaccatgaggccaaggaggaagtataaaaggacaatgtatgaaacaggcatctaagaaactgcataagtgaatggacttgcccaggagccttaaagctccatttgacgtttattaaccaattgggaattaacactgagaaactcaccaaatctgagacataaaggctgactctgactttctactataaataaaaaattctctaacaaactgctgaaaatggtcagtgtctaacatatttgaatatacaatacttggggagagtcgtaatttctccaaataatgtgttgaaagagattacatcccattttcacaccatattcataattgcttcgtcatacataacttgaagggagtcatcagtcattgaaggatttaataaccttaagctgaagttaactcccttatgtcagaccacagtaaacaaaagcagggttttaatgccttaagccaattatatattgcaaagtaaaacatcttatattcttattcacagaagtacaaatttagttttagtttagttatattcttattcacagaagtacaaatttacacaaaaagattatctaacagcattcaattaatcaccaagaactgccatataaaaatctatttctaataatatggtcctggttgcacaactctatgaacacagatggtccccaacttaagagggtctaacatacgattttttcaaattaacaacagtccaaaagtgatacgcattcagtggaaaacatactctaggtaaccacacaactattccatttttcactttcagttcagggcacagcgactaacgcctataatctcaacactttggaaggccaagtcaggaggatcgcttgaaccaacgagtttgagaggagcctggagaacatgagacccctatctctacaaaaaatttaaggccaggcatggtggctcatgcctgtaatcccaacactttgggaggcaaaggcggatgacctgaactcaggagtcgaagaccagcctgggtaacatggtgaaaccccgtctctactaaaaatacaaaaatcagctgggcgcagcacctgctattgtaatcctagctacttgggaggctgaggcagaagaatcccttgaacccaggaggtggaggttgcagtgagccaaaattgtaccactgcactccagcctgggcaaaagagtaagactccatctcaaaaaaaaaaaaattaaaattaaaattaaaaaattagccaggcatagtggcacacacctgtagcctcccagctactccagaagctaaggtgggaggataacttgagcatgggagctatgatcgtgccactgggcaaaacatctatctgtctgtccatttgtccatccattcatccactcatacatatataccatgagatatccaacactttcttatataataggatttatgttagatgattttgcccaactgtaggctaatgcaagtgttctgagcatgtgtaacatcggctaagctaagctatggattttggtagattaggtgaattaaattcattttcgacatgtattttcaacttaggatgggtttcctgggacacaactccatcttaagtcaaggaacagctatatactggaaaccattgatttgtatactttttaaatgagtgagctatctcgtataggaattttctctcaataaagcttttttaaaaatctattccaagcttttaatctaaagaaatagttttatcaagtaaaaatttgattttttttttagtttctttgttgaaatttcaatggaaaatggagcaaattaagtatgttctgacagcttatgaatataaactttgtagagactcagaattctttcagaatgaagggcagaattaaggatggagtttttggcctttggtttggttgtttttcttctttagttgactaaagtttatagtttctggcattcctgctttatccctttgatgaagacatactcaaatcactttgactaaaataaacagcaattttctggttgtagatagccacaaataactcctctatcctattacagacattcatcagcaagactgagtaacaaaccaatacctgtataaaaatgaaaggatacaatatcacaagtactaattcaggtaatatcacatttcttagagttatgacacttcaaagaaattttatacttcaaatctaaacagcaggccaaggaattcatattttttccctgagacaggaaagataattcaataatttccccactgaagtttcagttcccatgccagaatgtgagaagtgagagagttcttcaccttgaaaatcaaatcaccacagggactaaaaataaaggttatattcttctaagcaaagcgattataagactgacaaattaaggtgcccatcgaaggagcaatggatacaggaaaaaaaaaaaaaaaactactaacaggcttagttagccacttccaaaatgtaaactgtaaatgtgggaaactcaatgaactgccctacacttgcatctcattttgtgtaacctgagaggctaacatctgttctgcctccttcagaaggcagctgtaaggatggaactagaggccagtaaaggctgttcagtaggtctaaagtcttctgccaagagaagtataatcctcatttcgttctcaaaaagctcagtctctgtagtaacatactgatcatcttctgcaggtataaaatttatgctctgtattagtccgccataacagaataccacagactgggtggcttaaacagcaaaaatttatcgcttgcagtttcggagtctcagaagtccaagatcaaggtgccagcagattcactttctcaatgagggctctcttcctagcttgcaaatggccaccttctggggctgtgtccttacatgtcagagtgagcactggtcatctctggtctctcttcctcttcttataaggacactaatcacatcatgaggagccccaccctcaggatctcatctaaacctaactgccttccaaaggctccacctccaaatactatagcacttggggaacggaaagctaaggcttgaacataggaattttgaggcaatacaattcagtccacggcactcgcctacacaatttctttactgattgtctctaggcagaaattaaatctttgtatcgagagagaaagatagtttgaaaggatggctttaaagggggctgaaggtagcttactgagatttagacaatgtaaaataaaatttaagaacagatgagggtatttggtggagaataatagctaagaagtattaagtatttacctttgtggatagtttccttaggtcacacacctagtttcacgggtcacacaggctacaaagcctttacttttaattatacaatatttgcttctcttttccttggaacaaaggaaaaaatagaagaggaggagaatctaaaagatgaaaccatgaatgagctgctacataaaagtatgtattcatgttcattttgtaccttttgttagatgtggccaaaattttagtttattttttatttttatttatttatttatttatttttgagacggtgtctcgctctgtcaccaggctggaatgcagtggtgcaatctcggcttattgcaacctctgcctcccaggttcaagcagttctcctgcctcagcctcctgagtagctgggactataggcgcgcaccaccacgcccagctaatctttgtatttttagtacagacggggttttaccatgttggccaggatggtctcgatctcttgaccttgtgatctgcccgcctccacctcccaaagtgctgggattacaggcatgagccaccgtgcccggccggccaaaattttacaagcaaatggctcaaaggaaacttgatgagttacaggattctaaatctgtaagttagaaaacaaaccacatgctcagaaggtctggttttttttggtactaagagctaagaaaagtttatctctatgtcctcataaagaaagcagtttaatacggtcaacagcagccttgggaacccctttataaaccattcagtacacacaaacactgttccacaagtgttcgcacaagtcaatggcctcaaatcaatataagtaaagcaaacctgccaaaaataagaaatgcaaagccttcctagtcattcaaacatagatctagggctcaccagaataggagttcttaatgagagggttcatggataggcttcaaaggctacataaaccatctgcaatttatgtactcaaacagtcacaaattatgttctgggagaaagatcatatattacaccaatactcaaagaagtccctgataaaaataaagttaaggacctgtaacaagaattaatgaactacataaccatcaggagagcctatccaaatcatcttaacaaccaaggcactgggtacttatatgccacaattaggctgatgttaaattccaacaagtagctagtactggataaatgcagagtcaaacgctctaacttagcttaccctggaagtagttctaacctcctctaagaagtgcacagtacctgttgcatagtaagcccctgaatatgcactgctgcaattattactggatatattacaagctccaaggacaggaccaaatcttctgcatttctgagttccttgatcattaaaataaatggtcctcaataaagaaagaaaataatacaaacatttaactctacatagatctagcaaataaggaccttagcagaatgggtttatttctaaaaactgaaaagcatccctttgttttataaaatgaaatgttttggaaaacgaagaacacagggaaactgaggggaaataacacttacatggaaccactaacaaattcatactacggtcatccctcggtatccaaggggaactggttccagaacctccacagataccaatatccagacactcgtatataaaacggtatagtatctgcatataacctactcacattctcccatatactttttttttttctttttttttgagatggagtctcactgtgtcacccaggctggagtgcagtggtgtgatctcagctcactgcaacttctgcctcccatttcaagcgattcttccgccccagactcccgagtagctgcgactagaggcgcctaccaccacatctggctaatatttttgtatttttagtagagacagggtttcactataatggccaggctggtctctaactcctgatctcaagtgatctgcccgtctaggcctcccaaagtgctgggattacaggcatgagccaccgtattcggcccggtatactttaaaaagaatctctagattacgtataatacctaatataatataaacgctatattttttaatttgtgcttttttctaaacatttttgccccacagttgattaaatccgtggacacagaagccaagaatacaaagggcttagtgtagcatattttacatgaaccctaacctatcactctaccagaattatgcccatttaaaaatctaattagattgtattattcctttttacatctaaagtttatgctttccgcttacaagacagagtatgaggcacatgtaatgcataagatttatggtcctcgtttctcctgctccatgacaaatagtagagaaaaataaaaactgtaacagagctggcatcggaaatgagcagttatatgaaaaaaaaaatttaataactaagaagggctaaaatccactacactgacaacaccaaatggtagcaagtatgtggagcaacagaaactctcattcattgcttgtgggaatgcaaaatgctagagacacctcgcaagacagcatggccgtttcttacaaaactaaacatactcttaccatgggacacagaaatcacacaccttcatatttactcaaaggagctgaaaacttatctcaccacaaaaaactgcacacagatgcttaaagcagctttattcatcattgccaaaacctggaagcaatccagatgtccttcggtaggtaagcagataaataaacttcagcacagctacatgatggaatattatcagtgataaaaagtagtgagctatcatgctcacagagacatggagaaaccttaagtacattttgctaagagaaataaaccaatctgaaaagactacatactgtatgagtccagttatatgacatctggaaagcaaacctatggagatattaaaaaagatcagtggtggccaggggcttgggggcagagagggagggatgaatagggagaacatagggcatgtttagagcagtaaagactcttctatatgatattgtaatggtagatgcatgttatgaaacatttcaaaacccatggaatgtataacaccaagagtgaaccttaacatacactatagactttagttataaataatgtatcaatattggctcatcaacaataacaatgtaccaaactaattcaagatgttaataggggaaactgggagttaggggggatgcgggaactctgtactttctactcaatttatctgcaaacccaaaaccattctaaaaactagtctactgatttaatgttttaaaattttttaatgttttaatctaccatataaaataaaatgctacttatctaaatgcttaaatgttaggcctgttagcaaaactgaacaacaccaattttctttcccaaaaaaaaaaaaaaaaaaggccagattgctttaatccttacattttccgcacttttagttctccttttccattcaaagagccaggaagtgctagccagagcaatcaggcaacagaaagaaataaaaggcatccaaacaggaaaagaagaagtcaagctactgctctttgctggcaatatgattctatacctagaaaaccctgaagacgccatcaaaagactcctggtacaataaacaacttcagtaaaagtttcaggatacaaagtcaatgtacaaaactcagcagtatgtctatacaccaataatgttgaagctgagagccaatccagaatgcaatcctatttataatagccataaagaaagaaaataactaggaatacacctaaccaaggagggggaaaatctctgcaaagagaactaaaacacactgctagaagaaatgacaggtgggctgggcggggtggctcacgcttgtaatccaagcactttgggaggttgaggcgggcagatcacaaggtcaggaattcaagaccagcctgatcaatatggtgaaaccccatctctactaaaaatacaaaaattagccgggcgtggtggcacatgcctgtagttccagctactcgggagactgaggcaggagaatcatttaaacccgggaggcagaggttgaaatgagccaagatcatacctctgcattcacggctgggtgacaaagcgagactctatctcaaaaaaaaaagaaatgacagatgacacaaatggaaaaacatttgatgctcatagattggaagaatcattaaaatgaccacactttcctaagcaatctacagatttaatgctattcctatcaaactactaatgtcatttttcacagaattaaacaaagtaattctaaaattcatatgaaaccaaaaaaagtacccaaagagccaaagaaatcctaaggggggggggggaatgctggcagcatcacattatccaacttcaagctatactataaggctacggtaatcaaaacaggagggtacaggtacaaaaacagacacatagaccaatgaaacagaatagagaacctacaaataaagtcataaacctacagccatctgatctttgacaatgctgacaaaaacaagcaatgggtaaaggactgcctattcaaaaaatggtgctgggatagctagctagccatatgcagaactggaccgctaccttttcccatatataaacatcaactcaaggtggattaaatatttaaatgcaagaccacaaactgtaaaaatcccagaagaaaacctaaaaaacaccattccgacccttggctttaggaaataatttatgactaagtcctcaaaagcaactgcaacaaaaacaaaaattgacaactgggacctaattaaactaaagagcttctgcacagcaaaagaaactatcaacaaagggccaggcatggtagctcatgcctataatcccagcattttgggaggcccaggggggcggatcacctgaggtcagcagtttgagatctgcctgaacaacatggtgaagctccatttctactaaaaaaaaaaaaaaaaaaaaaaaaaaagccaggcatggtagtgagcgcctgtaatcccagctacttgggaggctgaggcagagaatcacttgaacctgggaggtggaggttgcagcgagctgagatcacgccactgcactccagtctgggtaacagggtgagactccaactcaaaaaaacaaaactgtcaacaaagtaaacagacaacctacaaaatagcagaaaatatttaaatatcatgcatctgacaaaggtctaatacccagaatctataaggaactttaacaatacaacaagcagaaaacaaataaccccattacaaactaagcaaaaggcattaacagacattcctcaaaagaagacatacaagtggccaacaaatatgataaaatgtttaacatcattcatcatcagagagatgcaaatcaaaaccacaatgaaatatcgtctcacgccagtcagaatggctattattaaaaagccaaaaaacaacagacactggtgaggctgtggataaaagggaacagttatacactgttggtgggaacataaattggttcagccactgtggaaagcagtttggagatttcccattaccaggtatacatgcaaaagaaattaaatcgttctaccaaaaatacacatgcactcgtatgttcatcacagcgctatacacaataccaaagacatggaatcaacctaggaacccaccaatgatggactgataaagaaaatgtggtacaggctgggtacggtagctcgcgtctgtaatcccagcactatgggaggcagaggtgagcagatcacccgagctcaagagttgggagactagccagggcaacatggtaaaaccccatctctactaaaaagataaaaattagccaggtgtggtggcacacatctgtagtcccagctactcaggaggctgaggcaaaagaatcgcttgcacccgcaaggtggaggttgcaatgagctgagattgtgccactgaactcctgcctaggcaacagagtgagacactctcacaaataaacgaacaaggctgggcgcggtggttcacgcctgtaatcccagcactttgggaggctgaggcgagtggattacctgaggtcaggagttcgagaccagcctggccaacacggtgaaaccccatctctactaaaaatacaaaaattagcagggcatggtggcaggcgcctgtagtcccagctactcaggaggctgaggcaggagtatagcttgaacccaggaggcagagattatagagagctgagattgcgccactgcactccagcctcggcaacagagcaagactccatctcaaaaataaaaaataaaataaaaacagttgaaattatcaaaaaaaaaaagtaaataaaatgtaatggaggtactagtgaaaaaaataataagatccaaactcaaattgctcctgcacccaacacacttaagagtaaatactgttaagagtcctttccatgaacatctaacatattgagaaaggtgaatatttcattactgaacatttactctaacctatgttaagaattatgatctgtggaaagagcacaggctaaggaagctgcctaggtaaatagccaaaaaacatacacataagatgaaaacttgtctgcgtcattttcctaccactcaaaaaagaaggtaacagtaagaaataaacagcaaaaacaaaaagaaaaaattgttcaaatgttcaatctagatataggtttttctgtataatttaatcaattaataaataaatacacatgtatctttcttcccccaaccacaccccccccacacaacttttttttttttttgagacggagtctcactctgtcccccaggctggagtgcagtggcgtgatctcagctcactgcaagctccgcctcccaggttcacgtcattctcctgcctccgcctaccgagtagctgggactacaggcacccgccaacacacccggctaattttttgtatttttacaaaatgtttttcaccatgttagccaggacggtctcgatctcctgacctcgtgatccgccgcctcggcctcccaaagtgctgggattacaggcgcgagccaccacacccaacctaccacacacaactttctaaagttcctggataatgttctaaactctttttctatgttttacatgtaacttatgcaagccattcactttactaagcaaatgaacagtagtgtctgtggccaaaaataataagacttaaaattttgagtccttccaaaagaacttgtattaaatctttggaatagaaaaaaaaagttcatattagggagtagatctgggtattgaaaggcctgtctttttttgttggtaatgccaaagaatgtcatcacacaagactcaccttataatattatttatgtataagttatcaattacatatatttaacattttaagtgaaagcaagtttattaagaaagcaaaggaataaagaacggctattccttaggcagagtagcctatatttaacattttttaaatgtttaaaattataaagctggtgagtaaaacaaaaacatctttgagtgatacagatcggcagaatttccccagcctcattcctgagagaccaccacataaaaataacttggttatctgcttctgtatgtaaactcaggttgtttgtgcaaaacataaactgccccaactaagaaatcctgaagaacatgcaaaaggaggtactttcactgtcattttattaaaaggcacacaagtcactactgctgaatataccactgtttctacccagctattttaaaattattggtagataatgtggtgagctactggtaaatacagctgtgaacacagcagcacacaccatctggaggcttttgacttaagcgatttttcaaatgcacagtatatttacactcttttgttcctttgaagcccaccagtcacatataaatggaccctttcttaaaactacaactacaaaagctcattcatcttgtggaaaacaagatatgagaaacaaatctaattgttcagctttagaacaagtgattatttcaaatcattaacagcataaatactttactttttctatttttattttttttaatagatagagacagggtctcgctatgttgccaaggctagtcttgaacttctggactccagagatcgagatcttcccaatagggcctctcaaaatgctaggattacagacgtgagccactgcacctggccccaacactttacttttataatgatctcccatacttacccattatattcttattatcttaacaagaagcttctgattaatactctaaaattaaatgttttcttcttttttgtttttcaatgagacagggtcttgccctgtcactctggctggagtgcagtggtgcaatcatggctcactaacctgctcagaaattatgtttgtaagtttcacgaatcatcatgctcatttttatttgttttgtcctcctccactggaaaataaatgctatgagaacagagacttcatcttttttgtatcttcagcaactaaaacagtacctagtacataattagtgctcactatgttaactattcactgttttcccatgctaagcatggtcctaaagcatttcgtaaaccctctaggtagactcattattttctggtatgagaaaacagtcacagaggttaaataacttaccccaggtatcacagtgagtaagtggtaaactaagaatagaactcaaactcagacagcctaactatttaccactacgctgtactgaataaattaatgaattacaccagagttcaatgataacattaaaaattgagtaaaattatgctaattttcctattgactaagcatcaacattattctgttttattacaaatatttaagtatgtcaactatttcatggattaattagattttagagggaaagtctaagaccccaatcatcattaatatgtggaattggataacaacctggaaaaagacttacaaatgaacttgtgatataacctgtttgaattggatgtaggatacctacttccctccattattccttggattcagcagtctgttgccaatctgaatgttttaacttcttttaattagagaaaacattttctatataagttacaatgaaattatcacgttttctagaaaatactgcactctactgcttcattccaggttgtctgaagatggaccaatttctccaatgaattaaaaagtatcttagtctaagacaagctctctttctacccagccacccccacgagatcccactccgccccaacaaccctcagcccccatcttctatcagcaaactgggcctctgacacaaaggtaccacatttataatatcagctttagtcataaacagatttcaatcaagtttgtttctacgacttttgctcctttttaaaaatgcaatggatagcccaggcgcagtggctcatgcctgtaataccagcactttgggaggccgaggcgagtggatcacaaggtcaggagttcgagaccaacctcgccaacatagtgaaaccccatctctactaaaaatacaaaaattagccaggcgtggtggcacacgcttgtagtcccagctactcaggaggctgaggctggagaatcacttgaacccgggagacggaggctgcagtgagccgagaccatgccattgcactccagcctgggtgacagagtgagactccaactcaaaaaaaataaaaataaaaataaatgcagtagataataacagctctggacagtagtatctactcaacaggaaagcagacagtaaagagaccagaccactgagaacccatgtcagtcacattacaatctatgttacagcctgaaaagcctgaaaagactcaaatctactcataaatactttctaataacttgaaacaataacactataaaatatcaagttggccacacatgcccctgagcagacacgtctaaaagcttctatgtgccacccagcccatggccaaactgctgttggtcaatgggttgctcaagtccttttgtacaatgtaacgagaggtaagagacaagggggaaacattctagccaccttatctccaatgatgccaacatttatttctgcttgagttttacaaactaatcctagactagttaacaaagaacccatttttcattgttgatttttacacaaaatattggcttcctatgtcattataaaatggatggctccatcggcttctcagcctacacaatagcaagcaaaaccctttggccttggaaaagcatggtaaatataatacctactaataagttacatggtttaccaatttcctcaaaatcaaaaataaatctctcacaagtcaactattaaataagtaaacaaaagcttgtcttgttctatcacttgcttaaaagcaagcacggtggcatgggagagggattaagaaacacaaccagtcaagtccataaaaccttcagtgtaagataaaactaccctgtaggagcagccaatgcattctgacctaacagctgtacacagttgcactagttaaaatgaaaagctagtctgcatcacacacaggcaattcactgagccttactgatacgttgatggggtttaccatcacagtcttccctcccctaacctacaatgtaaaaaatgaattgccatatagctgaaggcaccgggatgggggtgaggggaatacacacacacacacacacacacacacacacacacacgcacacactccctccctccctctctcaggcatttcaaaaataatcacaaccatgtagattgtaacatatcctatacgctataaaaacacacacacaaaggaagtggtacagctacattacgtcagctcttgcctcaattcataaatgcaaaaaccacaaaacaagacaaaaatctaaacggcctttttctggaaatcttagagtgaatgaatgtgggttaagtctttaaatatgttattgaacacttctcgcagatgcattgctttcatcagccacggggagggaaaaagtgtaatcttggtcaattctatcatgcaaccagatcaaataacatttcaagtgcagcctgccaagcgccagcgcctgccggagtacaatgagcgctcaactgctctggactgaaaaaccatctttcactggtcccagggatctttataaaatagtttaaacactactaaattacagagttagaaaaaaaaaatacaagctcaactctgctgcccccacactattgtgaagctgctgttaagcatctaaaaatctgccttgtgtaatttactaggcaatgtaaatattcagaaaggcaactgcctctcagagcccaagtctaacacatgcataaaaatgtagagttggttgtgcttctggaaataattgcccacagatcaacgtgcttacatgggatattgttcccatctgtaaggtttcaaatcatgtctactttaaatttggagtttccagaaagaggaaaaaaaaaaaaaagccagaactcaaaacagtaattttggcacagaattgtgaggactttgttaaatctgttctcaacttttactcagtgtctcaatcttaaaacacagaggcacaaagggaaaatggaatttctctgtagacacccgtgttcattcacagaccattttttagattttccgtgtggctgagaggcctccagccaaacaatgcccacagagcgcggggcacatgtgcgccagggacgcttaagggctgcaagtaaaacaaagtaacctattacaggagtttccttctcagcaaacaaaaagtggtcaagcaggtctccctacagtttcagaaaacaagagttgagtaaacaagagaggagaaacaaggaagacagcatcccacactaaaaaattcttttaacaatttaaacgtaaaacaatcgtcaagagtacctccgcattttagctactctggcaaaataacagtagttcggtccaagaagaaaatttcatttgtcacttaagtagcctcaaatcaagtccatcaaattcattttatttttaaacttgtttattccacagtaaagcaatgaagtttctgatcaaagagcgacttctgcattatactcggcttcaaaagcactttcctttcagaagaaaaaaataaaaatatatacatatacatgtatttttaaatagtgttttctctcccccctcaaaaaaatgttttctgttcgatttaattaactgagatttcaagagtttggggctacttaaaaactagtgagcccaacagaaatgcaatgggacacggcaaatactgactccccgttcctggaaagccatcatcattcttaggaacacccgagttccatctttctagggtcggctggaacactccgtgcacccaccccgagccccccgcccgcacttgtccaactttctggcccgagattcgcgtccccctcgacgcacgaggccgccggccacttgcctgcggcccgctggcggcgagagctgagcccgcgggcctggtcctcctcctccggcgcagggccccgccaactccggacccgcggaaaggggcggcgcaggcgggcaggtgggggcccggggagtgaagtgcacttgctaaaacaaaaggaggcctgagcggccgcagggcaccgcggcgcgggcgcaggtcccggcggcttggcggctccgggaggcggtggccgcgcggggccccgcccgcggctagggaggcggccgccctggcccgagcctgctgcccacggccgcggcactcagctcgcactccttcagcccgggaggccgggccagcactgccacatgccggtgacccagacgccgggagagaaagagcagactccccgcgacggcggcggccggcaaaacccgggctggagcccagcccgctccgcgcgcacccctgctggccgccgccgcgggcgcgcgcacacacaatgccagctgcaattttatctccttcgttgcttggccagcctccacccgctccaatcctccctcccctccgacagccggaactgggagcctgcgtgattgatggcagctcttaatagcgtggtcagctagaaaatgcatctgcaagcaagatattaaagaggcagcgcatccctgtgagtgatcagcatttcacacatcctagagctgcctctgcttctgccaggaatattaatgccaaccacctctgacgtctaataaatgcagatgaaacaaccaacaatcacagacaagctaaacatttatttcaaagatgcaccgggagaaagcagcattgtttcgtgtcaaagaacacttctgaccccagttttccttacacattaagaattctctgcaagccatttgtttaaaaatctcaccaatcccttttccacaagtaaataaagatccatctgttagacaagacatagcttaaattgtgcatgattgaaattcatctaataaggaagcaaaataagtgcacattccttaccatgtggctttaaataaacatataacctaccagctaccagattccaaactccctcattaattcaatttttatgtgaatcttaacagattaccaactgttaatttcaaactaatttcttacccacccacaattaattctggtaaaaaatatatatatcaacttgctaaattttattaaaattaaagtacatttaaagcatgtattctctagtggtgatagccaagatcattttgtcctcccaaagacattgtataggaattttttaaatgtattcctataaaatacaaattctaactattaagttcactcagtgtcaacccaaattagaaaggtacaagctgaaaatttaaatgattacttctggtatcttcactattacacctttccccttccaggcaagtttcatggaactctcaaatagcttcataaatgttaattagactttccaaggccctataaagtggctgcattatcaggtactctctttccaataaacagagaaatttagacagattaaagtgatttgcctatagtctctcaacaagatgggggtggggccaggctgaatagaacccaggggtcctgctttgttgccacagacagccaaacagacatgcacatgcatgtttgctatttaaagataactctgctggtctctctttaaagacaaatcaagttattctacaggacatagaaatatctgtctcaaactcctaacacagcacatgtactgagagcaagagctgatgaggcataatgtctttgcccccctgaaaggtggctgtgatcaatacaaatcagagatggtctgtagtgcaaatctagctctgctataagctccactaaacaccattcctcagtgaaaccatcctgagggggacctgtgacttgaaaatctgcttcatatccaagtggctatgagattactccatatatgtcagagatgaaattgatcctaaagccttgctacaaagctactcctgtacttggacacacttccaattttctaaccagctatatccagacacatggcacaggctgaaaagaatttcttttttcttttctacagaccattttaaaagtgccagtttatagtgagttggaaaaggctggtgagaagaagcaaaccgctctattctgaattcatactgtacctagtctctcagggattctaaatgctttgacagcattttatgccactcaaattcttttgtgctcatcttgcacctgctgctaatccaacctgcacccagccccccactttgcagttacaccagtttttccacttcccccaggtatagggatttctaccacaggccagcaggcttcttcccaccagagcaggaataatctccttgcagccccaaacagccactcacagaccgtttaaagcctccttcagatctcaggtcaaacatcactttttcagagaagcttcccctgagatcccattctaggtcaagttcctttgttataagttctcatagaactgtgttcctccttcacagcattgatctccgtttgtaagtcatgggtgtgattttttttaacactcatagccccttctaaacagttccatagagttctatagagaaggttctatatgtttgctcatcatgtagatttatgtcaggtacacaaatctgttgaatgaataaatgaactgaggtcaacaacactgctttactcactccatatattctctgcacatttcttggcacaaagaagcctatctcaaataagtaacatctatgcaaataagaatatcttctattggccggatgcggtggctcacgcctataatcccagcactttgggaggccgaggtgggcagatcatgaggtcaggagatcgagaccatcctggctaacatggtgaaaccctgtctttactaaaaatacaaaaaattagccgggcgtggtggcggccacctgtagtcccagctactagggaggctaaggcaggagaatggtgtgaacccaggaggtggagcttgccgtgagctgatattgccatgcactccaggctgggtgacagagcaagactccgtctccaaaaaaaaaaaaaaaaaaaaaaaaagaatgtcttctattaacctttaaaagcctagtaagccaagagtggtggttcacgcctgtagtcccagccgctcaggaggctgagacaggaggatcctttgagcctaggagtttgagtccagcaacataacaagactcagtctctaaaaaaaaatttagaaaaataaaaagtctagtaaaaaggaggatttttatccccattttatgaagatataaaataattgtgcctggggttactcaaaaacacagagatcctaactagtgtcctatttccaagctacactttttaagagttaatgaagtatagaagccatcgctagtttattcaagccaagttcttcctattacccagcccttaagggatatgcaaacagccacaggtaaactggacagaggactaaatcttgtatacacacagagcaatataaacagaatataaaacttagaaagtactttgtacactagtttgtcttcaaagcttctcagaatgcaaaagcactaccaaattctgctgtgaatgaggggagttcattcttacctcccttttacactgaacttactttattttcaggtttttttctctaagtaacagacctgacatggaagccttcgaaagagctctttccacctaggaactcaatggtgggtgtactcctcaaagtgaaacatttgttttaaccctcattagtatgagtttgtaaattactttgtgaagaggaaaaatcaaagttattacaacaaaaactataatttttcaggtgttttgcacatgaccacatgaaaaagtaataggaagaataattatgtaagataaatgaaaaatattagatataccacatccctcccaaattaatactcattatgactgtcagcattccacaagggattccttggttcccatgttatctccctggcctggtctgcaccattgcttctttttgtcctaagctccattccacacaaattccagctctccgtttccataacacccgtcatttatcaaaacaaccctgtcaagttgagtaccattaacagataatgagaggagacaacagatgtggctggaagcaaagcactctatattctacaggcctcagcatgcagccaagtgagctgacatctgactttatcctaacagttataattaaatcgaaagtctagttaaactaacattaaagctatgaccagaaacatcacacaggggaaatgtgaaggggaaccttagcaatagctgaacaggacccacattattccagacccttaacctggagcaaccaccctgcatggactctctccaccactccgctctgtcacagcaaaggaagaatcataaccatatcttctgaagatggcaactttgggccactttccaagaccaccgaggcagcaaggaaactgcatttttacatgaaagtttaaacagtagcactcatttaataacactaataagtgtcaaaattctaactatcaagttacctgagacaatcaacattctttcctatagcattatccagtacaaccattcagaccaagtaatttagctcacccatgtcaaaatgtcaaaagtacaccccaacgtcatccagcaaacagtgactgaatccaggattgtattagtaccagttagctatgtccgcataggatgctagggtggagaggatttgatttgtaacacagtactccacttttatccacagtttcgctttccaaggcttcagttaccctgagtcaactacagttcaaaaataggtgactaaggtacagtaagatactttgagaggccacattcatataattttcattacaatgtattgttataattgttcttattattgataatttaatttcccttataaatcaaattttatcataggtaggtatgtgtaggaaaatagtaaaaacagggttcagtattatccagtttcaggaacccacgggggccttggaacacattcccaagggtaagaggaaactactgtcctatacagaatacggagggatatggtttggctctttgtccgcatccaaatctcatcttgtagctcccataattcccacatgttgtgggaaggacccggttggagataactgaatcatgggggcaggtctttcccatgctgttttcgtcatagtggataagtctcacaacatctgatggttgcttttttgtttttgtttttgtttttgttttgaggcggagtctcactctgacccccaggctggagtgcagtggcatgatctcagctcaccgcaacctctgctcaccacaacctccacctcccaggttcaagcaatgctcctgtctcagcctcccaagtagctggggactacaggtgtgtgccaccacacccagttaattttctatttttagtagagatagggtttcaccatgttggccagctggtctggaactcctgacctcactgaatccacccacctcagtctccgaaagtgctggaattacaggcatgaaccactgaacccggccaatctgacggttttaaaaatgggagtctccctgcacaacctctccatctctttgcctgctgtcatccatagaagatgtgacttgctcttctttgccttccgcctccccagccacgtggaactgtgagtccactaaacctcttttcttcccagtctctggtatgtctttatcagcagcatgaaaatatactaatacatggagttacaattttaagcaaactatctacttcttttgcttttccaactcaccaaaatgtcactagacaacaaaaactctggagtttttttttttttttttttttttttgagacagagtctcactctgtcgcccaggttggagtgcagtggtgcaatctcggctcactgcaagctccatctcctgggttcacgccattcttctgcctcagcctcccgagtagctggaactacaggtgcccgccaccacacccagctaatttattttttttgtatttttttagtagagacggcgtttcaccgtgttagccaggatggtctcgatctcctgacctcatgatctgcccgccttggcttcccaaagtgctgggattacaggcgtgagccaccgtgcccggcaactctagagtttttaaaagaaaaaagaaaaatataaaattcttgaagctcttttagattttttaatttttttttttcttatattgagacagggtctcagtatgttgcccacgttggtcatgaactcctgagctcaagcaatccacccacctcggcctcccaaagtgctaagattacgggtgagccacggcacccagctcccttgtagattttttttagagtatatggtcctacggaaaatccaagcaattccacttaacaggctgaaggtttaccaggctcttctctagaacataggtacaaaagcatgcacatatacataaaaacatatgtattcatttgtctgagggttcacttgttgattttttgtcacaaagatgaaatcccactatttatgttatacagcaagtcacttctctcactttacagaagaccattaacatcccattcttgtttattactgcaaagaactgaacagtgtgggagtcccataattattatataacaagccccttattgagtctttttcacattttttactcttataaacagtgctacaacaaacttctttgtgcatacatgtatttctacactgaaggaatccctagttcaatgaatatacactctttcagagagagtcaaacagccatccaaaagctgtacaacttatactcttaccagcagtgggtcctggtcctgttcccatactcttattctggtttttgttggtttggttttggattaggcactctcttggatctcctacctttctggcgattctctctttctttccatgactcctcctaaatacaagtagtccctgtcaagcctccttttatcacattcggccatctcacatcagtgaaaagatccactctcaagctgtttctgtgtttgtgattccaaaatttgatttttccagctgagcttgcttcttagcaagaggcccacatatgcaaatgccctatgggttccaccataatggcattccacagacactctcaatcccaaaccaaatcaaaatgttcttccccctaagtcctggggggactgttgcaatctacgtaatatactcttgaatatactgttgcagtctacgtaatatactcttgaaaaataactagaaataacatcagattataaaaagaaaacaaaaagcccaagacagactggcctttagtaaaactctgaatagcacactttaaagtgaaataacataggtacaacattaaggttgggcattagttacaaccttccttcatgttttactttccaacatagtcccaaacatagatatttgtttgtttgtttgttttttgagacggagtctcgctgtgtcacccaggctgatgtgcagtagcatgatctcggctcattgcaagctccgcctcccaggttgatgccattctcctgcctcagcctccctagtagctgggactacaggtgcccaccacgcccggctaattttttgtatttttagtagagacggggtttcaccgtgttagccaggacggtctcaatctcctgacctcttgatccgcctgcctcagcctcccaaagtgctgggattacaggcgtgagccaccgtgcctggccatagtcccaaacatatttaagagtgataggccaggcggagtagcttacacctgtaaactactgggattacagtagcaaagtgctgtaatcccagcactttgggaggccaaggcgggtggatcacttaaggccaggagttcaaaaccagcctgaccaacatggcaacaccccatctccattaaaattacaaaaattagctgggcatggtggcgcatgcctataatcccagctactcgggaggctgaggcaggagaatcacttgaacctgggaggcggaggctgctgtgagcccagatcgagccactgcactccagcctgggtgacagagtgtgactctgtctccaaaaaaaaaaaaaaaaaaaaaaaaaaaaaagggagtgataaactgctaataagtatttaaagtattatatcatgaaatacattatcagcattataaaaatatactccagaaaacaaaaaatacaactttccactaggctcccgggggcatcacagcaaactgttatgacattagtcatcaatcgaaggtcaggcctggaggttttagtttttggaagtgtgcagccgtctcatggatgtagccctaaaccaacttcagacagagagcaagacctcttagatagcacatgctttaaatatgtttaaggacattttcatttttatttcaaaactcactagagatctcagactgtgcagatcaaattattaaattccaatagagcgatacgttgaaaagccaaagcagggttaagaagagaaatttctcgtttggaaaagggttttacagatttaaaaacaaacagttttgtggaagaaagagctcagggatgcagggcctcaatgggatgtttaaaatgaggcccctcgtgtattttgaactgatgatatatgataaaatcagtgtggagatccagccaaatgtactggaagtaatcttaaggataactcaaaaccacaactgaaatcaatatcctaagaattcaaaatattaaccagacagataattgtatgacttattaaaataatgtacacaaattcaaaatataattttgccctttattattattaggacatgttttctctagtattatgccgccaataaatgaaaatactttaaaataaaattacacacgtgtatttcagaaaaaaatacatacatttaaatgtttcaaaaaattaaatgagtaccatttgccagtctcagcatcagaggtagcattacagatccaggaactgcctgcctaaaagccaataactgctctctagaaaatgccagaagactccagttaaaaatatacactcaaacattatataatacattggctaaaacaaaaatcaaaagccacagattcgagaatgtttgatctgcacaacacagggtggtttcttgtgttttcttctgaagggattagaagtgagtgagactgtcataaagacaaatgctgaacatacattctggagtttaattttaactaaaagagcaaatacttgggctgcaggaaacaacaactgagtgagtacaaaggaaggcatgggctaacttctaacgtttacatcatctgattaattccaacaataaaatctaaacactgatcatcccctccaatcttcagagcaagctgactctacagtgaagaatacgagagccctatcagctgactctggtatgtttaaacgattataatgtaaagcatgttcattctcttaagtgaaaggaaatgactgccaaatgcttccttcacaatctctccagaatagggcaggtcctttaatgtgagattttcctgacattccaattgtagcagacattgaacaaacagagacgcattaaaagccgacctggttctattatcttttattgaaggcctagcaaagatcagacatgagccctgtgctatttacattttttggtgcattaatcacttttatactcaagggctttagaaaaattcaatggatttttttttttaatgaaaaacaaaataaaaaaaaaacacaggatgtaaccacagctatattggtctttttctcaggaaggtcagaaaagctttaaaaacaggaagtctgtgctataaggttgagaaatgtttgttttaacagcctaaggcgtcatggttgcagtttgcagtcagctgctatggaggactatagtttattcttcccagccaaggattaatgtccctagggaaaaggccaaaaaggtactcatataactagaaaagcacattatcctaaaataagacttgttataaaatctgaatcataaatcttacaagatacctttcaacattaaataggaactaatttagtaactggaggaggaacagtttgtcttttgtggtaatttataaaggctaaggaaaaaccatagtaaccaatgctaagacaacctcctagaaacaattagcagtgggttaagaattggtgcttgccatttgatacaagttttctattgattacctctattttaatcattatactaatattaattattaaaatcaaatgtaaaaatgacactcttgcttgaatgcaaattcttgcaaaaaaggcagattaactttaaaaatgttttatccctaacaaaatggttggtctctgcttttaagaaaaaaattttttttaattaaaaactttggccaggcacagtggctcacatctataatcctagcactttgggaggctgaggtgggcggatcacctgaggtcaggagttcaagaccagcctcgccaacacggtgaaaccccatctctactaaaaatacaaaaattagctgggcgtgatggcaggcacctgtagtcccagctacttgggaggctgaggcagaagaaccacttgaacccgggaggcagagcctgtagggagccgagattgtaccactgcactccagcctgggcaacaagagcaaaactccatctcaaaaataatgatgatgataataataataatagtaattgcaaacttcaactacagtgctaaacagtcttaacatacctaacattaaaggtattttatttcaaaaattacaattttctgattccattctttatacttagcttacacaggcaatcaaaatgaggctttttcatggtggactccattttaaatggaattaaacgttatattatgaaaactttaagccaaaaatatccaaatattaatattaaaatacacatagcacatgaatttaaaattcatttggcttttaaagggtagtgattggaaaaatcctatcatgataaagtgctttaaaatacaaacataaatggctaataccacaaagtttgccattcaccccaagaagtaattttctatttgatagttatagctatctttaaatttttaaatatttatttctacaatatctctagagaggattgaactactgccatttaacagatgggagtaaaatgaaattctctcaactttatcttttcccttatggttcagaagacatcactctaataactttatctttccaaggggcatcattcaagtaacaactcatcctaaaaggcccatactggctttcagttgagtgtattctgtattatgctctggcgtctttcctgaaaattggaagacaatagagtaacgccttcaaatttttgaggaaaatagtctccaacctacagttctatacccggccaaactgtgagataatcaaggatgagcataaaataaagacattttcagacacacacagcctcaaaacatttacttcccatgtacccttctcaggaaaatacttcacaaacaacagagggaaccccaaccaagaagccatgaaaaatgatctgagagtcatatgaaagggaagtcttcttccaacaactcagtggcagatctagacaccaaaatgaggcaatgggttccaggaggatagcaccaaggctgatctatagattaatattttccattacactgattttccaatagttctgttggaaaatttaagggtgatttagagacggggcatacaaaacaaaacaaagaatcaaaagagagacaattattaattccaggaaagaagttgtacaagaaatgtaattcaatcataccacaatttttttttttaagacggagtctcactctgtcgccaagccggaatgcagtggagcgatcctggctcactgcaacctccgcctcctgggttcaagtgattctcctgcctcagcctcccgaatagctgggactacaggcgtgcgctaccacgcctggctaatttttgtatttttagtagggatggggtttcaccatgttcgccaggatgctctcaatctcttgaccttatgatctgcccgtcctggcctcccaaagtgccgggattacagtcgtgagccaccacgcccagcccacaatatttgttttaagctataacaatatatacatgcctataataatataaacattcggctgggtgcggtggctcacacctgtaatcccagcactttgggaggccgaggcgggcagatcacctgaggtcaggagttcgagaccagcctgaccaacatggtgaaaccccgtctctactaaaaacacaaaattagccaggcgtggtggcaggcgcctgtaatccgtgctactggggaggctgaggcaggagaatcgcttgaacccaggaggcggaggttttggtaagccgagattgcaccattgcattccagcctgggcaacaagagcgaaactccgtcttaataataataataatataaacattcaatactgatttaaccacaaatggtgatattaccacaatgagaaggaagaggaagaggagaaagtagaagatatataaaaggtgacgggctggcaaggaggctcacatctgtaatcctagcactttgggaggccacagcaggcagattgcttgagctcaagagttcaggaccagtctggaaaacatgacaaaaccttgtctctacaaaaaatacaaaaattagccaggtgtagtggtgcgtgcctataatcccagctactcaggagactaaggcaggaggattgttgagcccagaaagtagaagttgcagtgagccatgatcatgccactggattccagcctggatgacagagcaagaccctgtctggggcgggacgggcggggaagagatttaaatggctaaatttaaattactcattgggtaaactcagcaagtgatgtctaaaatagaaaataaaaacaggtcaggcacagtggctcacacctgtggtctcagctacttgggagactgaggcgggaggatcccttcagccatggagggcgaagctgcagtgaacagtgatcaagccactgcactccttcctgggcaacaaagtaaggccccatctcgagggaaaaaaaaaagacaaaaagaaaagataaagaagccaggcatggtggctcatgcctataattctaacactttgagaggccaaggtggcaggatcacttgagctcaggagttcaagtccggcctaggcaacactgcaagatctcatctctacaaaaaaaaaaaaaaaaaaattaaaaaattagccaagtgttagggcacacacctgtggtcccagctatttgagagcctgaaggatcacttgagcctgggaggtcaaggctgcagtgacccaagactgcaccactgcactccagcctgggcaacagagcaagactctgtctcaaaaaataaaaataaaacataaaacataagcatgtcctttagcaatattgagataagtgacaaaataaatggttttaaaagttcaaacagtttgcctctgagaagtgaaactcaaggatgggaggaactactaaaataaacaaacaaaaaaaaataaacagtacaccaccacttgattaagtacgtgcacatatattacctagaaaaaaaaatcatatgaaattaaaaattaacacaaatgttcccagaagatctttgctacctttttttaaaaaaaattcactaacccatgtgctttgatcacctggtgaagaaagtaataaaatttcagaatggaaaaaaagaaaaggaataaaaaaaaacctagccaaagaagcaatcaatctttttaagacgtaggcatcggactgaaatttatttttcttcagagggcaggctgtactacattttgcaacctgctagtaagactcctgaaatttggcccctcgataataataatcttataccaaaaagaaaggaaaaagacacaatcacaattttaaaaaataaatgatataacaactcaatcactataattttagtatgtataaatgagaaatacatcactaactaaagtaacagcttttaaaagaagcagtaggtgaaagtacaaatagatcatccagcttcaaaaaacttaatgaatttttaaaatcatttttagcattttacccatttgtttattcacaattatgttccatagtcagctaatggtttttgaaaaagagagtaagaataagatggataagggaaaggaaaatcaagcatgttctaaattgcaagttaatcattaggtcaacagtggtagttttcagtatttctcaaacacaataacgccttgtcatcgattgagaatactgaattttaatgccattgttttgtcaataaaaagtgcttatgtacacttcacgagttcattaataatcctctaagaagacctaaattaaagcttggcaagcagtttctcatgaaacaaaatttgctttagttctggtttgttagaactaaatgcaccaagtggcaaattaagatgtagaaacataccttaaaggttatgctttgaaagtattcaatgactcaaacagaggcatcattaggcagtagcaaaataaatactaagattcctatttcatttgcaatctgttaagtttcagacagataattttacaatgaccaccaatagctatcaggataaacttcgaaaggagatagacatacattccctaaatttcatcagaggactggaaggtaaccaggatagatcccattttcagcattaaaagtgatcaaaagagtccaataattcacatagaagatgccattgtgctgtctatactgtgtgtatttaatgtccatgggaatgctgacatgtgcactccaagtggtgattgaagagtcaactaagtagggggaaagggcttggagcaaaaatttcaactaaaaataatccagttacaggagaatagtaccaggcaagctggaaaaactataatcaaagtctgtatttccagtttcaatagtaaacacagttgttaagagtggttaacacacaagaccataagtgcatgcaatttcaagtcagaaacatctgttttaccaatagtatccctgttatgtcctccatttctttactaaagcagaatgtgagagtaagaacaagagcaagcacaatgtatgaaagaaagtaagcagtcaatttaccttagaaaacattaggactttcatataagttcctaaaatcataaattctaaagccgttagatttctagaacttgacaagatttctttaaaaaacagggtcagataagaattttgcctttcctcctattagtttttagtccccaccagctgaagcagggtgcccgtttctacaccaaagagcggcaaaatgaagaaaatcaagcaaattacacagcaaaggcagaaatgccttctatttcatgagaaaagagaaatggtgcaagccaatggatcaccaacctcaatgcactgaacagctgaatttttttgtttagttctgagaataaagctgtggtttaatttcatcaatagtgaagtttagtcctacctattttgctgggtgattttaaatggtaggtgactctcttcatctggtactctaagagcaggcagcaacatttcatccttagttctgactgagcttcccagtcttcagcaaatttagcctagtggtaaaggtctctagctctggagtcagatggccagggttctcctaatctaagattttctaactgcataaccttgggaaagtctccatatgcccatctatacaatgtggttaataacagtacccactgcacaaggttatcatggagatgaaatgaaataattcaagcaaggccttggatggagtgcacagcacacaggaaatgctcagtgaatgccagacaccattaaccgtgtcatcttggactctgtcatcgacttattgtaaaaacctgattaaaacaattaaaggagggcctaaatcaccccaacagtgagggtggtaattcattatttgtctgtgaagtacatcaccccactaaaaaaaagaaacaggcagggggcagcaaaatcagcattttgcttttcatccttgttactatcactgctacattatttatgtgaactgggaaggagtgtgtccggacagatgctcagctgggttctgcaagcagagcatccatcacaaaaggtagtgcctgtctcaggagcaagcccctttcctgcctcctctctccccttcatcagtcaccactagggagagcacagtggagccacacagcagctgggcaatgtcaaaacattattgtccaagcactctgttcaatgattttgatgaaataaagtaatccacccctaaatgactcattttgtcccaaattagcatccttaaggtaattattaaatatccaaaaggatccagggtgtattagaaacaaaggagggggtgaggaacattgatatactaccaacaggcaccctactataaatttactaaaacaggaatcatgaaatgattgaaatgacaccaaattatacaacataaacatagaggaacaaatgacagagatttgccctctgcttaattcagcttacatagatgtctatcaaagacaagtttctacagagtcacaagcacactgtattcaaataatcttcatttccattttctctggacaagcgaaagtaagcctaccacaacagttaatgggttaaaaactgtcacattttcaaaacatttacattatttaaatgcttatgtgtctaccaccacccccagagaattaatcacctccttattactgtcacctctctaccctccatataattctactgctgcgtttctcacagacttaaaattattttcatataaattggtctttgctgctatatgaagcaactcagggcatggagcacgtttgattcatttttgtattcccaaatcttcctgaataatttactcactcattaatggaacttacaagccctaatatgtgccagatgctttggggcggctgaggcgggcaaatcatgatttcaagagatcgagaccatcctggccaacatggtgaaaccctgcctctactaaaaatacaaaaaaaaaaaaatttagctgggcatggtggtgcacgcctgtagtgccagctactcaggaggctgaggcaggagaatcgcttgaacccaggaggcagaggttgcaatgagccgagatcgcgccacagcactccagcctggcggcagcaagactccatctcaaaaaaaaaaaaaacagcacaagcacttagaatacatctatgaacaaagtagaaagacactcctgacctcaaggggtttacattctgcagggagaaacaaacaataaccaacagatttttttgtattctataaatttcacacaatattcaaaggcagtaagtgctaagaaaaaaaagtagagcaagaaggattaaacatatgcagagggtaggtaccagctggagagagaagagagacagacagacagagtcagagagagagcaagagagagagagagaacaagaacgagcaagagagagcaagcgagccggcaggactagaacacaactgagggtggagggtgccggcaacggacgagtcgagtccaaggtcagggtaggcctcataggccactgtaggggagttcttataattgtataaccccaagagtagacaagaagcacacatcccaaaatacgttacttgtacatgaaacatccaggctccattaaaattaaaaatctagccgggcacagtggctcacgcctgtaatcccaacactttgggaggctgaagagggcggattacttgaggtcaggagtttgagaccagcctgaccaacacggtgcaaccccgtctctactaaaattacaaaaattagccagacatggtgatgcacacctgcaatcccagttactcaggaggctgaggcaagagaactgcttgaacccaggaggcggaggttgcagtgagccgagatcaccaccacacaccagcctgggtgacagagcgagactctatctcaaaaaaaaaagttgttttagtatttctcaggtacccgataggtcatcttagaaggagcccaccttgaagacactgccctaggctggtaaaacttggacagttaacactgcattcctcagacaactgggagcactgcagaggtctgcttccccaagcccctgaacgacagcctgggacttccctgcaggcctgaacacaagatctcaggaaatggaagagttgaaccgaaagagtttttgtatttttccactcaagacttttttattattatttttttagaaggagtctcgctctgttgcccaggctggagtgcagtggcccaacctcggctcactgtaacctccgtctcctaggttcaagcagttctcctgcctcagcctcccgagtagctgagactgaaggtgcccactaccacacccagctaatttttttctatttttaatagagagagggtttcaccatgttggccaggccattctcaaactcctgacctcaggggatctgcctgcctcagcctcccaaaatgccgggattacagatgtgagccaccgtgcctggcaagagattcttaaaacctcttctggtgagaagtgaggcacctgaccaggaccaatgggatttggtgacttggtctcacacctgctttctctctgttggaagggttgctggcctctattagaaattttaattactatctggcaaaaatatgttctcctttctgactgcttaaatatgtaagatgggtccctcagtgctagctaacctcaaaactcaaaactaaatcatcttaataacataaacccttatctctgtcttgacagcagtaacacggagctgaacagtcagctaccagcatatctcatttcattgcatttgctttgctgcgctttgcagatactactttttctcacctagcaaactgaaggctttggcaaccctacatcagggaagtctactggtgctttttgttctttgtttctgctttcttcagccctttttctgtctatgaagccaacctcctctactgcactcattggaatgcttacatttattctacttcataaggtattgcccaattctagaaccacaaataaagccaactgaaatctttaaacgatatttgttgtaattgtgtcttctgacagaaacacaactcaatccacgcacaggtcttcctgcctcaacctttgctaacctagcacccatctaccttccccttggctatcaaaccaatgtttctgaaactcaattctggtaacatcccttttctacttaaaactcccattagctttttcatccaaactataatgacagcgatactaatatttattgagtgctaactgtacaccaggtactgctgtaagtattatacatatatgacaatattcctacaggataggcactattattacctcctcttttataagtgagcaaaccaagagacaaaggtgttaagtaacatctgttcaataaagccacagacttggccttcatatccctgggttccacatctgtggtttcaaccaaccacggactgaaaatatttggaggaacaaaaaaaggatggttgcttctgtactaaacatgtatagaattttttaagtctttattccataaacaatacagtataataactatttacatggcctttacattgcactgaatactataagtaatctggagacgatgtaaagtataagggaggatatggtctaaagtatgttggaggatgtgcataggttacatgcaaatacgacaccatgttatttaaagaacttgaatgtgtgtggattttggtacccaccgatggtcctggaaccaatcccccacgaatactgagagaggactatgtagttagtttcagaacctgcatttaaactcaggctctatacctcaaaataaaaagctatttgacatggaaattcaattaatcaacagagttgtctttgaccctctacctatcaaaaactactgacagcacaaacgattcagaactttcaacagagaaaagagaaggtgtccagaaaggaatgctgagtctctcttaacacagctatcaaatcctgaatgcctcacaaacatcagatcagccatccatcaccaaaatgggagggggaggtaggaatcgaaactgcagaatgacaacaaagaagaataaaatctaacaactcagcaacaatataccctcaggttagagataaggaagaataaacaattcagtctgaaaggacttctaccaagaagagattagtaattagactgaatggctgtggttcaatataaagtatagaaatgcaatttttttccctctaaacagaacataggcacaaccccagaagttactcaagagggctttaaaaaagaaaacaaactctaaaacaaagagtatctttaaacactaatcattgtttttttttctaaaatcactattagaacactacctgacaaggtctttaaagggttcactgttgattaagccattttcatggcctagtaagtttgagttctattaattcagactgtgctatgtacactgaaattttgtcttaggcaggctcaacagaacagttcttcaaattaagcaagtgcttaatgttaggtagaaaaaatatgtcgctgtgaaatatatactgtccaagtactatttggtgccaacaaaagctaacaaacaggctgtgtttttaagtctaagcagaagaaaagtaaccactacctgtacagaatacagttcggctctttcagtatttcagataaaaagaaggactgaaaccagaaacaacctactttctagctctgaattaccatcatcacattgtataaatcattaggtggggacagaatacaccaaaatagaaatcacaagctgaaagagccttgaattccttcccttaaatgaagctcttatatcaaatgaatctatatagtctctgtgtgttccagcattttgtcaacttgtaaatcaaagattttgttccatagcccttctcaattttctacatttaacatctgacaaaaaccagcttttatctttaccaaagatattctatccctagaaagtcactatttaaaatgatgtcatttatatcatgtaacatattaagaaatacatttattttatttttggtagtaacaaaacaaccctggatatttgcataaattaaagctgtcaataagaaaccacttctatatgtatccttctttgggtttctggctcaggggttggcaaaaatgggttatacatttaaataatatttcaatcttaggttaaggaaaatttctcctgtatatttcaagatacagagagactctgccgatttacattcaaataaaacaaaacgtgagtaatactgtctatatcaatgttctgtcacttgccagaataaagaaaacatttagtaagttagttaatttcaagtctgagaattaagcaaatatcccaaatcctttgtaaactcaaagatttagttactttctctacatattacacagctgctttaaaattttaccttctggccgggcgcggtggctcacgcttgtaatcccagcacttcgggaggctgaggtgggcagatcacgagctcaggagttcaagaccagcgaccccgtcgctactaaaaatacaaaaattagctgggtgtggtggcgagcacctgtaatcccagctactcaggaggctgaggcaggagaatcccttgaacccgggaggtggacactgcagtgagctgagattgcaccactgcactccagcctgggcgacagagctagactccatctcaaaacaaaagaaaaaaaaaatttaccttttatttctagatactttgtaaaaaaaaaaaaaaacaactcaaccttctttcctagaaactttctaattaactttctacttttttcgttaagaaaactcctttagtttacacaccaattctgtataaattaaaaacacacaatttcaggtgaaagttctaatgagtagtgtatattttgaaaacacgaatgcttattttacattactctgtgattagaatgaaaaaaacatagatgcacaagtggtgacagaagtaaacctaatactcaataacaataatcaaaggcaatacatgatactcgttcctgtctcactagtgcacattagttttaacattactgaaagatgtgggaaactcagtattttctaaaactcctgatttatttccaaaggaaaaatagttgtaactacgtcaaaataactattttggccggatgcggtggctcacgcctgtaatcccagcactttgggaggccaaggtgggcggatctcttgaggtcaggagtttgagaccaacctgaccaacatggtaaagccccgtttctacttaaaatacaaaaattatccgggcatggtggtgggcgcctgtagtcccagctactcaggaggctgaggcaggagaattgcttgaacccgggaggcagaggttgcagtaagccgacatcgtgccactgcactccagcctgagcaacagagtgaaattttgtctcaaaaaacaaaaattgcaattaatagtttaaaatattaaatctaaatttataggagattcattagtttgcccttggtaatccccactttctgccttgtaaagcctaagaccctaagaagctctacaaactagagcttcttaggcttcaaaacagttctttccaaaccatatttgatgaattatatgtaagatgagtcaataacataaggattagatttccctgaaaatgcatagaaggttaaaaattagaagaaaaagtgataggcataataggctctgggttttgcttaatgcaaacgttctgaaaggttcaacattaacacagacattcacaaatgaggcatctaattttaactttgttttaaaaagttgtttaaaaaaaaagtcaaaataagtcaaactcttcccatttgtttgaatagagggtacatttacttcctacccaacaagatttgaaaacaaaagacatattagctataaagatatattcctttcacttaatgctccacaaatgtctgaaaagcaaactcaactcaatttagttgagtcaataagggaattccagttttccttttttcttttctttttttttttttttttttttttttgagacggagtcttgctctatcgcccaggctggagtgcagcagcgtaatttcggctcactgcaagctccacctcccgagttcaagcagttctgcctcagcctcctgagtagctgggattacaagcacacgccaccacgctcggttaatttttatatttttagtagagatggggtttcatcaccatgttggtcaggctggtctcgaactcctgacctcgtgatccacccgcctcggcctcccaaagtgctggggttacaggcgtgagccaacgcgcccggccaggcaattccagtttttctaagacagtattgtaaaccaagcagagatattccctagggccatataattctgatacattagctaatctttgtaagccaaatcagagcacttctttccaaaactcacatttctaccaaaccgggacaccgtgtggtggggaaagagttcagaacacctggtatatttttccaaagcaaaatttaactttccattgccaggagaagcatgaacatgttgacttatactgccctctagagtctccttctaatattttttagcctgaaataattaattctaatcataagactcttctaattactcaagctttcagtattctaatattgtaaactgacgtttatttatttatttattgagaagaagtctccctctattgcctaggctggagtgcagtggcacgacctcagctcactgcaacctccacctcctgagttcaagcaattcccctacctcagcctccagagtagctgggatcacagccatgcaccaccacacccagctcatttttgtactcttagtagagacgggttttcaccatgttggccaggctggtctcaaactcctgacctcaggtgatccacccgcctttggctcccaaagtgctgggattacagcatgagccactgggcccagccaactgaccttttttcagtggattagtagtcttttttttggagggcgcggggtggggggaaaggagtctcgctctgtagcccaggctggagtgcagtggcgcgatctcggctcactacaacctccgcctccagggttcaagcgattctcctgcctcagcctcgtgagtagctgggattacaggcatgcgccaccatgcgcagctaattttgtatttttcatagagacagaatttctccatgttggtcaggctggtcttgaactgccgacctcaggtgatccgcccgcctcagcctcttaaagggctgggattacagatgtgagccaccgcatctggctagtagtcattattaaaacatacaatatttcaattacccactgttttttatttttttgttgtttgtttgttttggacagcgtctcgctctgtcgccaggctgttgtgcagtggcacaatctcagcttactgcaacctctgcctcccgggttcaagcgattctcctgcctccgcctcccaagtaactgggactacaggcacgcgccaccacgtccagctgatttttgtatttttggtagagacggtgtttcaccatgttggccaggatggtcttgatctcttaacctcgtgatccgccagcctcggcctctcaaagtgctgggattacaggtgtgagccactgagcccggccaattacccactattcttaaaggtcagcagtacttccccaaaggacaggaatgcaccccaaacagaatcttctaatttgcttatttaaaaaaagttttaaatagctcaaactgcaaagacttctaaaacaaagaccacttgtagcatatattaattaatccatgtagcccagagttttgtctagcaaaacccaagttcacacatttgaccacatgcacacgaacctcagccaacgcagccaacgctccccagaggctacttctgcagctaagcatctgtcctttcagctcctggcagttcctgccttttctcttgccaggcaaccagagctctaaagggatcttaatgcactaatgagaagccatgacaaccaagacctgcggtagctgcaaagcacaaacaccagtatccacttttactgagcacgcatgcaataagcaatgtgctaaggaatccaagtaaattaaaatcattcctctaacctaataactccataggcacctataacacaccataacttgaaactttctatcattctttatatttaagaacttattaaaaggcaggctttaccatgcaccactggtagtatagcttgcctcagctgttatagtaactatagaagtagggttattttcttgtttgtttcaatctagagtcataagagaccatcaaaaaaaaaaaaaccctattgaaaccatgtttagagcgaaaaagtctatattctttttaggggattagtagtcaccattaaaaggtatgatatttcaattacccacagttatttgagatcagcagtatttcctcaaaggacagcacctaaaacggaattttctctaggcacctgtggtataccataacaccaaaaagcatccctcaaaaaagaaactaaaactaagatgctatgctccatacccagatatctgttattacttctgaaaacaatctaagtaatcttggggatcccatccagtagataaaaacgatggcatcctttggggcataaagtgaaggtaagatttccacaggctctgaaacagcagctagcaactagggccaagagactgcacctgtttttgaaaataaacttttatagccaggcgcagtggctcatgcctgtaatcccagcactttgggaggccgaggcaggtgatcatccgaggtcgggagttcaagaccagcctgaccaacatggagaaaccctgtctctactaaaaatacaaaattagctgggcatggtggcgcaagcctgtaatcctagctactcaggaggctgaggcagagaatcgtttgaacccgggaggtggaagctgcggtgagctgagatcgtgccacaccattgcactccagcctgggcaacaagagtgagactccatctcaatcaatcaatcaatcaatcaagttttattagaagtcagctacaccgatttttttttttttttttttttattgagatggagtctcgctctgttgcccaggctggagtgcagtggcacaatctcagctcaccacaacctctgcctccctggtttcaagtgattctcctgcctcagcctcccaagtagctgggactacaggcacgtgccaccatgcctggctaatttttgtatttttagtagagacggggtttcaccacgttggccaggctggtttcgaactcttgaccttgtgatccacccgcctcggcctcccaaagtgctggggttacaggcatgagccactgcacctggccttatttttttatgtgtattttctatggttgtttgtcttcccactacaatggcagagttccatacttgaaacagagaccatacaacctgaaaagactaaatatttactatatctggccctttacagaaaaagactgccaacagcaaacatctccagccttctccagatcacaacttaagaggaatgtcatgtgcatgaggctaaggagtgtgggctggcttgagatggaaaaggggattatgactgctatccaccctatactacatattaagaaaatgaaattatgggaactcatgggaagaaagaatgacagatgcagctgattcctcccatatgatggttcacatcaggcttttccaaagactgaatgaagagctctaaggttttctttcaggtatttaaaaaatcttatgtaagggatggcaggggaaaataaaattttctatataacatactatttcactcacatcaatgttacactgaagctcacacctgagataggctgatatttctttcaaagagaagatttcaagtaagcttccaaatagctatgataatgtgtatgaatagaaccagatcccagaatgaacttgaggtaaataccaaggactgaaatcagtgaaccatcaaaacaaatatacttgtcaaacatacaatacacaagatgaaatataatgaatccctttgaaggtcactatatgtagatacaaaaatacagcttgaagatgatctagtcaagagacccaggttctagtccgggttttgactctccctgtaacttagaaaagtaatttcccccatttgtttttggggttttttttgtttttgtttttgtttttgagacagagtctcgctctgttgcccaggctggagtgcagtggcgcgatctcggctcaccgcgagctccgcctcccgggttcaccccattctcctacctcagcctcccaagtagctgggattacaggcatgcgtccccacacccagctaatttttgtatttttagtagagacagggtttcaccatgttggtcaggctggtcttgaactcctgacctcaggtgatccacctgcctcagcctcccaaagtgttgggattacaggcatgagccactacgcccagtctggttttgttttttgagacagagtcttgttctgtcacccaggctggtgtacagtggtgcaatcacagctcactgcaccatctacctcccaggctcccaaagggctaagattacaggtgtgagccacagtgaccagccagtttcccctttgtactttatctgtgaactgaaggactaacgctgcatgagtggttctcaaccattcacatgcctcagaatcacctggagggatttgttaaagcaaggggtgttgggtgccaggcttcattttcagttcagaagtcatcattcccatcctcacagcaagaaaacagctaaacaaactgaaatcaatggcctttcttagatccattagagaactggggtcacagagcaaacagctaccacaaaatttgaaggaaaaaaatcacaagaaaatacagagaatcacagaaaagatcagattaccagaagcaaaagctacatgaaccagtaagcaatacagtaatcaatacctgaacggtaattttgacgaactgcagaagactgagtgtggactagcttgagagttaaaacttctggaggtccagacttaagagggacctatatagcttttacctccaggagcctgaacaggttcttacaagaacatcaaagaaaaaaatcccctcgtattttaggcagggagaggggaaagtaaccattttgcaattgctcagagcattctccataacaaaggcccacctgctaagaaaaactacttcgcaggagctttgtagacctggggaaaggacaattactcaactccctcttgccttctcacagaaggggtgaggggaggaaagctaataaactcttcggaagatcacagcctaaagacttacgcccactaaaaaactgagatttaatattagattacagaatgcactccttccccaacacctttccaccacatcaacagagctccagtataaaaaaaaaaatgcattacaactgacagagcttcaagacagactctatttaagaaggagttcttagggaaacccaaagaaaccaggggtggaaaaaaacaagaaaactacaggaaacggaagcatctaacccacagcaaacatgaagcacagtatggcattttctgaaaaagctaaacataatgtttttttgtttgtttgtttgtttgtttgttttgttttgtttttttgagaagagtcttgcgctgtcacccaggctggagtgcaatggcacgatctcgactcactgcaagctctgcctcctggtttcatgccattctcctgcctcagcctccccagcagctgggactacaggcacacactgccacgcccggctaatttttttgtatttttagtagagacggggtttcactgtgttagccaggatggtctcgatctcctgacctcgtgatctgcccacctcagcctcccaaagtgctgggattataggcatgagccaccacgcccagcctgaaaaagctaaacataatcttaccatacaatcccacaatcgtgcccctaagcatttgtccaactgacttaaaaacttatgtccatacaaaaatctgcacaaattttagagtagttttattcataatcagagacagaaggcaaccaaggtgtccttcaaccgtacttcatgaatagatatgcgaactgtggtgttcactgagcaataaaaagaaatgagctctaaagaacaagaaagaggaacattaaacacatattgttaagtgaaagaagccaatctgaaagtatacacactatatgattccaaccatagaactttctttaaaaggaacttcaactttctttaaaagacaaaactatagagatagtaaaaggaccagtggttgccaggggctgggcaaagaagggagagatgattacatggagcacagaagttttaatggtggtgaaactattctgcaggatactgtaactgtggataagcacatgacatttacgtttctgtcaaaccccacagaatgtacaacacaaagagtgaatcttaaactgtagacttcagttaataatatattaatactgcttcatcagttgtaacagataagccacactcatgcaagatgttaataatagggggaactctgtgtgtgtgtctgtatatgtgtgtgtgtgggaactacttatactatctgcccaattttcaatttttctttttttttttttttttttttttttttggtttagatggagtcttgctctgtcacccaggctggagtgcagtggcgctatctcagctcactgcaagctccgcctcccgggttcacgccattctcctgcctcagcctcccgagtagctgggactacaggcgcccgccactacgcccggctaattttttgtatttttagtagagacggggtttcaccgtgttagccaggatggtctcaatctcctgacctcgtgatccgcccacctctgcctcccaaagtgctgggattacaggcgtgagccaccacgcccagcccgatttttctataaatctaaaagtgttctaaagtataaagtttatttaaaaaaaaagagagagagagagagtgagtgttgggagtcactcctcgatcctaattcagtaagtcttgggacaggcccaataatttacattttaaccaaattcacaagtgctgctgctggttcaagagccacatcttgaaaccactgggctacggctccttttagttctaaattttattattctattcactaacattttcatgagaactgtggtaaccagcccacaaaatggcccccagtgagctctgcctcctggtattcaaactcttgacaataatgtcttccaaggctacgtcataaaagacattgcagctttcaccttgctcttatatgaatcctttcttctggaaagccaggtgcagtatcatgaagaaactcaggcagccctatgaagaggttccatgtgcaaggaactgaagcttctgccaacagccagcaagaactctgccaaccttgtgaatgcactatgttgcaattggatcctccaggccctatcaagccttcagttgactgcaacctgagaagggacctcaagccactcctaaattcctgacccacaaaaggtgtgtgggataacaaatgctgaatgttgttttaagcagcagtttggaggtattttgttacatatatcatataggagcttaatctaaaatatgtatgtggctgggcacggtggctcacgcctataatcccagcactgaggcaggctggatcacctgaggtcaggagttccaaaccagcctggccaacagggtgaaaccccatctctactaaaagacacaaaaattagccatgcatggtggtgggtgcctgtaatcccagctactctactcgggaggctgatgcaggagaattgcttgaacccagaggtggaggttgcagtcagccgaaatcgtgccactgcactccagtctaggcaaaaaggtgagactccgtctcaaaaattaaaataaaataaaataaaatgcatataatataactgttattgttgacccttcttgcctttactttgatacagctggagaagtcctgaaaatgtgtccaaattcattacaaggtgaagatcaatttaaagaactcctccacatttctcaaagtattatattaataatgaattatatcatttcttcaggacataaaggatttggggtgggaggagaagggaaaggaaggaagtggaaacgagattttcatcatcttccctaagccattgctggtcatcctagagtagaaatctgagagtttcactttattgcttaaaatcctttaatattatagtttcccaaagcttatggaagtgaatccagacactgctcattgtctgcactacatctaccaagcaggctcatgaggcagcacaaggggtgcacacaaacatgggctgactttgcaagaccttggataagttacttaatctccctgcctcggtctgctcaacagtaaaatgaaggtaattatactaccaatatagttactatagggaattaatacattaaaacataaaaaacacttaaaagaggacgttgcctaagtgctcaataaatgtcagctatcatcatcatctgccattgcatctctcataacccagactatttcaagccattatgaactactggaattttcaaactcaccaacactgttttatgcttttgcaccttagaaaagggactttctctgtctggaatggccttccttcacttctctctcaattatccttctcaacttccttatatagccttctctgatttcccttttacttaccgcatccctcatagacacacctacagagaatatttaaattatttattatttgcctctcccacaaaattgtatgcttgataataatacttgatacttattgtgtcaagtactgtgtgccagccactgttttatattaagcactttacttagactatctaacttaaacttcttaataactcataattatcctagttttattgacagtaaaatctataacatatataaataaagaataagaattcaaaccttagctgtttggctgcaatttgttacaatctaaaatctaaggactaggaggtggagatttctgacatgctgaaaatatcaaggaagcaattaaaccttccagcagttagcataagtgcacacagtttaaaaatttataatatatatgcatggtactgtaggtgggctaccccacacccccagtcatatcagcttcttgcttatactttctggagatatttcatgcatatacagcatgcacacacatatatgtacatctctttgttacacaaatagtagtatacttcatatagccttctgagcccatttttacttcctgtatctttgagattgttccgtgtcagtccatacaaagtgcctcattctttttcactgctgcagagaattccaccatattccataataatatggtttggacttgtgtccccacccaaatctcatgtcaaattgtaatccccagtgttggaggtggggcccggtgggaggtgattggatcacggggcggtttctcatgaatggtttagcaccatcccctcggtgcgaagttcccatgagatctggtcgtttaaattgtatagcaccttccgcctctcttcctcctactccagccatgtgaagatgcctgctccagctctgccttccaccgtgagtaaaagctccctgaggcctccccagccttgcttcctgtacagcctgcagtactgtgagctaactaaacctctttcctttataaattgcccagtcttcagtatttatagcaatgcaagaacagactattatatttaccatattcaaccactctcctatattgtttgtagccttttgttgtaatataaaatcctaaagcaaaatccttatacacaaagaaatggatagaggatgattctacagtaaatatggtaaatgtatacgctatagcaaatatagtaaaatgcaactgtagaatctaaacggtgagtgcaggggtgctctcactatcataattcctgcaattgttctgcatttaaaccatcagtttgtttgtttgtttgtttgtttgtttgttttttggagacagagtcttgctctgttgcccaggctggagtgcagtggcacaatcttggctcactgcaaggtccgcctcctgggttcatgccattctcctgcctcagcctcttgagtagctgggactacaggcgcccgccaccacgcctggctaattttttgtattttttagtagagacggggtttcaccgtcttaaccaggatggtctcaatctcctgacctcgtgatccacccacctcggcctcccaaagtgcttggattacaggtgtgagccaccgcgcccggcctatacttgttcttaaagtgagcatcatgtttttctttcaacttctcaataaattgctaatatgaaatattttatcaacttcaaaacaatccccaaatttcaaaaatataataatcttggaatgtttgttacccttggcttatatcatagaagaacagaggaggcaattatcagaagagtcacatttcaacttccatcattttacccaagggacagtcaagtaaagtaaaactgccctaagtgtcttattttcttgggtctctcaacactcttttaggcaaacacttggtcttcaccaagaacaaagagttataggtgtctgttacctctaggagaagcaagggggaaaaaaaaaaaaaaaaaaaaaaaactaaaacctttggagagtcattgtttgacatcttccttctcagcttccttcttatataattcccaggagtcctagccaataaagaatggtttaactcttctttctgaaaaaaacaaatgattatctttctttagaaaatgtattcctctttcctctgaagactcagaagcagacctttcaggagaatttctggattagagtgtgccatttcagccaagggacttcctctaccagggtccaaagataacacattctaatgaatgcttgctggactgtttcctttttttttctgacaatttgaaggtcttcaatgaaagcatgccagtattaccacagacttatcttagggcagtgctttggtaaaccaaattcagaagctttagaaaagactagaaactaataagtcagctatacatccacttagagtttgccagacagagaaaaaggaaaataacattccagtcacaaagaataaatcacagagggctttaaggcttaattgccacgttttccctccaaaagaatcaaaagtttatcacacttgtttcctaaatctccaaaaatgtgagttattgagagaagagtcatacaatttttaggaatttccatttcttccgttgtcgaacctttgaaaaacaattgcaagttgaagagaactcacatgacccagaaactgttctgagctctatcaatgttcaggaagcagaattttttttttttttaactttttaaactctttttgtagagacaggatttccctatgttgcctaggctggtctccaactcctgggctcaagtgatcctcctgccttggcctcccaaagtgctaagataacaggtgtgagccaccacacgtggctggaaaaaaatgttttcatccagagagtaaaactcaatgaagtggcacagcacgcagtacatttcaactttcccctcttaaagatttcagcctacacactccaatttcacactcaatgaaagcttaagcaaaatgttagcataaatcaaagttttaaatcattttagattgttaactagcaaatgtcctgcagaaattttaaaactcactaaataaattataaatctagttatgagaacaaagcacactgtggaatataaggatgcagaataaacagctattcagaaagtgtgtccaatttttgtcccacccctaagtcaagaggcaaaccatgaccccgctgtgggactgggctgtcaagcactctccctcctctgctaacgctgttgcctctgttcagaagaccttccctgccctctcttcacggggcaaacctacacctctcctccaagatccagctgagcctttacctcctctgtggcccctgatcagaatccccaaggcagaagtttttggagctttattcgtgcctttcttttgttgttgttctttttttttatttttttgagatggagtctcgctctgtcactcaggctggagtgcagtggtgtgaacttggctcactgcaacctctgcctccctggttcaagtgattctcctgggctggtctcaaactcctgacctcaaacaatcctcctgcctcagcctcccaaagtgctgggattacaggcatgagccaccacacccagcctattcacgcctttctgacacctaccactcactataacacacttaacaagcctcttcccattccccacccctcaaggcagagcctgcagccctggtcatcctctatccctgacacccaccacattgcccagcagacaacagcacagtcagtagtcccatttactaaggacttacgtgccagacactatgctcagtgctttatataatatcaactcatttcaccttcacaaaaaccatatgaataatataataataaactatagtatccctccaatcagtcttccccagcctccttaggaggttccttttcatgtgaacaggctgtaacctacaggactctatcctgaccatactgtcatcttgttcctcacactcttcctgggcaatctccaatccaggtctttggagctcattccaaacccatataggacaggcacttggatatctgagtgttctgcacttaaaattggtcatgtcccaaactctgtccatctctctccccaaatatgctctctctttatgattctaacagaacactctatgtccagtcatagcctaagtccaatcaggagaaagaaactacatggtaatttgaacaagggaagataaaaaatcattaactataacaaaagattaatgagaagttggcaaataagaccttgaaagaacacagcaatagctgacataaaatatagtagcaaatataatattatgtaacacaacatataattgccaccacccttaaggctgagacagagcacccaagaaagagttcccccaactctagggctgagatccagaccttgctggagggggctcatacctgacagaacttcaggcaatccactctgtgaaatttgccagaaatcagtcctctagaatgccaaggaaagttgtttgtgggagagtgtctcagtggacgtactctgctacctgggcagcaggagagctgctggtcactaagagctgcaaatgcctgagcactgaagaaacaccatgtgccacactggcctctcttggaaccagcaagtaaatctctttcctcctcaatgtctctccagcaccctctactgacaaaactaaacatcgtgccagctggcggaggaaaagcaaaaggcccagattcattttcacagagcaagcaatgaaggacatacttcgaggtgagaagcaataaatcaataactgacacaagcacacaatcatctatcagttgtctaagcccaaaacctagaggcatccttgatttttcctccagtcatcaagtcccacaggtcctaccttctaagtatttattgaatccatctacttcactccatccacttcactccattatgattaatgttaataatactgatatattaattaattatattatataataaataatatattattgttaataatagtgttaatccccccgtccagttttacttgcttgctttttttattctgttttgcctctgggccactgcacatgggtttcctctgcccagaacagccttccttctttcccctattgccatatccactttttggttagctgattcttcatcattcttcagctctcaactctcttgctccaagttacttgcccctgctaagtacacccaaaagaatcctcttcttccccactaagaacacttaccacacattattgtacaatcacatgttgcttaacaatggatatatgttcatccttgtgtgaacatgatagagtgtagttacacaagcctagatgataccctatagcctactgctcctagactacaaaactgtatagcatgttacagcactgaatactgtaaacaactgtaacacaatggtacatctgtctagggcacttaccccatgaatggagctcactggaagttgctctgggtgagtcagtgagtcagtggtgagtaaatgtgaaggcctaggacattactatacaccactgtgaactttataaacactgtgtgcttaggttacactaaattcctcttttaaatattattttttcttcaataacaaatcagccttagtttactgtaacttttttactttataaaccatttttaaaactttttgactcttaacaactcagcttaaaacacaacacgaatacattgtgcagctctacaaagatattttatttgtataatcttattttataagctttattctatttttaaattttttaacttttttaatgtttttgttgaaaactaacacacacacattagcctaggcatacacagggtgaggatcatcactgctgctcttgcaccgccacatgttggaccaatggaaggtctccagggtcaataacatacatggagctgtcatctcctacaataacaatgccttcttctggaatacctcttccagaatagctggaggctattttacagtgaattattttatatgtaagtagaggacgtacactctaaaataatgataaaaagtacactatagtaaatacataaaccagtaaaacaatcatttataatcactatcaagtattacgtactgtccacgattgaatgtgctatatttcatataaccggcagcatattaggtctgcttacaccagcatcaccacacacatgagtaatatactgggctacaaccttataccacatacaatgtaactaagcaacaggaaattttcgcctccattataatctcatggaaccactgtcatatatttggtgtggtccaccattgcccagaatttctttacacagcacatgaccataattccttattaactaactctcatcattcatacttttacctctatgaaggcaagaaaaatttcttcatcactgaatcccaaagagttagcaagatgtctagaacaaagcagacactcagtatcagctcagttaatggatgttgaatgaaggggggtgacatggttaggcattgtgtccccacccaaatctcatcttgaattgtaaaccccataatcctcataatccccacatgtcaagagagagaccaggtggaggtaactgaatcgtggagccggtttctcccatgctgttctcgtgatggtcagtgagttctcataagatccgatctgatggttttataagaagctcttccccacttcgctcagcactcactctgtcctgccaccctgtgaagaagatgccttgctttcccttcaccttccaccatgattgtaagtttcctggggcctccccagcattgtggaactgtgagtcaattaaacctatttcctttataaattacccagtcttagacagttctttatagcagcaagaacagactaatataaggggaagcattttatgaagcaaataacaacttaaaaggagaaaattttggctttgagattatatctgatatgttgatcagtgtacatgcaataaaattattacacatatataactctaaggataaggagacaatgcctttgtctcatgcctaacaattaagatacagtaaaatataaagtctattcctcaaaagaaaaagaactaattcaaccagctggcaatatgaatttatatgatttcagtatattgtatgcagatgaggaaaaagactgttagttttcaaggtgaacagtgccatcccagtgtagtatgtatatatcaaaggattctgtttatttacacccaataatgaaaatcaaatattacaacatgacattccattgcacaccatgcttctatggtagaaaatcaatacatcctatttgttttcagtaacttgtttacccaaccacagttctagagtcattatgcaatgcaaacagtcttctaaagcactctgacccatatgaaataaaaactaggtcctctctgacactcccaaagggaatatctctctggctaactccaggaatttgctcagggatatatggagcaaagattgtagagctgaatcggtatataaagttactctgacactctgggaggaaatttagccaaatccgtaatagtgagtagcaatctcatccactcaatggccaagggaaatatattcaggactagaactcacacaagccaaagcactaaaatacacaaagtacaaccaccagcagtgctggctcacacctgcgatcccagcgctttgggaggccgaggcaggcagatcactcaagcccaggagttcaagaccagcctaggcaacatggcaaaaccctgtctctacaaaacttacaaaaattagccaggcatgaaggctaaaattagccaggcatgatggttaaaaattagccaggcgtgatggggtatccctgtagtcccagctactcaagaggctgaggtgggaggatcacctgaacctgggaggttgaggctacactgagctgtgatcatgccactacattccagcctgggtgacagagtgagatcctgtctcaaaaaaaaaaaaaaaaaaagtataatcttgaagatttaagcttttttgttgttattgcttatttatatcattctcacagtctaaaggggggaaaaacttaggatacaaacagacgttatttcagcaactcaatcattgtttaatcctcgagacatattgtggacaactgtattatagaatttaaaagtgtgtgagtttattacacacttgtttaaaaaaagacataataagtatgcagtctattcgagctgggcacagtggctcacacctataatcccagcactttgggaggctaacatgggaagactgcttgaggccaggagtttgagaccaacctgggcaacaaggcaagaccccatctctacaaaaaaattttaaaaattagccaggtacaggggcgcgtgcctgtagtcctatcttcttttttttgagacaaagtctcactctgtcatccaggctggaatgcagtagtagaatttgggcttactgaaaccactgcctcccaggctcaagcaatcctcccacctcagcctcccgagtagctgggactacaggctaatttttttttttttttttttttagtagagacggggtttcaccatgttggccaggctggtcccaaactcctggccccaaggaatcctcggcctcccaaagtgctgggattacaggcgtgaaccaccgcacccagccacacttggccatttttaaactatttttattccaactgatatatatttcatcttctataacatgtctcagtatagacatgcatagtctgatcaagaaaatcttgtcaataaaatgaaacttaacaagggccttggggatattctctctaccaagactgatctttcctttacttctacagggctcagtccctcacttatttgctaaaatgtcacctttccccagttattctttaggcccaccatgaccacttactccctcagccaaatctcagcttgccatttcccctgtgcctgcttgacttttctccagagcacttttcaccatcaaatctttacttatttgtatattactgtctgttttctcccactagaatattttctccatgaattaaggaatatttgggtttgtttcacttgctgctgcttcctcagcacttagaactgtgtgttgaagcacagtaggtgctcaataaatagtggttgaatgaaagaaaatagacagtcccagaaattaatcttaatactgatgctgtgaaatgaaaagctctcaaagtgggagtggacatacttttaagagatgattccctttcatttaacttaaagcccaaaggacttttcaaaatgaaattgttattccaactacacccaaaaatcattaaggctgcccctgggtgctcacgtacgttttaacaaaaagcaaggaattctatgtcctgctaaagcaatggaaaaccctgatgtagaaaatgtaaactgcttaagttccatatgtgggtagtaacgatttacaccacaccacttataacattatgagggtcacactaaccacagggagaattccgtttcacctttgtttttccacatacatgccctctaataatacaactcttcacaaacactgtattagctgcattcttaaacacgcctactatctaaaacatacacagcaatgtaactgatgggtacattctcaatcaggtaattttgatagaaaaagtataccaaccagtgtgccatttggccattaaaacaataggaaagacagaactgatctaaatagctcataatatggtctaaaagagatgaccttcaaactttagcgataaaataagaaaacacagaaatagaggtgttaatcagttaacagaagtcagtaagctaaaacgtacaaagttctacactgcattttgtggtaagagacaaataaaatatatgttccccatacaaaaagacttcttaaatctattaagatggaataaatagtatgtacaggataatggagacaaatgcccatagtctaaaatggaaaacttcaaaatcacctagacccaagaaaacaaaaatcacatattaggacaatttgattttcccatgacatacgtggcgctgtagatgcagtttatcctacctccagtcaagtgggtccatgaatagaaactctcaggtataaaccactcctctaccacttcaccccagggcattctagtgacttccatggtgatttggtttggctgtatcctcacccaaatctcatcttgaattgtaatcctcataatccccacgtgtctagggagaggcctggcaggaggtgattggatcacagggcagtttcccccatgatgttctagagatggtgagtgctcaggagatctgagggatttataaggggctcttcctcctttgctcctcactcgctcgtgccaccttgtgaaggtgcctgctttgccttttgccatgattgtaagtttcctgaggcctctccagctacatagaattgggagtcaattaaacctcttttctttataaattaaacaggctcaggtatttctttatagcagtgcaaagacagactaatacacatggttacgtttctctcaactactgacacttggcatgtccagctattataatttcatttctatctcccaaatgttttccatctgtcccattccattccagaccaccgttggcctaggttcagctgtcatgatcgcctggctaaactgcaaaaggaggtgcgatgacattatactcctgcttaaaacttctacaggattccacggttcactgaatgaagtctaaactccttaatactctaatatacggattggacctctgtcctcagccccttctcttccaggcttgaacctccatgtcttggcatacatacttttccaccccctaacatatattccctttcttttctgttttaaaacatctttcttactggtcgtgaacggtggctcacaccggtaatactagcactttgggaggctgtggtaggagaatcgcttgagcccaggaattcaagaccagcctaggcaacacaggcagatcttatctttacaaaaattaaaaattagccaagcatggcagcacatgcctgtggtcccagctactcgagaggctgaagcaggattgcttgaacccaggaagttgaggctgcaatgagccatgatcctgccactgcactgcagcctgggctgctgagcaagagcctatctcaaaacaaaaccaaataaaattcctcttacttttgaaaggcccagtttaaatgtaacctctgtgaaaatttctttgatcctcacaatcagaattatttgttgccttcagggtattgccaaagtactctgtttatatctctgttcaaagagattgtatctatgttaacgtaaatcatagtctgatgatagcttttgtctgtttaacaaagcaccctccttactgactttactctagggaactaccacttcatatggggacctaataacatgtagtttgggtggatccagggttgctcaccatactaaatcctcctggccaccatgacttgttcaagaatggacccatgtctcagtaagaaccactgagaaccctccccataacttctgctagaaccaccagaagaagaaaaaaaatacaaagcctattttataataaatttgaatatctcatgtaacttattgaatacagaaagtgaaaaacaaaatggttatatggtactcaaagtatggtttctattgactgtgtatcatttttgcaccatcataaacttacaaaattctaagtcaaagaatcataagtcagagactatactgacatacgagtcatgatcgtggtctgacttacattacaattaattgtactcagggccaaagaaacagttataagaggacacctggcagataagagaaacagcaagaaggcctgtgtggctggggcaagcaagtgtgggagcgtgtatgggggggaagtgagagagaaggagggcaggcaggggagggaggggagagagaagagagatgggggaacaaaaaagagagagagagagagagagagaaagggagagggagagagagacagagccagacagacagacaccccaagatggcattgtgaaaggtcaagctattgcaaagtcccaagcagaagagggacaggatctgacttaactttcttttttgttttttgagacggagtctcgctctgtcgcccaggctggagcgatcttggctcactgcaagctccgcctcccgggtccacgccattctcctgcctcagcctcccgagtagctgggactacaggggcccaccaccacacccagctaattttttgtatttttagtagagacagggtttcaccatgttaacctggatggtctcgatctcctgacctcgtgatctgaccacctcggcctcccaaagtgctgggattacaggcatgagccaccgcgcccagccctgacttaacttttaaaaggatccttaggcttgctgtgttgtgaaaacaaatggcatgggggtgggcatggaagtgggaggtgggcagggagaacaagacctgttaagaacctgctagggtaaccaggccagaggtgatgaaggctcaaagaaagttttgtccaatttttttttttaaacaccctaattttttttgctaccaattacaactttggaaagacagataaatcaacacatgatattcatacttgatttactgagtatctactatatttaagacactctaaatattaccttatctagttacagaactatcttcctaaactcaaagcccatatgcaaacggtgaactggaattctctaactaaatatcccatacacattttacccccaaaacctaatcctcctttactctctaatctcattatctcattaatattatttcctagcctagttgttactaaagataataagagagtaggtatatttgagacagagctttgctctgtcgcccgcgctggagtacaatggcacaatctcagctcactgccgagaactccgcctcccgggttcaagtaattctcctgcctcagcctcccgagtagctaggattacaggtgcatgccaccacacccagctaatttttgtatttattttagtagagatggggtttcaccatgttggctagcctggtctcgaactcctgacctcaagtgatccgcccacctcagcctcccaaagtgctgggattacaagcgtgagccaccacgcccggccataactttctatattacttaagtagttgtatacaactacacataatttcgtctaaagttcaagacaattctgggagagaaacacccttatttacctctaccattttacagataacgaaactaagctcagaaaaatgcagtaacttgccagaagttattatgctggtaaatagtggagctgagactcaaacgtgggattctaactcatccacaatcacttcagtcagaaacgtgggaattatcttagactcttctctcagccccacgccagatgccctctgtcattcactctcacaccatcactatcttagttcagagcttcccatctctaaactcagttaccacaataggctcacaggttacgttgctgtatcttgcataaccctccccttccatccattctccatactattatcagatactctcttcagttccaaacacaagctttgtgctccaacgcaagtatatggttaggaaacctacagatcatggaaacagagccaaaagtgtcaagagctttcttcatcagtatgcatgcattaattccagcaccagcaacttaccaagcaatttttggcagcatcccaacttcaagattctcattaatatcgccaagtacgaaaaacctggtgattgctcaatttctccttttgtctttcttcccagccccaaaggtgtggactttaagcatttcaaggacctcatcagacctagtcccaccttcctaaattactcttttcttatccaatcaaaactgccattcctagaaggcccaaataggtcttaagtgttcataatgaggtatcagaacatacatattttaaaaagaggagctaattaaataagtgggtctctattctggtatttcataggcatgggggacagtgatgatggtaataatggctaacatttatcaagatctcggtaagctgtgtgtcaggtactgttttacttgctttacaagcatttaattatctgttcctttaatcatcagaactactccatgaagtgggtataattattattattatcacaatttttggataaagaattgaagagctggaggagttaagtaacatgtccaaggtcacccaatcagtaagaggtgccagcgctcctaaccacctcatgctaacaacttcactataatggtagactccaatagagatatgtgaaggagatcattgtgagcttattcattcattcttaaaatatttcttgggagtttattatattctgagaattattcctgccactgggaatttaattgtagataatgcttttatggaactcacaagaaaggcaccaaaaaatacataagtaaaaatgaaaacaacacaattttgctctggaaaaaaaaaaaaggataaggtgatgtagagtaatgcgctactttagactggaagccagggagggcctccctaaggaataatattgaaatgcgatctaaattataagatgaagcaaagaaaaaaacctgatggaaccgcactgaggcaattatgatgaatgcaatacacctaggtaagagttagtttgttagttcctaaaacaacagaaaggacaggaggccattgtgactgatgctaagggagcaagtggagagtggtcagagttatatcagagactcagaagtatcaactatgctggcacacagccatggaggaaaaaaaatctgtattttactcccagcagaatgagaatctggagggttttaaggaagagaacgaggtgatctatgtttctgaaaaagcaattccactcctccaactctgtgtaaagaatgaactacaggccaggcgcagtggctcacaccagtaattccagcactttgggaggccaaggcgagtgggtaacttgaggccaagagttcgagaccaagctggcccacacagcgaaacctcatctctactaaaaatacaaaaattaaccaggcgtggtggcgggcacctgtaatctcagctacccgggaggctaagacatgagaatcgcttgaatgcagaggccgaggttacagtgagccaagattatgccactgtactccagcctgggtgacagaacaagcctctgtctcaaaaaaaaaaaaaaaaaaagaatggattatagagtgatgaaagtggaagactggagaggaattaggagactgttacttctagaaccatgcctggcacgtagtcagtagtcaatgtgttcaataaatgaatgcttcaatatcaaggtaacggaagatgagggctaagacttgggtggtaaagtgctacatgtagaaaccattctgcctcattcaacatctgtgagtgtcacaaacccagtagtcttttaaaaaccagtagcctctttttccggctggaaccatggagggtgttgaagagaagaaggtggttcctgctgtgccagaaacccttaagaaaaagcaaaggaatttcacagagctgaagatcaagctcctgagaaagaagtctgcccaaaacatgctttgaaaggcaaggaagaagcttatttatgaaaaagcaaagcactatcacaaggaatataggcagatgtacagaactgaaattcgaatggcaaggatggcaagaaaagctggcaacttctgtgtacctgcagaacccaaattggcctttgtcatcaggaccagaggtatcaatggtgtgagcccagaggtctgaaaggtgttgcagcttcttcgcctttatcaaatcttcagtggaacctttgtgaagctcaacaaggcttcaattaacatgctgaggattgtagagccatatattacatgggggaacccaaatctgaagtcagtaaatgaactaatctacaagcatagttatggcaaaatcaataagcaaattgctttgacagataacgctttgattgctctatctcttggtaaatatggcatcatctgcatggaggatctgattcatgagatctaaactattggaaaatgcttcaaggaagcaaataacttcctgtggcccttcaaattatcttctccatgaggcggaatgaagaaaaccttgactatctacaatataagctgctccaaagtgcttgaaacatctgagcacacttcccaaaacaggtagtgttctgttgcccatcatgacaatctctcaataactctgaaacatacttattcaagcagcccccatttacaaacatccaccaaccctacctctgccagccctgctactggaaaaaacacttaggacatgccagggattatgccaagcactttgcatctagtctctcatttgctccttactacactctatgagtctaatatctccaaataaatagcaatctatagtaacaaaggcaatattcttataagaatcatgtttttaatacctggcacctatgggaaaacctctctgatggaagaatttaagagaagggtggaagggagcaaattccatttcttccagagtgactaaactacaccgaagtcaaacttatgctacccagttagttttgctctgatgatcctctctgcactgacaggtgaaagcacatgcagaacatgcatggcttattattctgaaaagtccaaaatactgcgcttattcctatagcaactcggaggctaaacagagacccagtgttaacttcatacagacgtcctcagagaagcccttcctttgcagttttatgttctttataattataccaaacctttagctcagaatccctttcactttaaaaaaaaaaaaaaaagaacttacattatcatctagttatatatgcaaggcaccaaagaaacaacaacaacaaagtaaatatggaaaaagacttgattctaagaagtcataatagaattttcagcacttgactgtagtacgggaactgtccccaaataactgttttaagattgcaaaaaaaaaaaaaaaagatcaattcaatataataatagttaaaacttaacacagctctttatgtggcaggcactaatctagaataacccatttaaccttcataacggccattcaagggccactattattatccccattttacagacagcaaaaagacacagaggctaagtaacttgccagtgaagtggtagggacaggatttgccttgcgtgtctgtgttcttatacaccacatgctgctactcttcaaatggaaaaaaaaaaattcactatcacccagaaggcgatcatacgatgatgaattttgactttgctttttatttctaatccttcatcataaaagaaacacttcctttgcagtttcatattcttgtactaaagcatagctcaggaacattttcatttaaaaaaagaaaaaaaatactcccagtatcatctagtagttataagagatacggaaggcattaaactacattattcctataatccttacaagagaaattcaggttcagagaagagactatcaaaatgataaacaatagtgaagtggtaattcagaaaagttcatgtttaagtttcatcttaatctttatctcattgagggacatattttaaaagtaagaacactgacaaactgagagataacgtaacttgtactcatcgtaaggctgtagataaaaacaaggtttcttaaaaccttgtgagtttcttttcctatgctacagcagatgtttcaagaaatgaagctattgcctttgtaggaaactgatatgatcaaaagaaattaaaggaaacttaccagagacagtttgtgttggaaataatttgaagtgccaaactttaaaccatttcataatttttaaattttgttttcatagatattacattacaaagaaaaattttccagaaatattttaatcaaagttctatttaaagaaacttttgattagacattattaaattgtgtattgttttaaaacaataataataatctgtcctgagctattagaaagaaatgtatagcatgttattttaataggcctaaatgaggaaggatcaatattattttaatttttaaaggtctgtttatgaaatgcaatcatccttcattaaaaatgcaagctgtgcttcagcaagaggttagcataaatgattcacagagagatctctctccagtataatcttcctctcctgggagtttccttcggatgtttcatcaaaccactcaagctactattaaaaatgcttccctgcgataaaaggagggaataaacaatataaacacacttccccattcccattcaccaatgactcttccatttgagtgatctatacctttttcagtcataggtaaaattaattttttatattccacgcatttttgcaatcgtttcttttctcaagcattttaagttaacgttattttacagtattcaaaatcagaaattcagatttttaaggtaggtttttaatcacttacctattttgacatttcagtgtgagtcttgtctttcattgaaattaaaagaagtttgccttctatttgacggattttaaaagattttaaaatgtcaactcatcaaagtcaagacactccaaatttaaattcaattctcttctatttaaaaatgctaatgaaaatggctgtttcaatgcagcagcatctggctcattataacactcagttttaactaataaatccttaattattaaattctggtgttcaatttctttcagataaataagccaaacacatactgctacaattataaatacctgggataaattacttataccatgaaaaagcatacctcttgattctctggctgctaaataagacccaaagtatgtaaaggacacacatttgaaagacccagcattaaacatttgggctccactgtatgtaggtcccacattcataggctggcaaatctttaactctactgggtcctcatgcataatgcacagggcaatttgtctgtttgtgcaaatgggccagtttttttccatgctttttcagatgtgtcaaatgtgtcaaaactgaacataatcatatacccctaattctggctttacaaagcagaccctaccttcacccagcttgatgtttttattaaggagttactgaatatatttaatcaaggtattactgcacatcatgatgtcttgtaaaggttgaaatccctgagagaatatgtttggttttaagccctaatatgtgttagggagtgtttcatttttctctcccactcccaattcctttttttttttttctccttttttaatcagcagcatcgacagtactgactgaatattttacaatggagttgcagagtatgtgtgttcaatcgtttcagcttcccagaagattcattacagttacattagaaagtcaaatcaggcaattctgcagtctggtgaaagccagcatatgaaagaaggttaatacaaaagaatttcattttagaggacatttaggactttaaaaagcaacattatgataaaattttcaagatatttgttcttgccttagcacatgctttccaggtctaatttcagagctgtctcaatgcttttctaggaaagaatgagggtgtatgggaggaaattgtttgatctacaaggtctgccatcttaatgatcctcatgctaagaacactgcagatgtatgttttgccctcactcatggggaaagaatctatggttctccaattatgctgatgaagtagaagtcaagtaaaagtgaaggtgcgttcatttaaaacataaagattttcagtgactgttaacatctgtctttctgattataaataaaactaactgctgagattttcagatcttaatatgtatttatataacaaaaaccagtaagttaattgttttccatgattagtagcaggtatagaaagatcttcttcagattggtacatgtttaactggcacttgtgtataatatagtaattcccctctttctagaattcaagcctcaataaacccctaactaatcttatgtatttatttccactggtttataggtaagcaaaaataagaatagactatctactgaaaggcaagccttgtcattcagtacagtcgatttacagaatacaaattccaattcaatacaaaggctcacctttgcatgagcaattccaaagcttaaataccatggcaagagggaaacagcagctagcagtggtaacagacataaaaggcggctgactgtcttcagtgctacctttggcagcagtacagatggactttgtaggccactggctatgcttaatttaatatgaagctaaatacagtcaaaacatctggtgcaccactgatggttatcatgataaattaaatctggcatcacacacaaatccattcaatattctgtttatatcccttttacctaaaccacaaaactaaaaatccacatttacttttgtttttcatttcctcttagcagtcctgtattttagaaaaggaacgttttgtagatctgttgtttatacaagttggggggccttctttaagaaaaagaccacgaaaatttgtatacaaaatgtcaagagggccactcaagtgagggtctctttggtttaagcttcatggacaatccacctctggggaggttgaaaggcagtgtaaaaactaaatagtatgccaagtagcacatggaactgggacaaagaatacaaaaatttttaaagcagacaatttaactgacaagctacagaagagcaaacaagactttctaggcaagcaaatcggcaaaaacaaactgtattgtcagaatctgtttttaacatatatttctaaaatgcaaaaccccaaattgggccaggtgcagtggctcacacctataaatccagcactttgggaggccaaggcaagagaatcacttgagcccaggagtttgagaccagcccgggcaatatagtgagactccgtctccacaaaaaataaaaattaaattaaattgaaattttaaaaccccaaatctacagcatactaccacaacaaaagggctattataaaggaaaaaagtcaattaaagaaccaaattatcagtcaagtgtggtggctatagctgtaatcccagcactttgagaggccaatgcagagggattgtttgagcctagaagttcaagaccagcttgggcaacatagcgagaccccatctccactaaacatttttaaaaatttaaaaataaagtaaaaaataatcaaattgtcaattttataataactataggtcaagaaacaagtataattcttacaagcaactaattcacaaaacaattagatcatggctaaccatttgttatttttaaaaagtcagagcaccacttataactaaagtgactactgcctgaactgcaatattcaaattattgcatttttattacattgctttgaaggatattcagtgaagataattattaattctagtgctatataatattagcatcacccacactcttttaaacaaaaaggacctaaaagcctcgactctgcatctgaagggaggagagcatgccatataataaattcagtacaatcaaaatgagaaccatatttctgtttaactttatgcatcttggctcaagagccataaaaaaaaagttattaaaattaatgcatcaaactataattctgtcctttttattactggtaatattctttctaaaatattagtctgctttgctgtactactatatctttttgaaagttttctttgaagatcaggatcactttaactttagaatgaaaacatgcaattatattaatttggcactgaatcttgttagtttcagtgggtttgaaactttgaaaatgatttattcattagaaagccacatgttggccagacatggtggctcacacctgtaatcccagcactttgggaggctgaggtaggtggatcacctgacgtcaggagtttgacaccagcctgaccaacatggtgaaaccctgtctctactaaatacaaaaaattagtcaggcatggtagtgcatgcctgtaatcccagctacttgggaggtgaggcaggagaatcacttgaacccaggaggtggaggtggcattgagccgagattgtgccattgcactccaacctgggcaacaagagcaaaactccatctcaaaaaaaaaaaaaaaaaaaaagcaaaccagttactgcttctgatggcactcataaagatggaagataatgaagctacttgtcattcaacacaaaacacacaaagaaagtgttaacagctggcaaatgtcacaaagtaaacattttcctatttctgttaaataaaattcattcctaataatcactgtcctgtatgaactttccctagcaaattactgccccatttctttcactaaataatcaattttttctaaagttaacacaaaagaaataccctggaaatcctcattctctagtcatgactaaatgaatgaaccacatgggctaccaaaatcaaattctctactgcatcactaatgtaatactaaataggatgctccatcaaaagagacctagaatttacataatttcccataaacttatcagaggaacaaatgtaagacaatgggaagaaaatcaagataagctcactgttgttgctggtttgtgtattcctgtctttctcaactcctcccacagctgatagaacattgtagttaagagagctggtagaaactacttcactaaaattatgtatttgaacatcagccttttttcattctagtcagccttttttcactctaaagtattaaattcaaccaaaaagccaaacattcaaagtctgttcaccaaaaacactcatcataaagatgtttatttactatccatataaggacgcaaaatggtattcctaacagccaatacacagaatcaacctaagtgtccatcaacagatgaatggataaagtcacatacatatgtatacacacacacacacatacatacacacacacacacacacatatatatgcaataggatactatgtgttctaagaaaattctgttacttgcaacaatatggatgaacctggaggatactatgttaagtgaaataagtcagacatagaaagacagatactgtatgatcccacgtatatgcagaatcctaaaacgtcaagttcaatttttttttttttagaaagaatctcgctctgtcacccaggctggagtgcagtggcatgatcccagctcactgcaacctccacctcccaggttcaagcaattctcctgcctgagtctctcgagtagctgggattacaggcctgcgccaccatgcccggcaaattttagtattttttagtagaggtgtttcaccatgttggccaggctggtctcgatctcctgacctcctgatccacccacccagccacccaaagtgctgggaacacacgtgtgagccaccgtgcctggccctcaatctttttttttttttttttttaaagaaacggggtttcactctgttgcccaagctggagtgcagcggcacaatcataactcactgtaacctcaaattcctgggtgcaagcaatcctcctgcctcagcctcctaagtagctgggactacaggtgtgcgccaccacacctagctaactttttatttttattttttgtagtgacgaggtctcgccaagctggtctcgaattcctaggatcaaggggtcctcctgcctcatcaaccttttttttgaagctgaagtagaagcaaagagtagaatggtggttaccaaaggctgagaggaggactggggaaatgtgagtcaaaggacataaaatttcagtgaggaggaataagttcaagagatcagctttataatatagtgactataattaataataatgtattatattactgaaaattgcaaagaagaatttaagtgtcctcaccacaaaaaaaaaaaatgtgaagtaatacatatactcattttagccattccacaatgtatatatatttcaaaccatcatggtatacacaataaatgtgtacaatttttgtcaatttaaaaaatgggattattctctcacctcaacattgaggtactaactaaaaagatatttcccaactactcagatgctgaagccggaggattgcttaagcccaggagttggagaccagcctgggcaacacagtgagactccatcttgaaaaaataaataaaaataaaaagatactgtgattgtcaaagaaaggaaagaggtattaagtcactgaaaggttatatttttcctttagaaaaatgaaaaattcctactttactgtcaactattacctcttctgacacattaactgtagaatccttttatatgagaaaattactaaatcggacactacatctcagaatctgctagaggtcacttggaaaagagcatcatcctttcaaaaggcaaggatgaagaattagaaagaaaaaggccagaagcacacaagtgaaacaagccagtgcacctgaggcctttgttggtccaatcaaactataggtcacaggtatttcaaaaaggggaataaaagacaactgcagttactttagaaaagggttaaattctccaaagtagacgcttcccaaaagaaaaaacagaacgaaaactgcaaaattctttcttctctcctttggagaatacggtttagcacagtttttaaaaaatcaaaatctcaagagatatgggtgccattcccatcccaataactaagtggctctgctaactgcaggttgtgtgaaactgtacacccactacgctcaattgcaaaacagccataaagaacttagaacactacacaagttcaacagacatgaagaaaaacactacaaaattcaaatgtgagggacaattttcctgccaatatacgtataactctaaattcttactctctctatacacacacacacacacacacacacacacacacacacacaatatgtcttgatgatcagagctattacactgtataaatctaattaaggtcagtttcctatatgggaaaaggaagatttatctgagaaataattcaaaataaattctccccaagtaaatagacctaggcctatcattagtttagtttagttttgttttgtttttttgagatggagtttcactcttgttgcccaggctggagtgcagtggcgtaatctcagctcactgcaacctctgcctcccgggttcaagcaattctcctgcctcagcctcctgagtagctgggattacaggtgcccgccaccgcgcccagctaattttttgtattttcagtagagacggggtttcatcatgttggccagactggtcttgaactcctgacctcaggtgatccgcccgcctcggcctcccaaagtgcagggattagaggcgtaagccactgcgcccagcccctaggcctgtaatagttaagacaatcatttatacatcatttatatcaatcaccacagtccacaaaagtcagccttagataagatgccaaaaatcggagatgaattaaaagaaagagtcctgggtcagtagtacagctttgttgcaagtatctgcagggacctggtagaggtgtgagagacacagttccttggtgtgaagggtgagaggtcacagggagggtagcaggaagcccaagaacaggtaactgaatttggacaggcttttgatattttaagcccatttccatggatttttgttgtgttttgaagatagggtctcgctctgtcacccaggatggtttcttaatatatttactataattattcccttggaatactaatattaatactaagttaaattctttgaaaatccagccagtgtcagttatgctaaatgaaaacaaaacactttgtacaattttatatttaaaaagagaagctctacactctaggattagaagcagtggagccagcaagactctcagggcaacattagctaccatttatggagcacttcttatgttccatgtgccaggctaaattattttcatacattatcccactaatgtataaacaaccctatcatttagctattatcagctccattatatagacaaggaaatggaggcacaaagacgttccataactctaacaggattacaggacagagaggtggcagaacaaggattcaaacccaatccttctgttctcaagctcagactcggaaccattatgctttaccgtcttaccaaaatgagaatcaaaatgaaagaacctcaaagagaaataaaaactcaaaggaagaatctgagttctttaaacaacaccagagcaatcctgtcctaaaactggaggattttcaggttttgcaatgtgacaaacttggaaaagatacatctgacactaaatcctttggcaattttattccacctcggggcttcaactaccccattctcagtatctccatcttaaccttgatgacttctcaagatattaaatatttccatctgcctaatgacaaaaatcactcatctcaataaaaagctgtatttattagcatcttcttcctcaaatcagtttgtcctcctgtgttcccaattttttaatggcacaggtgtaatgcaaattacctatgcttcacacctcccccacatgtaagactatatgccttgttctaacagttgccaaatccaactaattctacctctacaacgtctcccatctgtcatacctcttcatttcccctacagttagaaaggttagattctcggccgggcatggtggctcatgcctgtaatcccagcattttgggaggtcgaggcaggcagatcacctaaggtcaggagttcaagaccagcctgaccaacatggagaaactcccccgtctctactaaaaatacaaaaaaatagtcgggcgtggtggtgcatgcctgtaatcccagctactcggaaggctgaggcaggagactcacttaaacccaagaggcggaggttgcagtgagccaagatcacgccattgcactccagactgggcaacaagagtgaaactctgtctcaaaaaaaaggaaaagaaaaaagaaaggttagattctcattactttccacccagtcttcactctcttcctttcatgacatactagaaatagctatcctaaaacacaactctatcatgtcactcctttatcagaacaccttcaaaaaggctccattccccaccaatcaacccttcaagattcagaccaaatgcctccttctccaagcaaccttgtgtaatctccttcccctaaggagaggtcattgcttcctcctctgaacttcagcagtacctcacttgacccttaccaatttcagcctcctatcacaagtacctgtactgacatacaagcatcgtcaccctactggaagacaagcgccttaggagaaggttcaatgtctaattgaactgtgagtctcccacaaattctggtgaaaatatacttgcacacagtaggtacttaaatatttgacaaatgaatgaaaaaattacaaatcagctttctcggttataacacaagcttttcagcacaagaacttgtgcccatttacttaatttttttaaaacatacaaattgtgaagactaatcataatttccatgaaaccagccctttttggttcctagaatacccgagaaaggtgcttattttatttgaagacaaaaaaagtagcatcagttagctaggtcaggcaccatctaactctactattcactgaggccaggaacatttcctagggcctcagctttggtccttctggatgaagcctcagggggactttcctctgataatggactaaacgattcaagatgaccttaatgaccaccctgtttaaaacagcctccttatttctccaatacttcttctccaaacattgatgtttccaccataaggtcagctcctctttttcttccccttatggcaaggcttatggagaaactacaccacataaatgaagactaggagctcaaaattccagaatgacctgggaccatggaaaattagtattttgccttctacagtaaagtcacactcttgagcaaaggaggaaaaaaaaattatcacagtccctcaatcagcaaaaatctaggcatggaagactaaaagaagttagggtccagtaagcttaaaaaagaaaacagtgactcagaaatttcctatctgcaatatatagcaggtttagaggacgaaaatgaaaacagaagattatttctagacagcttgatggagaaagataatatttacctcagtaaagttacaaccataggaacaaatccagattctatttgtttttgtacaactctgcaaaaaatcatagggtgtaattcacttctcagttcagaaataagacgtccttaaaaaaataagtaagaggtacttcttgaaaactaaaagaaaaaaaatctactcccataatcaagagtttccatgcagtattaaaaatgatgtccagctgggcgcagtggctcacacctgtaatcccagcacttcgggagactgaggcgcatggatcatttgaaatcaggagtttgagaccagcctgaccaacataatgaaaccccgtctcaactaaaaacacaaaaaaatcagccagatgtggaggcgcacgcctgtaatcccagccactcaggaggctaaggcaggggaatcacttgaccctgggaggcagaggttgcagtgaggcaagatcgaaccactgcactccaacctgggcgacagagctagactccgtctcaaaaaacaaacaaacaaaaaacaagaccgggcacggtggctcatgcctgtaatcccagcactttgggaggccgaggcaggcggatcacgaggtcaggagatagagaccatcctggccaacatggtgaagccccatctctactaaaagtacaaaaattagccgggtgtggtggcatgcgcacctgtagtcccaactactcgggaggccgaggcaggagaatcacttgaacccagaaagcagaggttgcagtaagccgagatcacgccactgcactccagcctggcaacagatcaagactccgtctaaaaaaaaaaaaaaaaagtccctcctataattcaggaagtgaaggtgctagttgactgttatttattctcactcaaaaagctaactcaaggtcaagaagacctctgccaccagctgcagtgtaccaatcctaggaggctatttctcagaaccccatgcttcttatcaagatggttcccacgctgtcttccctttccctcatcactgcctcctccaggtcaaagaatatccccagggcaagttgcagctgctccttatgcactcagccctggcctcagagtacacatgggttttgcctcatctatgactcttgggggaagcttactatgcagagagcaactgcaatgtgtcgctctctataggatcccagccaggtgccttagtgccatcgggaaaatgagaggaaacaaggaacacacaaaaatcatgaaatactgcttcgggtactaactccaagacagaatttttttcttaagttaaatgtttaaaaacaaaaaaaagctacagtcatctatgtattcagtcatccagtcaatcccatgccaagtataatctctgttaactatgcttagtgtggtcagaaaggaagtctagataaacaatcacaacaacagagtgggctgaatgcaaacagccggggttcaaggaaggctccctgaagaaaattacctgtaaactgaagcaagcaagaggtgaccaggctaagaagaaaagaatgttcaccacacagccattactcagggacgtaattcacccagatttctatttttaaaagatcaaaggctccaaaaaagcaaagggccagtaagcacaagacagaggctcaacctcattagggaaatgcaaatcaaaactgtaagataccacttcacacccatcagaatggctacaatccaaaacccagatagtaagtattagtgctaatgtggaaaaactgcaaggttcatgcattgctagtaaaattgtaacatggtgtagccactttggaaaacagtttgtcagtttctcaaaatgttaaacagaggttccataccccccaaaaatttcactcttaggctttggaagtcaccccaagagaaatgcaaatacacatcctcacagaagtttgtacatgaacgttcacaacagcatttttttaacagccaaaaagtagaaccattcaaagtgtccatcaactagtgaataaataaaatgtggcatagccacacaatggactatgatttggcatttattgggaatgaagtacagatgttatgctaccacatgggtgaaccttgaaaacattatactaagtcaaagcagccagttacaaaagactacatgattcaattaacgtgaaatgtccagaataggcaaatccataaagacagaaagaagattaagggctgcttagggctgggggatgagtagaggaggaaatgaggagtaactgctcatggatacaggatttcttctgggcataattaaatgttctgaaattgcagtgatgattgcacaactctgtgaacacaaaaaacaattgaattgtacaatttaagtaggtaaattatatgatatgtgaattgtatctcaataaagctgttataaaaccaaacaaaaggccggatgcggtggctcatgtctgtaataccagcactttgggaggctgaggtggatggatcacccgaggtcaggagttcaaaaccagccaggtcaacctggtgaaaccccatctctactaaaaatacaaaattatgccaggcgaggtagctcatacctgtaatctcagcactttgggagaccgaggcaggcggatcacaaggtcaggagatcgagaccatcctggccaacatggtgaaaccccgtctctactaaaaatacaaaaattagtaggacatggtggcacgtgcctgcaatcccggctacccgggaggctgaggcaagagaatcgcttgaaccagggagtcggaggttgcagtgagtcaagatcgcaccactgcactccagcctggcgacagagcgagactccgtctcaaaaaaaaaaaaattagccgagtgtgctggtgcatgcctgtaatcctagctacttgggaggctgaggcaggagaatcacttgaacctgggaggcagaggttgcagtgagctgagattgcaacactgcactccagcctgggcaacaatgaaactgcatctcaaaacaacaacaacaaaaagaaaaaacaaacaaaagatcaaaaggactacagcagtgaagaacaaaatttctaattttgttagaaattagaggatttgaacatgccaactggtttggaatctataaagtaattcaagcaagagacagtggccaggtgcagtggctcacgcctataatccccgcacttgggaggccaaggctggcagaccacttgaggtcgggagttcaagaccagcctggccaacatggtgaaaccccatctctactaaaaatcaaaaaattagctggatgtagtggcacgcacctataatcccagctactcaggaggctgacgtgggagaatcacttgaacccaggaggtggaggttgcagtcagccaagagccaagattacaccactgccctccagcctaggcaacacagcaagactccattgcaaaaaaaaaaaaaaaaagaaaagaaaaaaaagagagagagagagacagtggcctgaactagcgtaatggattaggaagagataagagatacaggaaaaagaaacaatacttgattctatatagtggggagaagagaaggaatcaacacagcccagggttacttacttagaaaattgagtagcatttatcaaaacaggaaaacacagaaagacatgtttgggagcaggaaaattcacaatattgtgaaatttaattatatttacaaaagttatataaggacttagagaaggttttaagaaggttttgttttaaggttttgttggaagctttcttgggcatttatctaattttaaaatgcaatttaatgttagttatgtttataagtagaactggatatttaaacagaattcaacttgaattaatcaacatgtatcaaaaactgcattatttttcttttacctttatataaaatgtactgaattaatgaatagactaatatgatttataaactgaactcaaggctcaaggaaaattggactttaaactttttaacaataaattgactattcattttctacaccagaaactgtaagtagttgggtatcactggcatgtagcattactggttgaaaaccgagaagttctaatttgatggcttctattttctctggaaatgaggtcatcaattcaggaaatggaacggaaggatgggtggtatgagaaagtagaccaggaatccaaggtttgatacataattgaaataaaagcaatggaggccaggcacagtggctcatgcctgtaatcccaatactttaggagtctggggcaggacaattgcttgagccagaatttgagaccagcctgggcaacatggtgaaatctcatctctacaaaaagcaagtcaaaattagctgggtgatgtggtgcacatctgtattaatcccagctacttgggaggccaaggcaggaggatcacttgaaccagtaggtggaggctgcagtaaaccaagattgcaccactgcactccaacctgggctgcagagtgaggccttgtctcaaaaaaaaaaaaagagaaagaaaaaaaatgctgcttatcaaaaaggatgggatttctaaataaaaagctttctttattaaaaaaaattaaaaatagcctgtaatcccagcactttgggaggccaaggcaggcggatcacttgaaggtcaggagttcaacaccagcctggccaacatggtgaaacctcatctctactaaaaataaaaacaaaattagccaggcatggtggtgcacgcctgtagtcccagctacttgggaggctgaggcaggagaatcacttgaacctaggaggcggaggttgcagggagcagagatcacaccactgtactccagcctgggtgacagagcgaaactttgtctccaaatataatataataataaaataaaataaaaatgaataaataaaagtgatggagaaaagacgagctacgtggtggacagatacagaaggaccacttgaaatagtcacaggccatttggagtaaaaaggccatgacttcatgaggcatccattagctgaatgatgtctttttctttaaaattacttagtagcataatgactttcttccaaataatgtaaaaagaacgtgtttctggagtcttgattttcagctataccttaaagatagaaataactaagaggaaatttgatgtatgtacttacacaggaatactctgcactctaaatctaaccatggaaaaacattctttccaggaaagttgtataaaccacaatatccatttcagaagataatgaaagtatcattcattcattatactttaatatcatttctatgtcctttttctctaatccttaagtcagaattctagacgagtattgtccaacagaactgttgggaatgatggaaatatactgtatctgtgctggccaacacagcacccactggtcacatgtagccactgaacacttgaaatgcagctagtgtgactgaagaacttaactttaaattttatttaagttaatttaaatagtcatatgagggtagtgcctaccataaagaacagcacagtaaacttttctgttaaagaaaatgaagaaatttacaggccagttaggtgtccaagagtcctgtttacaacacaaaagatgtgaattcactcacttatgaatacatgtaacaacaccgacgcttgtccctgaagagcctttggttctattctcataatacaagagctctaaagtctcaaaaatgtgggtgtggactaggaggacaaaggaaatccatttcacaccccaagttccaagagaaaccgtgtacttagagaaggagttcatcatccttaggggaaaaatgttcatcagacaacttctagaggccagaggtcggcaaacggtggcccacaggccacatctggactgcaacctgtttttacaaataaattttataggaacacagacatactcatttgctgtaaaagcatgtatccatgctttggggctataagggtagaggtgagtagttgtgaccatctggcccacgcagcctaaaatgtttactacctcacatagtaaatcattgatttgagtaaatgttttttacccaatgatttgagtaaaaggagtaaaagactttgttttgaggggtaaactgctgctgtattttattattaggaaaaaagcaatttcaaggaaaaaacaaaaaacaaaaacaatcatatatagaagatttaaaatactgcacttccaatcccaatccacagtattccatcaaaaaatcactgacccaataaatgactgtccaagtacaaagtgataggcagatgcctaattcagaatgacaaccttaagacactgaattccgaaccatttttaaagttgtaaaactccaaaccactataaaggatgtaaaacacatcattttggtttgtttggagacagggtctcaatcgctcacccagggtgaggtgcagtggcacagtcatggctcactccagcttcaacctccaaggctcaagcgatcctcccatgtcagcctcccaagtacctgggactacaggctcatgctatcatgcccagctaactttattattttatttttgtagagatggggtctctgcccaggctggtctcgaactcctggactcaagcgatactcctgcctcagcctcccgaaatgctgggattacagacatgagtcaccacacccaggccacacgatttttttttattttttattttttgagatgaagtctcgctctgttgcccaggctggagtgcagtggcacaatctcagctcaccacaacctccatctcccaggtccaagcaattctcctgcctcagcctcccgagtagctgggattccgggcgcacaccactgcacctggctaattctttgtgtttttagttgagatggggtttcaccatgttggccagattggtcttgaactcccgacctcaggtaatccacccgcttcagcctcccaaagtgctgagataacaggcgtgagccaccgcgcccggccaacaccattaatttttaagtacactaatatattggaaattttctaaaacaaagcttgaaacaactatcaccaaaagttctgtaacacaaagagtcaataccactgaacacagtgttttcacctgtaacggagtaaacattctcatttcagaatattattgaaatagttaaggtattatcatgaggtacagtacctgacacagaatgggtacttatttaaaaaaaaatttttttttaaaaggatgactgtaaggggtcattccccatggattatggataattagggccttaccttctcaataatgcaaaactacattttcaatattgtagcatcactgaatgttttgtccaaaactagatttagagaaaatgtcacctactgattgagagcacagtctcgagaagcagactgcctcagtctacttatagccctactacgtactagctctgtcctcagtttcctcatctgcgaaataactatacttaacaatccatgaagaacaagggaagggtacagtgacgtagaacaacactgtggcaaactgtaagcactcaacaaaatgctgtattttaaaaacctatggctaatgtactgcccaaaattggtacaatcttttttagagggtaacttggcaatttctactaaaatctaaaatatgcctaacttttgaatcagtaactctatttttaggaattcatcctgtaaaaatattcacaggtttatgaaaagatattgacaaggatgttaactgcagcatcgttcataatagcaaataaccggaggcagtctaaacatctatcagttgaaaacaggccaaattataacactaacatgttttcttatggaatacctgtaattattaaaaaataaactatgtgtgcacctatttggggaaatgttcatgatttgtggttaagattaaaaagtgggtctcagtacagtatgtagaataaaatcttatttctattaattaaaaaaagacagaaaataactacagcagtcagaatccactaaggagatgcaacaacccacctgctggggggggaaaatgtaatgaaaaagaaaatgcatatagcataaatgttttttagagaaaaaacatggaactcctctaacagctatcattttggagattagaactattagaaactgggccgggcgtggtggctcacacctaatctcagaattttgggaggccgaggcgggtggatcacttgaggtcaggagttcgagtccagcctggccaacatgacaaaaccccatctctactaaaaatacaaaaaaattagccagacgtgatggcgcacacctgaggtcccagatactccggaggctgaggcaggagaatcgcttgaacccaggaggcagaggttgcagtgagctgagattgcgccactacactccagcctgggtgacagagagaaacttgtttcaaaaaaaaaaaaaaaactattaggaacttctatttgctaaatatttttttgcattatgtaaagtttataattagcatatactaattttacaatcagaaaaaagatgggccgggcatggtggctcacgcctgtaatcccagcactgtgggaggccaaggcaggcagatcacgaggtcaggagatagaggccatcctggctaacaaggtgaagccccgtctctactaaaaatacaaaaaattagccaggcgcggtggcgggtgcctgtagtcccagctactcgggaggcagaggcaggagaatggcatgaacccgggaggcggagcttgcagtgaccggagatcacgccactgcactccagcctgggtgacagagtgagactctgtctcaaaaaaaaaaaaaaaaaaaagaaagaaaaaagaaagataaaataggtttttagagacttgtgagaactctgctgcaaacgctgtttaggaaaacatataaaattttgtatgtatgtactgtcacatgtacatgtacatatgtaatatctatatacccaattttgtaaaataatcccaattttgtaatacatataactagaaaaagagactggaagaaaagacaccaaaatacagacagctgttatctctataaactccatgaaggcaggagcttcaactgttttatattgaaatatatactcaattacaaacatatgcttattttttttaattacgagatataacctgtcactacactggactgaaacttactgctacttgagatatttgttcctgatatataaattctgttttactttatcctcttgaagcatcattctaagtaaaatcttacaaagtaaacttacaaatccagcaaggaaaaaaaattagattacatactgtaccttgctctgataagaactttacaatggctttgaggaactcaacaaggaaaatcagtgtttccaagaagaagaaattcggcaggacttggtggttcacacctgtaatcccagcactttgaaaggccacggcaggtggatcacctgagatcaggagttcaagactagcctagccaacatggtgaaaccccatctcaactaaaaatacaaaataattagttgggcatggtggcgggcacctgtagtcccagcagctactcaggaggctgaggcagaagaatcacttgaacccggaaggtagaggttgcagtaagctgagattggccactgcactccagcctgggcaacagagcaagactcggtctcaaaaaaagaaaagaaaaagaaatttatgggctgggcacagtggctcatgcctgtaatcccagcactttggaaggctgaggcaggtggatcacttgaggccaggagttcaaggccagcctggccaacatagtgaaaccccatctactaaaagtacaaaaattagccaggcttggtggcacatgcatgtaatcccagctacttgggaagctgaggcgcaagaatcgcttgaacccaggaggtgaaggttgcagtgaacagagatcatgccattgtattccagcctgggcaactaagaaatttacttctttaaaaaataaaaataaaaaaataagtgaatatctggtctgtacctttaatacaatatcaactaaacttaaaagaaaaagaattttgttgattgaattaccaaagaaagtttttgagaattttaaggtccaaaaatgttactattatttgtcatcttaacttaaagatctaaaagtcaaaacatctgtctaaatagagatgttcaagaaatatttcatgctttgaaatgctatagcaataatatgaaattatattaaatcataaccagatgatatgtcttcataacaactctcaaccaaagaaagcagatgctgaaagaaggttgctggccgggtacggtggctcacacctgaaatcccagtgctttgggaggccaaggtgcgccaatcacttgagctctgaagttcaagaccagcctgcacaacatggcaaaaccccatgtaaaaaaatacaaaaattagctgggcacggtagctcacgcctgtaatcccagcactttgggaggccagggtgggcgaatcacaaggtgaggagttcgagaccagcctgaccaacacggtgaaaccctgtctctactaaaaacacaaaaattagccgggcgtggtggtgcgcatctataataccagctacttgggaggctgaggcaggagaatcgcttgaacctgggaggcagagactgcagggagctgagatcgcgccactgcactccagcctgggcgacagagcgagactccatctcagaaaaaagttacatctaaagtaagttacaatgctgtacatacatttgacatcaatgacagtcaaagacaatgagaaggggaaatgtcacaaaagaactgccatagaattttaacagaatgatctctaatgatctttcccactcatttactcaagtctttgacatcagctcatagccttccttctcaacaggatcctatcataatccagggtgatggcaacaaaaatgtactcatctaaccaggtaccttgttcctaggtgtcctctctccacgaatccacacacgcagccaaacttgctctacctctaaagccattcattcgaggcatcccattctctagccataatcactagcaatcctgaatattcgagatgcatttgttctccagcctcaactgtacctgtctttctttggtcctcagttttcttcatttcagcatctttcagatttcacttctactttctctggtttatactcactgcttgtaggaatttaatattatctccttcattttggcaaactatttttttttttttttttttttttgctacagagtttcgctcttgttgcccaggctggagtgcaatggcgcgatctcggctcaccccaacctccgcctcctgggttcaagcgattctcctgcctcagcctccctagtagctgggattacaggcatgtgccaccacgcccggctaattttgtatttttagtagaggcagggtttctccatgttgtgtcaggctggtcttgaactcccaacctcagctgatcgacccgcctcggcctcccaaactgctgggactacaggcatgagtcaccacacccggccatcattttggcaaactattaaaacctataagaaatctaacttatttcaatgacctaaaagaatcaaacaagaattaatagtctattatacagaataaaaccatgtttatctaatcttctcaaggacataaacataacaaacatgaacgtgctcattcattggtgggtattttaactcctcaatagtccaaccctcatctgcttttccttaaaattatttcattattccagctgaggagaattaaatcatgtgaaaagccccatatcagcctttcatagtagcatttcttctttctttcttttttttttttttttttttttttttttttgaaacagtctcactctgtcaccaggctggagtgcagtggtgcgatctcaactcactgcaacctccacttcccgggttcaagcgattctcctgcctcagcctcccaagtagctgggattacaggcgcacgccaccacgcccggctaatttttgtatttttagtagagacggggtttcaccatgttggccaggatggtctcgatctcttgaccttgtgatccacctgcctcagcctcccaaagtgctgggattacaggcatgagtcaccacacccagccacatttcttctttcttcataaattttttctgggccgggaacagtggctcacacctataatcccaacactttgggaggccgaagcaggaagacttcttgaagctaggcattcaagaccagcctgggcaagaaagtaagaccctgaccctgtctcagcaaaaaataaaaaaataaaaattagccagatgtggtggcacgcacctgtagtcccagctactcaggaggctgaaatgagaggatctcttgggcccagaaggtagaggctgcagtgagctacaatcacaccactgcactgcagcctgggcaacacagtaagatcttgcctttaaaaactaaacaaataaatcaacttttttaaaaaacaattttttcccttaacggtattttctagcacctaatattaaatacacatggtggttatttcatgttttctaggaaacaagtaactaacataaaaacaaaaaataaataaaatacacatggtgtgtgtttgataaacaatggaatattttacctctttcatcacttaagctttgcatatattaactcatttaactcttttaacaattttatgaggtaggtattactactatctccattttgtatcgaggaagctgaggcccagggaggttaagtaacttcctcattaatataaagcctctatgcagtagagctcagatttaaacccaggcggtcttggattctgcatctgtgctcttagcaatcatgccacactgcctctcaaacccaggctaaacttttgcttaactgagaaatctttccactgaaaacatggttaataattagtttcattatattcaagtaaacaccaaattagtacatcgcttccataccaattgtaataatctctaaattcttcatctgtttatcattcataacacagtaatcattcttcctattttcacaaaccatttcttatataaatttcctaaactttacatttcctttcactttaaatagctcagtaactttctaattttttcatccacctgaagttaccgggttactttcttcactgtctcattcttttcttttttaagacaggggctccctctgtagcccaggctggagtatggtggtgtgatactggctcgttgcaacctctgcttcccaggttcaagcgactctagtgcctcagccttccaagtagctgggactacaggtgcacgccatcatgacccactaattgttgtattttgagtagagacaggctttcgccatgttggccaggctggtcttgaactcctggcttcatgtgatctgcccggcttggcctcccaaagtgcaggactacaggtatgagccacggcacctagccccaaaatattgtttcattctattaagcatgtaatatacaacttaccaaattttgtaactaagttttcctctttccttcttctaaaaaccatcaatgtttcaacttccccttaaattcttttttattttattatcttttttttgaggcagggtgtcactgtcacccaggctggagtgcagtggcaccatcacggctcactgcagcctcgacctccccgggatcaggtgatcctcccacctcagcctccggaatagctgagagtgtaggcatgcgccaccatggccaactaatttttttttttttggtaatttttgtataggtggggtttcaccatattgcccaggctggtctcgaactcctgggctcaagctatccgcctgtctccacctcccaaagtgccaaaatgcaaggattacaggcatgagccaccacaccagacctaaatactttcttttgctgaatgttaaaacagtatcaaagtcaaaaattagaaccacttattctgagtgaagccaataagcacttcacctttgaaggagctctaagtagaacacgaaagaaagttatcaatattttatctgctaacatttacacggcaacctacttaaaaagttatatgggtgcttccacttctggaaagcattgtcttatctaagaagtccagattttctctttgcccttctagaaaacacatactatcaagtgtcatcaaatatttttcttatgttttataccaattaaaatttaataatggaggtgactgtgaagggagaaagaacaaagagaatacccaagcctaggtttaatttttataactttttgaagaaaaatatcaagaaaataggaaaacagaagagaatgaacattatattttctacatgaaattaaaagaagacagtagtttgagacaggtcactctgaaaacaaagtgtcatactttttttttttttttttttgagatgcagtctcgctctgttgcccaggctggagtgcagtggcacaatctcggctcactacaagttccacctcctgggttcacaccattctcctgcctcagcctcctgagtagctgggactacaggtgcccgccaccacacccggctactttttgtatttttttagtagagacgtggtttcaccgcattagccaggatggtctcgatctcctgacctcgtgatccacctgcctcggcctcccaaagtgctgggattacaggcatgagccaccgtgcccggccccaaagtgtcatacttttaataaaagtatatggtataaaaataaaagtatatggttaaaaaaaaaaaaaaacttcaactacccagacctcaatttgaaggccaaatgttgtattactaatagtgataccctgcacaaattaattctctgaatctccatttcctcatctggaaattagtaataccatctaccctgaagaatgggttattagaagtaataagaatacagcagctcaatcattccttttctccaaccatttcttacagtcaccacactaagcaaacagcaagaactgactcacctcaagccattacataaaatttatctattagacagtgagttaaagtatcaaataattctcattgtgatgaccccacatagactgttgtcttaaagtctttctgctgtattcagctctaagaagatgtttcttgatgcgcagttaaatttacaataaattacctgaaaattttctcaggcatgccaaaaatcacaagatctatttatatattttagcaatctagtgaaaacgttctttacttatcaagaactgatgatacttaaacttccttccagaggtctctactcagtttaatttgtgatagcacttgtatgtgagacagcaaacactatacattttaagcaaagaaaaatactatagaagacttcattttttacagagtttaaaggaaagctcattctgatgttcagaaatacagtggctcgggagtggtggctcataactgtaattccagctcttcgggaagccgaggcagaaggatcacttgagcccaggagttcaagaccagcctgggcaacatggcaaaaccccatctctgcaaaaatacaaaagctactcagttgtggtggcatgtgcctgtagtcccagctactcgggaggctgaggagggaggatcacttgagtccacgaggtggacattgcagtgagtcaagatcatgccactgtgaccttgtctcccaaaaaaaaaaaagaaaaagaaaatacagttactaaacagttttgtttttgttttgagacagtcttcctctgtcacccaggctagattgcagtggtacagtcttggctcactgcaacctccatctcttgggttcaagcaattctcctgactcagctcccaagtggctgggattacaggcatgtaccaccatgcctggctaatttttgtatttttagtagagacggggttttgccatgttggccaggctggtctcgaactcctgacctcaagtaatctgcctgcctcagcctcccaaaatgctgggattacaggcatgagccaccacgcccactccagttactaaacagttttatgtgtaacatcacttagactctatcctaaggaaataattgtaaatatgagatgacatttatctgctagaatataagttccatccgggcgcagtggctcacacctgtaatcccagcagtttgggaggccgaggtgggcagatcacgaggtcaggagttcgagaccagcctggccaacatggtgaaaccccattctctactaaaaatacaaaaattaggctgggcacggtggctcacacctgtaatcccagcactttgggaggcaaggtgggtggatcacctgaggtccaggaggtcgagaccagccttaacaacaaggtgaaaccccatttctactaaaaatacaaaaattagccgggcatggtggcaggtgcctgtagtcctagctactcgggaggctgagacaggagaattgcttgaacctgggaggcggaggttgcaatgagccgagatcacgccactgcactccagtccgggcgacaaagcaagactgtctccaaaaaaaaaagaaagaatgtaagctccatgagagcagagatttttttctatttattcattatcatatcctcagtgcctagaacaatgacaatcacttatttactgaatggaaataaaaagatccatagtgttacagcagtaaaaaacagaaaacacttatgatacattatgcattcattacaatgatgatgaaaatttatgattacataaaagtgcttacactcatttatttaaaaaacattaacttagtggccgggagcagcttatgcctgtaatcccagcgctttgggaggtcgaggcgggcagatcacttgaggccaggagttcaagaccagcacggccaacttggtgaaaccccatctccacaaaaaaatacaaaaattagtcaggcatggtgttgtgcacctgtaatcccagctactcaggtggcaagattctgtctcaaaaaaaatgactaagtcactaacttaggcattaagaagactgggttctaatgccaactctgtcactaatttgacctgtaccttggggtaaaggacaacctatttgggctccagcaccctcgtatgtattatttcctccccatttcctggccttggctggtcttaatgagactggctttgggtagacattacagcgagtacatgcctgagttacctcagaaagcaaagactaacacaaacagcagagaaaaaggggatgcaacctggagcagatcaaatgctgcatcccagtggactaggagatcctcagtgacatgctcttcaagccacactgactcagaatcatccatttttaactctaggacctcaaagcatccttgaaccactttacaataaacagcaagtaatttaggtcatctgagtcaagagaacaatgccatccagggtataccaaaatatcaagccctactgtcaaaaggaccagaaaataaagtacaggtggagaggaagtgatttcacccgctggaaatagaaaaagtagatctgtgtgtcagccaacaactatcacacaatggaacaggatgcttacctctctgctggaggaaaagaagctattctcaagtccttagaataaaaactattgtaatcttactatatctattttatgtcatctgagagcaatccatgaggacaatgcttcctctttcagagaatcttccaactgaaaatctcaaagaattcccaagcaccacttgcccttcaacacctacctacacctcacttctctgccccacactcacaaactttattagcatccacaattaaagaaccatgaggccaggcgcggtagctcatgtctgtaatcgcagcactctgggaggccaaggtagaagaatcacttgagcccagagggttgagaccagcctgggcaacatagggagaccttgtctgtacaaaaaaaaaaaattctcggccaggcacggtggctcacacatgcaatcccagcactttcagagcccaaggcaggcggatcacaagctcaagagatcaagaccattctggccaacatggtgaaaccccgtctctactaaaaatacaaaaattagctgggcatggtggcacacacctgttgtcccagctactcaggaggctgaggtaggaaaatcacttgaaccctggagatggaggttgcagtgagccaagatcatgccgctgtactccagagcctggtgacagagcaagactccgtctcaaaaaaaaaaaaacaacttttttttaaattagctgggtgtggtggcacacgcctgtgtcccagaggctgtggtaggagggttgcttaagcctgggaagtcaaggctgcagtgagctatgactgtcccactgcattccagcctgggcaacagggtgagaccctgtcttaaaacaaataaataaaaaacaaaataaaataaaactctgctctgccacttcctagctgagttactttgggaaagttattgaatctctccgtgcctccattttctcacaattataaaacggggataatacctgttacacaggattgtgataaagattaaattcatctagaatgcctgggtaaatacttagcataaaatagatttccaaaaatgtaaggccaatttctaccgaggcctattccttacaaagaaaactgaagacacataggaattctcattccttgtagtgatctaaattaccaaaccatgcaacatcttaatataaaagaaatctcaaggaaggaaatgaagttactgcctcatggttttactgacaagcagtttttaaattgcaggttcacagagggatttgggggacccattaatcccctgaaattatacctgattttgaggcagcgtgctacttctgtaaatgtcttcactgaatttccactagctccaaacctatttctctattctcctttacagcaaatatcctcaaaaaggtgctatactcactctctcaaattctcctttcattctctcttaaacccactccaataagaatgatgaaacaaaccctgccctgaaactaatcttgccaagatcatctgtccacattgctaaatccaatgatcagttctcagtcctaagctgatttttagcagatttttgacacacttcatctacccctcctgcttgaatacgtttttctcatctggcttccaggatgccatataatatagtctatgatttcttggttttcctccttttttgctgatctcttatcagcttttgttgctgactgttgtctcagactttttaacgtccctggacttcgtccttgaactttttctcttctcttccctatactccactggtaatctcttctggtttcccagctttacttacacttgccacacactcacaactaggtatctccaacccaggtttctcacatgaattccagactcttacaccatcttaaaactgtctacttggcatctccacttgagtatctaatactactttaaccttggtgtgtccaaagtaagctcaagaggccaggcgcggtggctcacacctgtaatcccagcactttgggaggccgaggtgggcagatcacttgaggtcaggaattcgagaccagcctggccaaaatggtgaaatcctgtctctactaaaaacacaaaaattagctggatgtggtagcaggcacctgtagtctcagctactcaggaggccgaggcaggagaatcacttgaacccgggaggtggagggtgaagtgagccaagactgcgccactacactccagcctgggagacacagtgagactccatcttaaaaaacaaacaaataatctgctctaaacacagccttcccatgtcagctcctgacaaccccatcctttgagctgcacagtcccaaaccttggaatcatccttgactcctttctttcaacccctaccctacagtgaaattcatcagagaccaggcatggtggttcatgcctataattccaacacttggggagggcgagacaagaggatcatgtgagcccaggagttcaagaccagcctgggcaacatagtgagaccccatttctacagaaagtttttaaaattagctgagcatggtggcacatgcctatattcccatctacttgggaggctgaggtagaaggatcacctgagccagggaggtcaaggctgcagtgagccgtgttcacaccactgcactgcagcctgggcaacagagtgagattctgactaaaaaaatttaaaaactcatcagaaaatactgtcgctctatcttcaaaatacatccagaagtcatatacttttcacaagtctactagcaaatggatgaagcaccaccatttctcacatgaattattatcatgatagcctcccacctatctcattatttctagcctgttgtcccagtctgctgtccacaaaggagtcttctgtccttttaaaatgcaaataatgcactatgggaggccgaagtgggaggactgtttgaactcaggagtttgagaccagcatgggcaacctaaggagagctgtctctactaaacagaaattaaattttttaaaaaaagaagagaaaatgcaaatcacatcatgtcacttctttgctcaaaaccatccagtgccttccccatttcaatttaagccaaagtcctgaaaaggccccaagaagcacctttacattcccccagccccttaccggtgaacatctacctcagaagtcacaacagacatcgtagactgaatgggtggtccccagaaagatatgtccaagtcctaatccccagttcctggggactgccaccaaagattgccagcagccaccagaagcaaggaggaagtatggaatgggctgtccctaagagcccccagaaggaactaaccctgccaaccgacaccttgatttcagacttctggcctccacaactgtggcacaataaatgtctgttgtgttaagccaccaagcatgtgcttgtaatggcagccccaggaaactgacacaccactctaccccctgctcattctgctcccaccacgctgtcttccttgtgcccacttcaggacctttccactgactattctcctctgtctgggaagctcacgctgcagaacttcacatggcaaactcccacacattttagccttttgctcaaacatcatcctctccatgaggcctatcctgactcccctatttaaattgcaaccaccaccatctttccacttctttcaaactcccttacagtatctatttttttccacagcatttatcatactctaatatactacataacattcttgtttattacccattggattccatagaatataagctccacagaggcagggtttttaggtttgcttggggttttttttctcttttgttcactggtgtattctaaacatctataaactatgcctggcagatagtagctgttcaataaacacacgctgaataaatctgttgaacgaacgtgtatatgtatatgtctttttctggaaacagaattcacagtttttatcagattaatgaagtgatctgctacccaaaaaaggtttccaaatctttgttctcaagctttaagtggttaaggaaaagggaattctatcctaaaagaccccaactctaaaaaaagcaaacaaaaccccaaaaacactcatactatgacttcgtatcttacaaatggcagacacaagtttaaatttcatactcccaaaaccaaattttgctaaagaaaaaaagacagtccactacaatttaatggcttgagaagcaccttcacccacttttcacagaaccttgcacactaaaaggtgtacccaggatgagcttatgtctctactgcttaagcaacaaagggtggccagcagtgtgaagcattcacataagcaaatcaaagttccacacagctcaagaacatgatccaatgctccacctaggtaaaatcctatccaaagtaggggagtagaaccaaagcaaatcataacctgtctagcatctatccttactatggaataaacagatatttactcaaaatacaacactgttttaaagaccttgagaaaccatagaagagatgtcatttacatgccccctcagtatgaaccataaagcgtaacaatgaaaggcagtcaagcataggaaaacctgttaatggattttgataacagcagaaaggcacccactacattccttattattgctgcaacatatttcaaagttactactaaacaggtctaggctaatacaatcacaccaaacaccagaattcagcatattacttatccaagcatacattcttcagacatatcttttatattaaatcaatgaccattacagaggaaaatatgcacatctgctgttccatctttcttgttccatcagcaagtggattcacaatgcaaccaagtcctagtccttacctttcctggttccattctccaacagaggaatttcaaggatacagaatctatgacatactttgaagacaaaggcattttaaactctaattaactcataatttgccttgagctgcttttttttgagacgaagtctcactcttgtccccaggctggagtgtgatggcgcagtcttggctcactgcaacctccgcctcccgggttcaagcaattctcctgcctcagcctcctgagtagctgagattacaggtgccaaccaccacgcccagctaatttttgtatttttagtagcaatggggtttcaccatgttagccaagctggtctcgaattcctgacctcaagtgatctgcccacctcggcctcccaaagtgctgggattacaggtatgagccatcgcgctcggcctgccttgagctgtttttttaaatactggtaagactttcacatctcagaacacatcattttatcaaattccaaacccaaccgctcttcatcacctccacgactaccacactaacccaggcccacagcacatcccctgcagagtctggccacactcctcatcagtctgcctgcttccactctgactggcagcagtctaactttcttttttttcaacttgagagcagctactgtttatttaaactgatcagactagaaaaataattgtggtaaacacctcggttcattcttctaagaagcctgtggatctggtcctccctgttgccagcatctccaccttctacaaaatgggtggtttttcttcattctatcttgtggagaaaataatttgaagggccacaggaagttatttgcttctttaaagcgttttccaacagtatagatgtcatgaatcagatcctccatgcagatgatgccatatttaccaagagatagagcaatcaaagcgttatctgtcaaagcaatttgtttattcatcttgccataaccacgcttgtagattagttcatttactgacttcagatttgggttcccccatgtaatatatggctctacaatcctcagcatgttaactgaagccttgttgagcttcacaaaggttccactgaagatttgataaaggcgaagaagctgcaacacctttcagacctctgggctcacaccattggcacctctggtcctgatgacaaaggccaatttgggttctgcaggtacacagaagttgccagcttttcttgccatccttgccattcgaatttcagttctgtacatctgcctatattccttgtgatagcactatgctttttcataaataagctccctccttgcctttcaaagcatgttttgggcaaacttctttctcaggagcttgatcttcagctctgtgaaattcctttgctttttcttaagggtttctggcacaacaggaaccttcttcttctcttcaacaccctccatggttccagctggtaaagatcgcagtctaactttcacacagcagccaaagtgatctttataagacagagatcagattctgtcacacacacctgatgaaaaccttccagtggcattatacttggaatgaaagccagaggtcttagcatggtccacagggaactttatggcctggctcctgcccctctttcctggtatcacctcctactgttctcccagagtttttccactgttccttgaccaaaccagcaggcttccacctcgggatttttgcacctgatgttccctctgcctggaaggctctattcctatacctccgcatggctccctagcctgttcaaggccttgtccaaatgtcacctcttcagagaagccatccctaaataacctacttaaaatggtaccatccgtacaccctgtcagtgtctctctctttgtctgagtatcatggttgcctcattttataatttgtttaatctgagtcagaactgaagcatttatttccctataaaatgaaatctgggcagaacaaatgctattttatagaccactcattttgaagttaaacacaatatataaacaaacatacacacctttaaaaaaaacagtgctttggccaggcacagtggctcacacctgtaatcccagcactttgggggaggccaaggcaggcggatcacctgaggtcaggagttccagaccaccctggccaacatggtgaaacctcgtctctactaaaattacaaaaattagccaggcgtcgtggtgggtgcctgtaatcccagctacttgggaggctgaggcaggagaatggcttgaatactggtagcagaggttgcagtgagccgagatcatgaccctgcacttcagccagggcaacagaggaagactctgcctcaaaaaaaaaaaaaaaaaaatgtgctttggtgtatggttttcctttatcgttcttaatttaaaagtattaccagcctgggcaacatggcaaaaccccatctctacaaaaaatacaaaaattagccaggcatagtggcgcacacctgtagtcccagctacttcggaagctggggtgggaggacggcttgagcccgggaggtcaaggctgcagttagccatgatggtgccactgcactccagcctgggtgacagagtaagaccctgtctcaaaaaaataaaagcattaaaaagaagtgctgtatgtacaagaagtttatggttgtagtactagatagagtacaaaaaagaaaaatggaaataagccaagtgcccaataataggaaaatacttaaggaatatacatgtgaaaaaaacataatacaaccatgttatgttaatgtgttataataacatcataacgttataataatatagtaatttttaatatatgttaataatgactacatagaagcacaaaggtgtttatcaaggagtttttttttttttttttttgagacggagtcttcctcttgttgcccaggctggagcgcagtggcgcgatctcggctcactgcaaccacctcctcccaagttcaagcgattctcctgccttagcctcctcagcagctgggattacagatgtgtgccaccacacccagctaatttctgtatttttagtagagatgggatttcaccatgttggccaggctggtctcgaactcctgacctcattatctacctgcctcggcctcccaaagtgctgggattacaggcgtgagccactgcgcccagccagtgtttttttttttttttaagaagctgtaatgatagtaacaaagaagtccaacctttatattgcacaaatatttactaaccatgtagcatctatgtgcctgaccagccctgacagatgaggattcaggagcaaacaagactcgtccctgtgctttcagagcacacagggtagcaaagccactgacaagtacaggtgggattacagtgaggcataagagatggctcgggggagtacaggggccaggcagagcaccctgggcacagccctgaggctttccaaatgaaatgatcccaaaactcagacctgaagaataaacaggagctaagaagcaaaggagggggagataaacaggtatgaatcagtgggtgctcagggtgagaggcaagagaagacatgaaacagaatatgtgaactattattttttaaaaaactaaagtaacttctatatttgatggtagaatttttggtaaaatttatcttgtataaaatatgatactaggctgggcacagtggctcacacctgtaatcccagcatttggggaagccgatgggggagggttgcttgatcccaggagttcgaaaccagcctgggcaacacagcaagacctcctctctaccaaaaaaaaaaaaaaaaaaaatatatatatatatatatatatatgagagatactaaatgaaagccaaatactttaccaaccactctggcttctcaaagcttatctgtcctgtggctactacctctctttccttcagcctaacctactatctgaccaaacacgagcagtggcaggaagcaattttaacacgtcacacagatgcacacataactctttatcaggactgaccaatacacttcccatccccacattacaaatttggggccaaaattactcagacagagatgtactctccagtctctggctgacgtgctaccttattacctcgccccaattcccttcaggtgccaacagacactccgtgcctagcattccaagcctgtcttctttggtctacctaacttatctggcactattcctccccacaaattctgtacttcaaccaggttctctttactgaacgctgcgcataccatatgcattcctgcctcaggccgacccctgcctggactgtcctaacctgctctcccagtctgctattcaaacagcacccattcttcgatggcccactcagcttttcaatggatctttggtcaacttatttaatccacaccaatctctaacctgaaactgaactaaatttgttatgctaaacagtaagtacttggttaaattccgcttttgttctagaaatctctaaatgttgtattcttgcaaggcttccctcctaaattctgaggccaaagatagtaacttttatttcttttgtatcccactaacagcaacattaaacttggaaaacacacctcccacacctgttggctagctgacagatcctggatggaaagatgagccagagagcattcagtgccagttgcttttctctggaactgcgggttcaagcaccaagattaggactagacttatgtgctcctttgggacaggaaatggcatatgtactgaaacgcgagatagttaaaggacacccccccaaaaaaaattaaacatgaggaaaaacatgtgttcctaatgtgggcaaaccccaccatattacaagtctccccagtaccttctatactatgtagctaataatacaaataaataataaatctaatctatttgataaatgaatagatttaataccactaagagaaatatgaaggtaataggtataaccaacagcctagagtttaataaagctccaaggtaatccctgtatcaatttataagatgctaatgaattatttttacagtttttcaaatccttcatatagaaataaactaagccattttctaggaagaaaaaaggtcaggctttacttacagagtcttgctcttgttatccaggctgcagtgtagtagcacgatctcagatcactgcaatctccacctcccaggttcaagcaattctcgtacctcggcctcccgagtagctgggattataggcatgcgccaccatgcccaaataatttttttgtatttttagtagagatgggttttggccatgttggccaggctggtctcaaattactgacctcaagtgatccacccacctcagcctcccaaaatgctgggattacaggcatgagccaccgcacccggcccaggctttacttctttagggagacagggtggtaggggtttcataatgaactgaaaaaccaaacactgtgtccctttcatttggcaagaactccttttccaaagaagggactcagaaaaaatgaaattacttatataacgtctgagaaatattcttaaaagacaacaaaacatacagaaaggtattttggattcaggagaatacaacctcttccaaaaagagatttactctctactccctaggaactactaatgacatggaaaatcccactcaagttacatgaggtcacacacccacaataaaggtagctgcctgaaggtggtctgccaagataaacaccaacttgttaactccctaagtgctatgcaaatgcccaagatagtatatgcacacttaatgactctctacattgttggagcatcatgtttctactattactacagttctttcagtctgtattttagtggggtttttttcatatctgttccccacttttcatcatgacctccaggagggtagggacacatcttactcatctttatatccccaatgcctagcattatatcttgcaagagacactaaaaaaataaaattctgccaaatgaatgggcaagcccaaaatatcactcagataatcccttattaacagccaaatgcccaggggaagggagacttagatgacagcaccttcctagaaaatatggcctgaaattacagatcatttctacaacaagttacatttcacttactaagcaactggtctatcttttcagaataaattttacttttcatgatcagtgtaagtatacgggaagcatgattattctgaaatctcttcttttcaaactaaacacatagctcctggacacccacaggaatcatacgagaagagggagaggcagtagacattagtttcaaacctataactctttaagagtcaaacaaaagtagaaaatactaagaaaagaaaacttgtcagaaaccatttaaagacaaaggacaccatcatctcccagaatttatcatcaacagaacaggtgaagcttaacaaagataaattaggccgggcatgatagttcacacctgtaatcctaatactttggaaggccaaggtgggaggatcgcttgagcccaggaggtcaaggctgcagtgaactataattgcaccactccagcctgggcaacaaagcaagaccctgtctcaaaagaaggaaaaaaaaaaagaaaacaaaacaaaaagacaaagtataagagcgccttcttcacttaatgaagcccaagttataaattcttataacccattaagtttataattgaaagagtatcaagcatatagctttatctatgcacataaaaacaaacataagttcagtaattcataccagaaaccaggtaatcacaagtccaacagtttaccttatctttgaaatacactatgtagttggctaatttcacagtaatcaattcttacgggatcctcttataatagccactcaaggagaaaatttcaaatactgacctctaattcaatgtaatacaaataagaggtcttccatccagaattatatcaaatggccacaattcctttctcagtaacaccataaacaggctgaagctctccacaaatcttctctgtaagtggatcccacggtggttgtgacccggtgctgagcgcacatacagttactcctagacaatcacctcctaaaagaagacagatgactatcactgtgactaaatgaaacaacttcaaaaatgcagctctgccaactagtttcattagcattttccaaacaaaacaggtgtcacagacaagctcaaaatagtcaaactcctctctctttggtgctttagcaacattcaattccctaacacctcccccagatgctggattctttttaacagtgtcttacatcgggtatgtttctcaatattaggaaggtttaaagaagctgtgaggatcggatagcggaacataaagaagcaggaaggccgggtgcagtggctcacgcttgtaatcccagcactttgggaggccgaggtgggcggatcacttgaggtcaggagttcgagaccagcctggccaacacggtgaaaccccgtttctactacaaatacaaaaattagctgggcatggtggcgggcgcctgtaatctcagctactttggaggccgaggcaggagaattgctagaacccaggaggcagaggttgcagtgagctgagatcgcgccactgcactccagcctgggagacagaatgagactccatctccaaaaaaaaaaaaaaaaaaaagaaagaaagaaagaaagaaggctctattttgatactgggagcctaaactgaatgattctggagaaattcacagatggggctgaggctcaccttcatgacagctgtatcaaaggcctaaatttctaaggctcagaaatcactacaataagcctatcaacagcatgtgatactctccaagcattttgcaaccttaacatttccatcctttacagtactttgatatcctcaaaagatgtcttggatttcaaagccagtcccacaacaacaaggctggcaatcagcatcccagaaaactgcaaagaggttaagacccaagcaaaatggacttggggatgcaaggaatttgtcagcacctgtattctcctaagaagtggtaaaaatatggccgcttcctacaggaagaaactatgccaaataaccaaaccaaaagtgagaaaacctaaattatattaacttctcatgagaagaggcacttaaccagataactctgagtcaggaccgttcagagggcggaaagaaaggacccatattaactgttctaattacaagttactctttgactcttcagatcttatttccttgatgattagactggaataaacaatttgagggcaggtactataacacctgtcatcccagcactttgggaggccaagacaggtggatcacttgaggccaggagtccagaccagcctggccaacatggcaaaacctcatctctactaaaaatacaaaaaaattagccaaatgtggtggctcatgcctgtagtcccacctactcaggagaggctgaggcacgagaatcgcttgaacccagggggtggaggttgcagtgagccaagatcgtaccactgcactccagcctgggtgacaaagcaagactgtctcaaaaaaaaaaaaattttttttttttgagagagaaaaaaatggcctctgaaggctgggcgcggtggctcatgcctgtaatcccagcactttgggaggccgaggtgggcagatcatgaggtcaggagatggagaacatcctggctaacacatggtgaaactccgtctctactaaaaatacaaaagtaaagtcccagctactccggaggctgaggcaggagaatggcagagcttgtagtgagccgagatcgtgccactgcactccagcctgggcaacagagcgagactccgtctcaaaaaaaaaaaaaaaaaaaaaaaagcctctgaaatcatttcaggaactaaaagctaactctggctctctctacatctttatattaaagggtcctggacctgtgattgttgaggtggcagggaaaactgctacctgttcccattcctaatagaaaccatcttttgatgccattcccattgtatttttccacaaaaaatgtatttacagatttctgggactgaaaaattgctgaatttgttaaaagagaagaaaaaggtggcccagcaagatggctcatgcctgtaatccctgcactttgggaggccaaggtgggtggattgcataagcccaaaaattcgaaaccagcctgggcaacacggcaaaaccccatctttacaaaacaaaacaaaacaaataaaaaaaaaactggccaggtgtggtgacatgcacttgtagtcctagctactgccagaaggtggggagggaggggtggctgaggtgagaggatggctgtcacccaggttggagtgcagtggtgccatcatgtcacactgcagcctcaacttcccaggctcaggtgatcatcccatctcagcctcccaagtagccagaaccataagaatgcaccatcacgcccagctaatattttttattatttttgtaaagacagggtctccctatgttacccagactgtcttttattccccgcaagacggagtcttgctctgtcgctcaggctggagtgcagtggtgcaatcttggctcactgtaacctctgcctcccgggtttaggtgattcttgtctcagcctcccaagtagctgggattacaggtgcctgccaccatgccagggtaatttttgtatttttagtagagatggggtttcatcatgttggccaggctggtctcgaactcctgactttgtgacctgcccgcctcggcctcccaaagtgctgggattacaggtgtaagccaccgcccccggccccccacttttttttttctttttaggagacaaagttttctacgttgcccaggctggcctcaaattcctgggccaaagcaatcctccagcctctgccttccaagtagctggaactatagacatgccacatatccagcatgcatttttatattttcaaggtatttccatatctatttgttcatttcagtttatgtactactgtccctatttgacagctaaggaagtagggcacataatcatacttcaagcccatagttcaggtggaaatggactctaggtcttctcatgccaaccaggagtcatggcttatttttcttatgcacagaggctatcacagttcaggacattttagtgaagccagaagaaacaggaattacatggccgggcacagtggctcacgcctgtaatcccagcactttgggaggccaaggccggcagatcatctgaggtcaggagttcgagaccagcctgaccaacatggagaaactccgtctctaccaaaaatacaaaattagctgggcgtggtggcacatgcctgtaatcccaactactcaggaggctgaggcaggagaatcgcttgaacctaggagacagaggttgtggtgagccgcgattgcaccattacactccagcctgggcaacaagaacgaaactccgtctcaaaaaaaaaaaaaaaacaaaacaaaacaggaattatgtagcatatataaattatgttttaaactactatcatataacctagtagttctctccaatgtaatcaacatatcccttagtaaaatattgtttctagagttataaatagtattctgccataggccacccagatctcagatctcatcttgattcaaatgggcactacacaagaatacatggggtgtttaatttatattcattttgttatttttcaggacagtgcctctaagccaggaaatagccttcaagtagaagtggaaacatccacaggctaagttaaatgctatattcaagccactcaatgttcacagtcttattctaagtaatcaggccactgacccaagtgtcagtcagcatcatcttcaatctccctatgaaaagctgaaggaaaagaaaatctaattaaaagcccaagaaaaaatccactttaatcaaaactgcaactaaaaggcaaaggaactttaaggtaggaaaaaaacttaagacatgaaaaaattaggaattacaaaaagggatgtcaagagggaaaaagaggagatactgcgattttttttttagaatagtcaaatacagcagtgagaagagggaaagagtagaataaggagtttgatctgtaaccatcaattaagattaaatcactaacttcagcctgatactgtaatttaaatgactaaaagcaagccaatgaaaaatatgactttccaaacagaagaggcataaaactatagaaaaataatgaaatacgaagggttaaaatacagagaaccacaattttaggaatattttactatgaagaacaggaaactgaatgtttaagtatatataaaagcaaaaggaaggaaacaatacatttagttccatcaaaatcaacagaaaaccatctactatgagcctccgttgacaacttctcccaagtgaaacaatacagatgagggtcacagacttagccagtgataggacctactactctgtaatcatccatgggcaacagacaagggctgtcagaggacccaacagacggaagccagtgctagaagacagaactagtttcctcaaaaaaaaaaatcagtcaaagccaggaacggtgtggctcatgctgtcatcccagcactttgggagcctgaggcaggaggatcacttgaggccaggagttcaagaccagcctgggcaacacagggagaccctagaaaaaaattaaaagttgttttaattgaaaacaaatcagtcaaacaaattactggtatgctttaaaaataactgtgtgacagaagaattacttgaacccaggaggcggaggctgcagtgagctaagatcacaccactgcacaccagcctaggtgacagagtaagactccgcctaaaaaaaaaaaaaatcagcatgaatcacaaaagaaagatacacgccagatcattattgttcttaaggtgaagcaatttagtcatcttagcgtaaacacacatatgctttagtagacatattaagaaatctctggaataaaaaatgaccagactaactagaaagcagttgaatcacccacctaaaaaaccgacttactaatttaaagcacttaccatattttaaaatcttttttaccttagaagcctttttcacttcaggttttatatttaaaacattttccaaaaaagtcagggtttgtgtcacctcttgcagttggaaatcagtttcaactgtaagttactttaaatccagtaccaaagcactgagattccaaagcagttgtcacattaactccatttcagaatccaagtacctgactgcagtctctagtaagagaagcctctaactggaaaagtaacaggaaaagttgtactttctcatttcaaatttggggcctactatgctgaatgaagaaagagagaacttcaagttcagcctaataggcatttactacaaataatatgacaatggttggcactcaattttaaaataaatgactaggccaggcgcagtggctcattcctgtaatcccaacactttggaaggccaaggtgggaggatcgattgaggccaggagtttgaaaccaacctgggaaacatagcaagaccccatttctataaaaaatttaaaacttaggccggatgcagtggctcacgcctgtaatcctagcactttgggaggccgagacaggtggatcacctgagatcaggagttagagacaagcctggccaacaaggcgaaacccggtctctactaaaaatagaaaaaaattagccaggcatggtggcgagcgcctgtaatcccagctacctgggaggctgaggcaagagaattgcttgaacctggctggggaacagaggttgcagtgagccaagatcccgcccctgcacaacagcctgagtgacagagcaagactccgtctcaaaaaaaaataaaaataaaaataaaaaattacccaggctttctgctgtaggcctgggtggctgctataaaaacgggcaagttcatgaaacctggaaagtggtgctgttctggccagacgctatgccagatgctactcaggaagcaaagatatcatcatgaagaacactgatgatggcacctcagatcgcccttacagccatgctctggtggctggatttgaccactatccccacaaactgacagctgttgtgggcaagaagaagatgaagaagagtcaaagatcaagtcttttttttctttttttttttgaggtggagtcttgctctgtcacccaggctggagggcagtggcgcaatctcggctcactgcaacctccacctcccgggttcaagcgatcctcctgcctcagcctcccaagtaactgggattacagacgtgcatcaccacacccagctaatttttgtatttttagtagacatggggtttcaccatcttggccaggctggtctcgaactcccaacctcaggtgatccacccgcctcagcctcccacagtgctaagattacaggcgtgagccactgtgcccggcctttttgtttttgtttttgttttgagacggagtttaacccattacccaggctggagtccaatggcagacctcggctcactgcaacctctgcctcccgggttcaagctattctcctgcctcagcctcctgagtagttaggattacaggaacccgccaccacgtccagctaattcttgtatttttagtaaagatgaggtttcaccatgttggccagactggtctcaaactcctgacctcaggtggtccacccgcctcggcctcccaaagtgctgggattacaggcatggaccaccgcgccccgccaaagatcaagtcttttgtgaaagtttataactactatcacctcatgcccataaggtgctccgtggatatccccttggagaaaactctcatcaacaaggatgtcttcagagaggctgctcttaaatgcaaggttactgagaggccagggtcaagttcaaagagaggtacaagacagtcaagaacaagtggttcttccagaagctgtggttttagatgtttcatttaggttattaaattttttaattaattaaattaaaatcaaaattagccaggcatggtgacatgcccctgtaatcgcagctactcaggaggaggcttaaacaggaggatcgcttgagcccaggaatttgaggatgcagtaagccaggcttgtccaatccgcagcccaggacaggtttgaatgaggcccaaaacaaattcgtaaactttcttaaaacattatgagtttttttgtgattttttttttttatttttagctcatcagctatcattagtgttaatgttttgttttggttttggtttttttgcttttttttaagatggagtctcgctctgtcacccaggctggagtgcagtggcgcaatttccgctcaccacaacctccatctcccaagttcaagcaatttctccctgcctcagcctcccaagtagttgggattacaggaacccaccaccacgtccagctaatttttgtatttttagtaaagatgaggtttcaccatgttggccagactggtctcgaactcctgacctcaggtgatctgcctgcctcggcctcccaaagtgctgagattacaggcgtgagccaccgcacctggccagtgttggtgtattttatgtgtggcccaagatatttcttcttctcccaatgtggcccagggaagccaaaagattggacacccctgcagtgagccatgatcacaccactgcactccagcatgggctacagagtgagactctacgtcaaaaaaaaaaaaaatacataaattaaatgactaaaatccagaaattgcagtctttaaagagtaaattttatagcatgtgaccaatctcaatgaagcttttattatttaaatgtgttttaaaaataaatgacactcagaacgaagtattccatataacataaaccacctgtctctatgactgagagaccacgaaagtatatcttaaaattctgatatatgaaaagatcatcaacttcattcatggtcaaagaaatgcaaattcaaatgatactgtaggagccaggcactgtggtacacacctgtagtcccagctactcaggaggatcacttgagcccaagagttaagaggctgcagtgagctatgattgcgccaccacactccagcctgagaaagagagattccgtctctaaaaaaactttgtaagggccagaagtggtggctcagacctgtaatcccagcactttgggaggccgaggcgtgtgatcacttgaggtcaggagtttgagaccagcttggccaacacagtgaaaccccatctctactaaaaatacaaaaattagctgggtgtggtggcacacgcctgtagtcccagctattcgagaggctgaggcaggagaaccacttgaatttgggagccgcaggttgcagtgagccgagattgcgccactgcactccacctgggtgatacagcaagactcagtctcaaaaaaattgtaaggccaggcatggtggctcacgcctgtaatcctagcactttgggaggctgaggtaggtggagtgcttgagtccaggagttcgagaccagcctgagcaacatggtaaaaccccgtttctacaaaaaatacacaaattagccaggtgtggtagtgcattcctgtagcctcagctactggagggggttgagatgggaagatcgcttgagcccaggaggttgaggctgcagtcggccctgatcgcgccactgcactccaacctggacggcaaaacaagaccctgtctcaaaaaaaattgttctttttttttttttgagacggagttttgctcttgttgcccaggctggaatgcaatggcacagtctcggatcaccggaacctccacctcccagattcaagtgattctcctgcctcagcctcctgagtagctaggattacaggcatgtgccaccacgtcaggctaattttgtaattttagtagagatggggtttctccatgttggtcaggctggtcttgaactcccaacctcaggtgatctgcccaccttggcctcccaaagtgctgggattacaggtgtgagccaccgcgcctggccaaaaaaaaaatgttcttaatgaaaagatatcattgtacacatttccacctatcagattaacaaagattataaaatttcataatatccagggatggtgagaaggaaatgaaaaccctaaaatattctgtgcatacacaggcatatctttgggggcaatttatttacagctttcaaaataaaaagtaaacataacccactgattcagcaactctacttaagagcttatcctatacacatacttgtacaatagtacaacagtacagatatgaggatgcgaaccaaagagtctgagacaatttaactgtccatcaatgggaaaagtgaagtttacatccatacagcgtccgattatgcagttgttttcaaaaacaaacctgagttataagtattgaattgaaaaatatgtttggaatttttttaaattcaagatactatctatagtatgcttatatatgcagagaaaatgtctggaggaatactgaattgtgtgaaagtgattacaatgagtatatattaattttataattataatttgtatttcatttgaacacatgaagctatcaaataaagtcatttaaccctggtgttaaatcagcctatgctatgatcccaacctatctttccagtgctctatggttctggccaaaccagtctgttccttctttgagaaaccagtcccaaggactccctctccaaaatgctcttactatgtggtctgaacagctacccgctacagcttcaaatacaaattacctgagttgaaaaaactacgcctgcctgcatctgctataaaacattttaaaagagatcttttttaaaaagaaaattgaaacacaatttaataatccccatcatagaagcagcaaaagtactcaccatttcccaagttttccaggctctgtgcctttgcttcatgcaatttcctgcctcaaatcctcttagctacttatcacatgtccaaatcctgccaatccttcaaaacacaggtgacacaccaactcctacaccaaatcttccctaatgcccccatccagagctgattctctttcttaaaccacagtatcaacaccttttgaggcactttcttctacctagtactcagttgtgtacatgtctcatctttcccattaatgagaaaatcatcatgggcacaatctctgtcttggtcattttgtatgccctattttgctacattaattaaacttgtatttcactaaagcatataataaaaagaaaggggcaagaatctaaaagttaaaaaaaaacaggcttttagtatgcattcatttgaattaggtcttgtttacctgcaacaaacgctatgtaagaaaagtacgaaaggtaagatccttccctctccatccagctgcccagggccctggtatgcctcctgaaaaggcaataactatgggttctaagaagtccttggacactgcaacttcttaacacattcaggacattggaactaagttgacaaaaagaatttataagttatattttaaaataaatttatttatgacaattacacaattgcacagtttacatgctgaggcaaaatatgacgttcaatacatgggaagataaactgtataaaactatctgagctgtgaaaagaagtcactgttcggccaggtgcaatgacttaacgcctgtaatcccagcactctgagaggccgaggcgggaggatcacgagatcaagaccatcctggccaacatggtggaaccccatctctactaaaaatacaaaaatcagctgggcatggtggcacatgcctgtaaggtcccagctactcgggaggctgaggcaggagaatcgcttgaacccgggaggtgaaggttgcagtgagccaagattgtgccactgcactccagcctggggacagagtgagactctgtctcaaaaataaaaataaaaaaaaagaagtcactgttcattatcgaccatcacagaataaatattccaaggctacatataatcccaagttactaaagttttgaaggggaaggttggtctggttttctgtttttttgagacagagtctcactctgttgcccagactgaagtgcaatgcagccttgacctcccaagctaaatcaattctcccccctcagcatcgcgagtagctgagactacaggtgcacaccaccatgcctggttttttgttttttttttttagagactgggttttgccatgttgtccaggctggtctcaaactcttgggctcaagtgatctgcctgcctcagccccacaaagtgctgggattacaggcatgtgccactgtgcccagccaactaaagtttctgtagcgtcaaaagtgtttaaggattccacaaagactaaattctcactaagctatgcaaacaaaggtgctaaaccattccaaccaaaatatgaaagaaacatgtagatgttttataaagctagatttcctaagaaatattaatattaatgaaaacttttctcaatatattaatagaaacaagatgtctgcacatttttccagtttatagatgttaaaaattaagtctcaacaaggtctttaatcatatgtgtataatcctaagtgtataacaacttaggaaatttcagtaattattcctacaataatgaatcacataaaatatatatatgtacacatggcagattatgctaccaagatcagaatgttcaaatcagaaggcagttcatcttgttagaaaatttacccagcaataaaaatctgaagccatcgttagatcaagacaaatttcagtgaaaattctatactggatactgaactggaggtggggggttattcttacaaataatactgaaggattacaataatactgtcaaattatcaaatgtgttaatactacattagccattctactggtatttatggcacaaactgccagatgtagtgcaatactgattcttcccttcctccagagtaagagaacccctgatttttgactaggcacatagtaatttccagcacagaatatactttctagcttctcttgcagttatgtgtgaccttgtgattccgttataatcgaagggacacagcagaagcgatatgtacaatttctggaaagtatcttcacaagaagggagtgtgcccagcttttgccttttcctccttcctgctggtgagaatgcagaactgatgtgagaaagtggagaagccacctctgacaaaaaggaaagagttacatgttgaaggctgggtcccctaatgagcatgaaggtagcatactggttcaggactgtctatgagatacatgaaagaaaggaaacttctatcttgtttaagccattgttatttttggtttctaccactcactgctgaatctaatcctatctaacacacggcaaaattatagagaaagagtactatatttattaaactttactttttcaaatgattttttttgttttgttttgtttttggttttttttttttttttttttgagacagagtcttgctctgtcacccaggctggagtgcagtggcgtgatttcggctcaccgcaacctcggcctcccaggttcaagcgattgtcccggatcccgagtagctaggattacagatgcccgccaccatacccagctattaaataattttgaatacatagtttaaacttactaggattaaaataaactcattttggggggccaggcgcaacagctcacatctctaatcccagcactttaggaatccgaggtgggcggattgtctgaggtcaagagttccagaacaacctagccaatatggtgaaaccccatctctactaaaaatacaaaaattaagccaggtgcagtggctctcgcctataatcccagcactttgggaggctgaggcaggtggatcacttgaggtgaggagttccagaccagcctggtcaacatggtgaaacctcacctctactaaaaatacaaaaattagccaggcatggtggcaggcgcctgtagtcccagctacttgagaggctgaggcaggagaatcacttgaatcccggaggcggaggttgcagtgagcagagattgcaccactgcgctctaccctgggcgataagagtgagaatccgtctcaaaaaaaaaaaaaaaacaaaaacaaaaattagtcaggcatggtggtgtgtgcctgtagtcccagctactcagaaggctgaggcaggagaattgctcgaatctgggaggcaaaagttgcagtgagccaagatcgcgcggttgcactccagcttgggcaacaggagcgagactccatcacaaaacaaaacaaccttcttttttttttttttttttttttttgagacggaatttcacacttgttttccaggctggagtgcaatggcgcgatttcagctcactgcaacctctgcctcccgggttcaagagattctcctgtctcagcctcccaagtagctgagattacaggcattcgccaccatgcccagctaatttttgtacttttagtagaaatggggtttcaccatgttggccaggctggtctcaaacttctgacctcaggcaatccgcccgtgttggcctcccaaagtgctgggattacaggcatgagccactgcacccggccaacaaacttatttttgattattcaaataactaagctctaaaatgttttttctacactatatttgaggtataaaattgttattatcaataattttttggccaggcacggtggctcacacctataatcccccagcactttgggaggcagaggtgggcagatcaccggaggtcaggagttcaagacctgcctggacaacatggcaaaacccatctctactaaaaatacaaaatttagccaggtgtggtggtgatcgcctgtaaccccagctccttgggaggctgagacagcagaattgcttcagcccaggaggcggaggttgcagtgagctgagatcgtccagcttggtgacagagggagactccatctcaaaaaataataataataataataacttcctaagtatgccttggggtcaagcgattaagccaaatctcccttatctctacctcaataataccatacgttaatattattcattcatttaacaaatgaatgcctactgtactcttcgcaagcaaggtgcactgaagtgaccaaagcagatgatgggcctcttcctccgggagtttgcaagccagtatcaatgcagccgaggcagtagaagcctctgcttccctcttctctagcctccaagttcatcactcccctgctgtcatcatattcttgcttcaggctacaatatgagagtacaatgtgactagacttcagctttgctctgctaatataatcacacataatcatattcctcaaagatgacactcctgttaccaaaattagcatcagcatcttaccaaaatgccatagcagttatcactgatggtgggtcagttttccacatggcaaatcttatttatcacaagatatctttccctaactgtaccttatggggttctcttatccttacattttgttgttgttgagacagggtctcactctgtctcccaggctggaaagcaatggcacaatattggctcactgcagccttgacctcctaggctcaaacaatcctcccgcctcagccttctgagtagcttgggctacaggcacgtgctaccacgcctggctaatttttaattttttttgcagagacgggggtcttgttacgttgcccaggctggtctcaaactcctggtctcaagggagcctcctgcctcgacctcccaaagcactaggattacagttgtgagccaccacatccagctttatccttaaatttgaaaaatactttgcagttccgccgccccccacccagtcccagggactatactgaaaaatgtcagaatgtagggctgcttaggcagatagccaaatatttttagttactcctcacaggccattacatcaacctcattagagatttgaagccagaccaacaagaggtcttgctctttccctcaattgcctttcttcttgaatctctctaagaggatggaacactaatcggattgggtcaagagtccacagtactgattgaaccctgtgtacaactatgaagatcaatgaagattaaaagttacacaaatcttgattcaagtgcaagatagaaaaaaaagtcacatacatgtaagagtttgtgttcttgttcttggtcatttcactcttacacactctaaaagactaattgttggggtcttctgcaaagccatcaaccaaagagtagtaagacagtgaaatttaggaggatgagagagcccttgactagtcctggagcttaagtaatatgatgtcaccctgtttactacacaaatttacattggtattttggccaaaagcccaaattaataataaagtaatacttctaatttcctacttgccattgttctacttatataaatctccttcagaggccaggcgtggtgggtcatacctgtagtaacagcactttgggaggccgaggtgggagaatcacttggaccctcaagatcgaggctgcaatgagccgtgatcatgcaccactgcactctagaacctgggcaacagagcaagaccttgtctcaaaaaaaaaaaaaaaaaaaaaaacctccttcaggaagctaagccatgatattctgatcatttattaacaccccaaacttcaaactgtactattactctattcacttggtatttaatcacatattgtttttagcatttcctatattcaaggaatagcaaacattttagaattggtacctcaaagagaatctattcaaaccatctagagttcacccattgtctcctgcagatctcctgattattataaacaacaaagagaacatactggaaagctagatctctagatgacaataacagtaataataaaaagaggctgatatttattgaccatttactatgtgccagggacctttttaaatactttatatgaattaattactttggtcctcacaacaaacccacgagtattattattatctcaattttacagatgaggaaactgagacccagaaaggtaaataacctgcccgaagtcacagagttaataagcagtgggctgcagattgagtctagagctcttaacaacttttctgcaatagcataatagttagttaacggtagacaaatactacagcttggtaagttctgaaacttagggccaaaaagatattcaaggaggcaaaagacaacacagatctgcatctccagagagagattttcaaaatttgaggctggaccaaattggtgtttaaacaaagtattgagggagggctgggtgcagtgactcacgcctgtaatcccagcactttgggaggccaaggcaggcggatcacgaagtcaggagattgagaccatcctggctaacatggtgaaaccctgtctccactaaaaaatacaaaaaattagtcaggcatggtggcaggcgcctgtagtcccagctactcaggaggctgaggcaggaaaatggtgtgaacccgggaggcagagcttgcagtgaactgagatcacaccactgcactccagcctgggcgacagagcgagactttgtcttaaaaaaaaaaaaaaaaaaaaaaagtactgagggagaggttaatggatagaatcatgaggaacatcaatatttaacataaactcagcacattttaggtcaaaatgataatacagtaaggtagtatttgtgtatattatagatatacaacatatattacaaaccaaaatacataatgattatccctactccataggaagtagaacataatttaactataattactataggtttatggtagcatctctgttggctgtagctaagatttttcatgctaagtccttaggcaggaatgcaacctataataatgttactacaagagacaataatctgctttaaaatctttcttcagacatgctttccagggaacagacagttgtgaaacgaaagtcagcctaaatagatggaccatatttcaatgactctaagactcataatgtttgttttacatttgtatagtatgccactggaattaggaaaggtctcacagaggttaactggcatttttttcattcttagcagtatacaaaataataattcattttacaaatgatggcatcttggagtcaataaaatgtttttcagaatacatctaattttaagtgtgaacacacatactgctgtagtcacaggaaaactttctgccttcaagagatgtataatctaataaagagaacataattatctctaaaatataaatggaagtaataaacattaatacaagacatgaagtgatcaaatgagtgagaaggttataacaagaactgaagaaaaggtatttaagtggtaggaaataaaagtggccaaaccaaaaaaacttcaggcactgtgtcctgagcacagtttgttgtttttgtttttgttgttgttgttgttgttgttgttgtttgagacagagtcttgctctgtcgcccaggctggagtgcagtggagcgatctcagctcactgcaacctccgcctcccgggttcaagcgattcttccacctcagccttccgagtactgggattacaggtacccgccatcgtgcccagcaaatgtatttttgtagagacaaagtttcaccatgtttgccaggctggtcttgaattcctgacctcaggtcacccatccgccttggcctcccaaagtgctgggattacaggcatgagccaccgcgcctggcctaaagttatttttaaataaaataaatccagacatagtggctcatgcctgtaatcccaacactttgggataccaaggtgggtagatcacttcagctgagaagttcaagaccagcctgggcaacatggcaaaactctgtctctataaaaaatacaaaaattagctaggtgtgatggtgcatgcctatggtcccagctactcaggtggctgaggcaggaggatcatttgagcccgagggggtcaaggctgcagtgagcagagattgcgccactgcactccaacctggatgacagagcaagacctttcctcaaaaaatttaaatttaaattaaaaaaaattaattttacaggtgcatctcaaactgtgttctattaaactagaatagtagtatctatcccatgagtatctcatgagaaagaaacaggtattctttggggtaagggaggaaaatgaaaaacaaaaaccctctatagtataaaatgtttctgaggctttaaagagctcatgtgcattataaacgtatttcaccccacacttaaaatacttgcagcatattaggaagccataaatacagttcgggaaacactgacttgggtaggcaggtaggtagacaggtagtcagtaggcgggcagagtcacagaaaataaaaggagaataagacaaatgtaataaagtgataccacctaaaaaaaggatcataactgactacgagttatgactatgaagtctcttgaaggaaaataaggtgttagaataagctatcaaaatcaacaatagccgccaggcgcagtggctcacgcctagaatccacttgtgtggatatacttccccagcatagccaggtcctgccagagaacatttccagtgcctccccaggcagttcacacagacagacatatgcccacatgctcatctgctcacactccccctgaactgtattcaccccacacacactgagtgccttcatcactgtactcccttgcttcccaccccagaagcaggaagaaggtcaagaatcagacctttggctgggcatggtggctcacacctgtaatcctaggactttgggtggccaaggtaggaggatcacttgagcctaggacttcaagaccaacctgggcaacatgacaagacttgatttctacaaaaaaaaattagccaggtgtagtggtacacacctctagtcccagtcccagctactcgggaggccaaggagggaggataacttgagcccaggagttcaaggctgcagtgagctatgctcatgccactgcactccagcctgaacaacagagcgagaccctctctcaaaaaagaatcagacttctgggagcctagggaacatatacaggtgccaatgaatgtgtccgtgcatgctctgctaagtgtgtgcatggctgcgtgagctagaatgggtttttgtaggaggagctctgccctgctgctgcaggactgtctgaagatgctgcacagccatgcttcctcacaagctctcttttaaggttagtccaggccaaccacattaatattgtcccctttggggtggtatatttattgcaacacacagcctggacattcatatacagggccatggcactagggtaaggcgccacaaactcctcctgctgaggaggcaacaaggtatctggtcgctaaagctgggtgggacccatatccctgacagtattccagtatgtatgaggcactgcagacctggggtttttgttcttaggtgaggcctggctcgtacggcttaaatttctgttctacttttccccaacttgagatgactcggaagactttctgttccttgcaatgaaaaacagcctaaccaaagtccttaaaagtcatgtatataactactttaaaattaagataaaacccatggcttcgacttctgatgcaaatacccaagacaaatagggtatgaggattcctcaaataccgagtggtttatgaattagaggccacatcattttataactaaccatataaggaaaattttcacagttaaatatattgctcacacttgctgacatactggcaaattttaccagttaaaaatatgccgtgtgcagtggctcacgcctgtaatcccggccctttaggaagccaaggcaggtggatcacttgaggttaggagttcaagaccagcctggccaacatggtaaaaccctgtctcttctaaaaatacaaaaattagccaggtgtggtggcacatgtctgtaatcccagctactcgggagactgaggcaggaaaatcgcttgaacctgggaagcaaagttgcagtgagccgagatcgtgccatcgcactccagcctgggtgacagagcaagactccatctcgaaaaataataataataataattttacactggcacagaccactttaccaaaaaaagcatcttatattaactgtactctctgacctagttacctaatgtacagacacacagtacatcttatattacttggcacaccaacaagttagctatacaaatcacaattccaacccaaacttgaagctagtaaatatatttagtatttgaacttgagttgtgttcaaatgttcattaaattggcctatgcaatcttaacaatgttctaacacatatttaaaatgctcatttctcctccattatttaaaaaaaaaacacacacacacacaaactataactctgttagacaagaaaccaaacataagccaaaaggctcggcaaaatcacacttaaataggacaaggagagcttcaacttcagaataattatcaggataccaatcacacaaatatgattcaacaatcacttaaatatcattcaagaggaattcctggtagtaaaaaaagaaatcccgtaattaactagagcacagcattatcagaaactgattatgtaaaacaatagcttttctttcaggatgtgtgtatgtgtgtgtaacgaagttcacagctaggttacactaatgactcacttaaacatttgaattttctgctatcttaacctttaaatcgactgcaaaagtagctgccaaaagtagcttagtaggaaagcatactactctcaaaagaacttggtatgtccaacttattttactacttaaattttttttgatcactgatatttgaaactaatttttaagtaatgaatgcttactaaatccatgataatattcagcatatacaggtttttagaagggcacagattatattcttatatgtgtgtttttacagcacctggaacatttctgttcagtatctgttcagtattacacataattattgcaggacctgacagtgtttactatcctattttttcctttttttttttttttttttagacagagtctcgctgtgtcacccaggatggagtacagtggtgccaatctcagctccctgcaacctctgcctctgagttcaagcaattatcgtgcctcagccccccaagtagctgggattacagccacgcgccaaagtgccaggctaatttttgtatttttagtagagacgaggtttcaccatgttggccaggctggtctcgaactcctgacctcaagtggtccactcgccttggcctcccaaagtgctgggattacaggcgtgagccaccgcactaggccttactgtcctattttttaaaagctttttcgactgaccagtaaatcaaagttgaaaaggtaactggtacattttatttcttgatttggattacctttttgttgtgaattggttctcagttctagtttccttgtgacaaaacactgatggagaatatattgaactgaaatcccctgaatccattcccactgagaaaataatacatttgaactgttcacatttcattgtaaaagatacacaactttagagattactcttgaagttttgaaagtaaagtgaatcagaagtcacattcctagaagcagtcagtctggaacagatgtttatcctacacacccagtcccctttaccactgcaaacctctctaatagttcattacattagaacaactgagatgggccaggatttgtgaaaataaaaatcctttgagacatttattaagcagattatctctgaaactgcaccttagtttacaagcctttgggcaacaatttgaccctcttctatgataatttgtgtacacactcatttcacattttctctggcttccaattttaaattctttatctaatccatacaataagtcaccctatcagactttataagactactgaaaacaacactactgcaatgcaaggccactacatttgcaaaattgccgattttagtgagatttccctccttcaactcctcctctacccctctacctggtttaaatcccaagaaaaacctctgtccagtgctacaattttactttccatagagtaggtttatttgattttttattaatgatactaaaaacttttttaaaagactgctggtgtatatagtttccaatactgggaacagaaataaaccctctggtttaatatttcaagagaaattatctcataaaagatgagaaggtatcattcaaaggagtcctgggaagtcacaaagtgtaaatacttctggtaacagaacaaattaatgtcgaagcacaaccagtaacataataatgcctcaatgcaaccgtgcctgtcaaaggacatctgtattagcagctcggggaagtggcatttgcagaaaggcacaacaactgcgcttaaaagaaaatcattaagcctcagccattaatcccctcccccatcctcttcgtctggatctttccaaacaattaaccagtagaaggtgctattctgcaacccacatgtattcacaccaacctccatccttgggccacagctgggtttatcccaggtggactagcctattccctgtccagtattcaaaggagccccctaaacagaaaaccagatcttttcttataacccttatttacaaaaacaacattgacagctcaattgccagcaaacctgaccatcaaaccatcacaccactaaaaacatgcaaacatcatcttgctaaatattaacctcaatacaacctttataatattaatcaataaaatctatttctatctagaaagactctgctcacattcactactaagactcaagtgaacaaatcactgtccccaacaaaatcagggtcaatgagaaatacaaaagcaatgagagctgaacgtaaggccacaacatataaagagggattttatctttacatatacaaaaaagaaagagcagcagaaaccacggctgcaaaaggaataaagggaggcagagagaagagaagtctctgaacatgtttttgagtgtcctttagtttccaatgcactcttctgcctcacaaggttgcaaaaacggccaggcatgagatgggtggaagaaagctgtaacagaaaagcaccctcccttcccccatcttctctcttctctcccaaaaagagctgtgtttgtctgtgcaaacctagtcccaaatatgggagagagagaatgaatgtgtgtatggaagaacaatgagccctcagcttggtattgtgtgtgtgtgtatgtgtgtgtgtgtgtgtgtatatgtgtgtctgtctgcctctgcctcttttcccttcgacctcaacaacaacagggagagctggaagccagctttccacccatcccaggccatcaaaatcaaaactggttgataatttacagtagtattaactcagcaagcaaatccatggaacaaaatatcaacccaaagatgattttattattgtacagatccagcttctctcccctcccccaacagactgagactaaaaagaccagtgtacactagacaaaaaggtctctctttaaatggaaagcaattatgaaaactgtttcaaatcttagatgcatcaattcctgctatattaaaatgtctattttgtaattcaccaagttcaccctcttactagttatctttttttgcgtttaaaaattcgctgtgaagaaggctatttcacgattcatacaaaactactttctaaatgtaccttaaaaaagcaacagatactgaaacatttaaagcacccagtttctcaaggacccattttacttaaatcaatgtttgaagtctgtaatccagaaaaattgtaagcaaaccttggaaaagagacagaggaaaatgacaattcaacaatgaatcattctgttttcctttcaacaacttctcaagcaaccagtttcaaaggaagcctgcaacacttttcccccctcctagcagacacacatacacacgtgtatgtaaaactacgaatctttccatcatcttaaaaattagtaataaatagaagccaccctccttcagagagcagaactaaaacaggatagtaagaattctattctgctgcaagtgactttgggtttcataattttctaatcacatacagctgagaactagagattgggagcacaaagaggaaatcttcccccaatgagaaaatgatactttaataataaagtcctccccccagcaccccgaaatccacaaacattcaagaaatttacagtttcagtccttgacttccttcccttccagtttcagccaataatgtagtcacatgaaatagtttaacctcaaacaagtagaacaagagcatgaataagaggccaagagagagcaggggtcagaaggcacgcaggaacggtcacctggcccggacaggaccaaagaagtgccctgccctcgcccgactcccctcgacttcggcttcgaccccagccttttcttcctgcctccccccgggcgagtgactgctttcacggccgaccctctctgaccaccaggacgaggggccaaaaaagaaagcacacgacccggcgcgggcaagttggacacttaccttcccctaaagcgctacaccatcaatagtgaggtgttcgcggcccagctccggggaaagtggcggggatggggcgggaggccgcgcggaggctgcggggccgcggggcgcagggccgagaggggcggcccgcggggaggcgacgcggaggggctgagggggcttccctgccgtgacctttcctgcgacttgaacctaggctccctcctcctcggtcgggcagatctttcagaagcaggagcccaggatcatgtctggttttgttttccgagggcgagggggctccctgaggatgatggtgatttttttttttttttaatcctcaactaggagagaaaatgaggcagagacaatgtggggagcgagagaggggaaaaggacgggggaggaggcggggaccgaggcccagcggggcgagcgtctcggggtgtgcgggaggctgaggaggctccggagcgcggagggttgctcgcgagcgtct

SEQ ID NO: 2559 - DNA, 465237 bp, Homo sapiens; identical to SEQ ID NO: 2558

SEQ ID NO: 2560 - DNA, 148257 bp, Homo sapiens
tgttttgatgaataatacttggtggggcgagggggaaagagtaggggtggaggggtaggaggatttactcttccagcgagagctacgcgcatcccatcctccccctcccccctacccgggctccggcgtggaggcggggcgtggccggcctgctttgggaggggaggggcttcccttacagtgctgggctctgccaggacggctgtggggtcgccttacctcggggtatccactctgcagtcgaccagttcccgccaggagcaaagggtaggaaggagagcaggatctgctgtaggaacgcagctaccgcgccactatcacgaagaaacagcaggctcggggcacgagacgaactggagaccgcgctgcctagctgggtaacctgggaagcagagggtaataagtggcgccttaagacaaccctgtagcagcagcagtggcggccaaaggaggctgctcagggaacaagcggctgtagtagtctgtggggcgactggagtgaccgaagccaaggcagtttagtgcctctcgtgttcttattttttaacctctgactatgcaattctgaaacctcccccattcgggggaccagacagcctgatagacaccttccactctccttcctcccgccgtggtctcgagaacagaaggatctctccttaacgcctttcaccattaagaggaaagcgatggaggagctgagcgctgatgaggtgaggaggttgggggacaccttgagggattagttggcaactcgttagcgctttggacagggatggtattgcgccagtgctgtctggcctttgggcttggagaaggaacggagatgatattttccaagaataacgtgactccccgatagggtctctggttttgttctcctttattctgttgccttctttcttcattctgaactccatttgcttctttccgagtgttcttttagggtatgaacaagaggagagagcatcttgaggtgtttattcttttcttcagggtatgcgaacaagaagggcgagatttacatgaagttaaagtgtgtgtgtgtctgtgtcttcaggaatttaaagaacaattttggatggaatgagaatgtatggtgggtgaatatttttaaagaaagcatttgaaattccagatatgtgtggttattgcactgtataagcttgattaaacatatatttttgcttgaggggtggtttacagacagattctttgatatttaacaaaatatgtatcttctccacagtttagagaattccagttatattctggtacttaatagaccactaatgacttctggcattcttctgttacattctatcttttcctacttcttgaatctttcaaacttgtgttttgctgtagcagagactgaacgggaagcaagtggaagcaaatgactttctaaactctctcctgttctcatttcttaaaggagttatacagatctacttcttgatgttttaaagattgtttaataaattaggttgttgtaaaaaaaaaaacaaccaaaaagcagtggcaattagggtacaaggaatttcctatgattctactgccttttctcttcctttttgcaaattaggagcttccctttcaggacccctactggccataccctctttagcctacctccacatttcttcactggttcatcatgtaaacttccctacagtattaggaaagcagtcatccatcaagttgattgtactacaagacttccatgctccagttttagctacagagtacttagtgtgtttacttagggactgaaattctcctgggataggacacgcagtggtgtgttaagggtcaggtaggaaaggaagcaaatgattttgttgattgtgatacttggatacttggtttggaaaatcaggactgcccattcggcgttactttgtttttttcgaatacagcagaaatgtaatcttaagtgaagagaatattacacagtttctttcattcggtaggaaatctccttagaatcgctttattttatgtgggtttttttttgtttgtttgtttttttgagacggagtcttgctctgtcgcccaggctgcagtgcagtggcgcgatctcgtctcactgcaagctccgcctcccgggttcacaccattctcctgcctcagccccctgagtagctgggactacaggcgcccgctaccacgcccggctattttttgtatttttagtagagatggggtttcaccatgttggccaggatggtctccatctcttgacctcgtgatgcacccgcctcagcctcccaaagtgctgggattacaggcgtgagccaccgcgcctggcctgttttatgtggttttttaaaagtttctctacctcccccgtttttcattaatgttaattctagtgagtaatttctcttaaggcagagatactgtttttttttttttttttttttttttgaggcggagtctcgctctgtcgcccaggctggagtgcagtggcgctatctcagctcactgcaagctctgcctcccgggttcacgccattctcctgcctcagactccggagtagctgggactacaagcgcccgccaccactcccggctagttttttgtatttttttgtgtttttagtagagacggggtttcactgtgttagccaggatggtctcgatttcctgaccttgtgatctgcccgcctcggcctcccaaagtgctgggattacaggcgtgagccaccgtgaccggccagagatagtttttttatttttttttattttttatttattttattttattttttttgagacggagcctcgctctgttgcccaggctagagtgcagtggcgcgatctcagctcactgcaaagctccgcttcccgggttcacgccattctcctgcctcagcctcccgagtagctgggactacaggcgcccgccaccacgcccggctaattttttgtgtttttagtagagacggggtttcaccgtgttagcccaggatggtctcaatctcctgacctcgtgatccgcccgcctcggccttccaaagtgctgggattacaggtgtgagccaccgcgcccggccgaggtagttttttagtagtcctttactcctataaattactttttttttttttttttgatgatctgttaatagtccttggtttagaggcttttgcatacttgagttttcaccaaaaaattcttttcaaaccagtgaggcattacagaccagtgaagatattgtataatctaaaatgtgtctcttcactttcatcagtccttgaggaaggtgtaacttttttttgtgaccatatgaggaacacatgtaacctttgtggaagaaatagaataaacttttttcaaggtcaacagaatattaaaataaatgaaaaaaattaaattcactaatacaggatcaatgtaaaattatcttcaacaaattagttgtccagaacacaaagggctggttcaataactgttaattttactctcagcagaacctagaacaaataatattcgtttgtttttaatttaaaaaatcttttttttttttgtagagacgggggtcttgccatgtttcccaggatggtctcaaactcctgacctcaagcgatcctcccacttcagcctcccaaagtgggagccagacaaatagttattttgggaaaaatatctttgaagtttttctttttaattcaattaaaaatttttgaggttaggtaagcagttctcatgagacatttccaaagcttttgcctttgtattgttactctgtagttgaaaacttgtgtcagatatggtaggtgacattgatttgattacaaaataatacacttatattattgaaacttcaagcttatatttcagggttaaaacaggcaaggcggtgatcttttaatctaatttaggaaattaggtaaggcagagtttcatattttaacaaaatgaaaatgtatgattatacagtccgtgaaaaaggctggtataaccagactggtagctttaggaacttttaaattatgtgcactttttggtccctgtcatagatcacctagaattcttgtgctttttaaatttttttgtgagacagagtttcgctcttgttgcccaggctggagtgcaatggcgcgatcttggctcattgcaacctctgcctcccgggttcaagcgattttcctgcgtcagcctcccaagtagctggaattacaggcatgcgccaccatacccggctaattttgtatttttagtagcgacggggtttctccatgttggtcaggctggtcttgaactcctgacctcaggtgatctgcctgcctcggcctcccaaagtgctgggattacaggcatgagccactgtgcccggtagtcttgtgcttttaagtagagtactttaacttcactgttgtttgttatttatatagtgtattacagtgagttcattgccctatagttcactgcctataggttcattgcagaaccatgactaagttcattctcttcaggaacctacattccaaggcatcattatttacattatattaattctataatctactcatgtgttgtttttcgtatctcaaggtggtgctgtgagtaggtggtgtgtttatttttgagatagggtctggctctatcgcccagtctggaatgcaatggcatgatcttggctcactgcaacctctgcctcctgggctcaagtgatcctcccacctcagcctcccaagctgagactacaggctcatgccaccacacctggccaatttttgtatttttttctagagacagggtttcaccatgttgcccaggctggtctcaaactcctgggctcaagtgatccacccgccttggcctcccaaagtgctgagattacaggcatgagccaccatgcccagccaagtaggtgttttaaactgtttttcgacaatggtaatgagattgcataagtgatttttctctcctaactcttctttatgacctagttcatctgcaagatggttggctgggattccgggtgtggtcaagattttagaaagtgttggccgggcgcagtggcccacgcctgtaatcccagcgctttgggaggccgaggtgggtggatcacctgagttcgggagttcaagaccagcctgtccaacatggagaaaccccatctctactaaaaatacaaaattagctgggcgtggtggcacatgcctgtgatccgaggtactcaggaggctgaggcaggagaattgcttgaacccgggaggcggaggttgcagtgggccgagatcacaccactacactccagcctgggcaacaagagtgaaactccatctcaaaaaaaaaaaaaaaagatttagaaagtgttttaagtattcctttccaaatgcagaatatgtgaccttggactttttagcaaggttctgtaagtggaagaaaattgacattaaacaacagccttaggagcctcttctgtgccaggcacttgatagctgtttctcattagagaaaacattataatcaagcaggtactgttttcctaattttacaagtcaggaaactgggattcaggttaagtaacttgtccatagcgacctggcttagaagtgatggggttggaattcaaacccagtgctctggactcgaaagtcctctttattctactgctcaacaactgacataaattcaccacagcttttgtatcaacatcctacgtaacactgacccactctgttttgatatacatagtttttctgtagaagtgctgttttgcatgaatgcattcatgatgtgatcagggcttttggtactggtcctcccactcccaattttttttttaaatgcctgtcgcgttaaaaatttgggagttggggccgggcgcggtggctcacgcctgtaatcccagcacttcgggaggtcgaggcaggcggatcacgtgaaaccccgtctctactaaaaatacaaaaatttgctgggtgtgatggtacgcacctgtaatcccagctactcaggaggctgaagtaggagaattgcttaaactcaggagacagaggttgcagtgagccgagattgcgccactgtactctagcctgggaggcagagcaagactccatcaaaaaaacaaacaaacaaaaaaacacacacacagaaaaacaaacaaaaaagcaattataattaaatttgagtagaggagatagataggaatccaacagttatagaatagtgccaggtgctatggtggaggtatgcacaactcacttaagaaacatgagaagggaccccgggagaggcagggtcttagtgaagactttcaagaaaaagtgatacttaacgctgagtagcagttgccctgggaactggctcgaaattggggagctcaagaaacagcagcaagtagtgtgactggagaggtgggttttacctcgggtgtgtggcaggtacctgatcttggagggctgtcagaaacgtttaggagtttgaactttctttttgttgttgttttttgggacagaatctctctctgttgcccaggctggagtgaagtggcatgatctcggctcactgcagcctctggttcccgggttcaagtgattctcctgcctcagcctcccaagtagctgggattacaggtgcatgccaccatgccctgctgatttttttttttttttgtatttttagtaaagatggggttttaccatgttgactaggctggtttcaaactcctgacctcaagtggcccacctgcctctgcctgccaaagtgctgggattacaggcgtgagccactgcacgtggctgagtttgaactttctctgtaaaatgccttttagggattttaagagattagaaagatgggtggcaagggagtaaagggtagtttgggagaaggtggctgcagactgcaagacatattaggaggctgttgttgctgtataggagcgaggcagtggagtccaagggaactaaggcattgcctgtgggaatggaggggagcagacagacaccaaaaataccaaggactgtgattaacccagttttgatgatcagttagctgtgaaggaggggaggggaggagagatggagaaatgacaccttggtttctagctatggagaaggatagataagggttgaataaggaattccagagaagcagcagattttggagaaagcacatgtttctttttttttttttcgtcttttgagacagggtctccctctgtcgcccaggctggagtgcagtggcgcaacctcagctcactgcaacctctgccccctgggttcaagtgattctcctgcctcagccttccaagtagctgccagccatgcccagctaattttttaatttttagtagagacggtgtttcaccatattggccaggctggtcttgaactccagaccttggtgatccgcctgccatggcctcccaaagtgctgggattacaggtgtcagctaccacgccaggcctccggctaatttttgtatattttgtagagacagggtcttgccatgttgcccaggctggtctcaaactcctgggctcaagtgatctgcccacctcagcctcccagagtgctgagattgcaagtttaattttggaccaccaaaaagatgagtccacatgtagacccccactctggccttggtgctctaacatctccatttctttcttcttttttctttttttttttttgagatggagtttcgctcttgttgcccaggctggagtgcaatggcgcgatctcagctcgctgcaacctctgcctcccaggttcaagcgattctcctgcctcagcctcccgagtagctgggattacaagcatgtaccaccatgcctggctaatttttttgtatttttattagagacgggatttctccatgttggcttggcgggtctcaaactcttgaccttaggtgatctgcctgcctcagcctcccaaagtgctgggattaccggcgtgagccaccgcacccagcctaacatccccacctctttgaccatttcttcccttgtaacaggcctgaggacctgaggtcccttttttcctcagaagatagttgctaccattcactttataaccaggactctttcttaagcctgggaggacagtgggatgtatcctgccaggccctttcctctccttttgttcattgtagacaagagacagagaatgataataaggatataaacttgcttcacaaggttggcatccttatcccctgttttacagataagaaaatggaggctaatagaaattaatttattgaaaggcacacaactagtaagtggtagaacctggactctaatccaggttctgactccagagttttctatcgctttactacctctaaaacaagacttaacctcagccaactgtaacctttttggcattcttttttttttttttttttgatggagtttcgctctcgtcactcaggcttgagtgcaatggcctgatctcggctcactgcaacctctgcctcctgggttcaagcaattctcctgcctaagcctcccaagtagctttgattacaggctcccgccagcatgcccagctaatttttgtatttttagtagagatggggtttctccaagttggccaggctggtctcgaacttctgacctcaggcgatccccccgcctcggccttccaaagtgctgggattacaagcgtgaacgactgtgcccggccacatttatagcattcttacggtcccttctgagataggaagtggaagccccagtggactttttgtttgtttgtttgttttttaagacagagcctcgctgtgtccccatgctggagtgcagtggcacgatctctgctcactgcaacctccgcctcccgagttcaagtgattctcctgcctcagcctcccgagtagctggggttacaggcacatgccactactgcccggctaatttttgtatttttagtagaggggtttcaccatgttggccaggctggtctcaaactcctgacctcaaatgatccacccacctcagcctcccaaagttgtgggattacaggcatgatgctggagtgcagtggtgctatcttggctcactacaacctctgactcctgaattcaagcgattctcctgggtcagcccctcgagtatctgggattacaggcgcccgccgccaggcccagccctccagtggactttcattcccgtttgttattgctgagagtggagctcatcaagtagccccaagctcttgtagggaaagaaggcagaaagacttctctgtgcaaagtgcattttctcacacggcacttgtagtatctagtggaaatgtcttcctgtaaacggttcattcaacagcgcttacagttgactagctgcatccctgataacagacaaacgttgctgtatggagcttcgtcctagtgggaggagagggataaaaaacaagcatggccgggcgtggtggctcacgcctgtaatcccagcactttgggatgctgaggcgggtggatcacgaggtcaggagttcgagaccagcctgaccaacatggtgaaaccctgtctctactaaaaatacaaaaattagccgggcgtggtggtgcacgcctgtaatcctagcaactcaggaggctgaggcaggagaatagcttgaacccgggaggcaggggttacagtgagctgagattgcaccactgcactctagcctgggcgacagagtgagactgtgtctcaaaagcaaagaaacaaacaaacaaacatgttcacataaggtgtcatttgatgagaagtgctgtgaagagaaatacttagggatggagtattgttacagagtatttctgtggcctacaggtacagagaacaatcagatatgtgtaacgtgtgcactttgaggaggtggtcttgaaaagaatttcagggatggctgggagcttgctcggggaagaatgttcccaggtaaagggaacagcaggttcagaaggccttgaggtaaactcattcttgagctgttccaggaatagcaaggatgccaagcatggttagagccttctgtgcaaggggcacagtggcaggaggtaaagtcattcattctttttttttttttttaattttttgagacagagttttactctgtcactcaggctggactgcagtggctcaatgtcagctcactgcaacctccgcctcgggggttcaagcaattctcctgtctcagcttcccaagtagctgggattacaggcatgcaccaccatgcccggctaattttgtattcttagcacagttggagttttaccatgttgaccaggctggtcttgaactcctgacctcaggtgatctgccggcctcagcctcccaaagtgccgggattacaggtgtgagccaccgcacccggccaactttcagtaaaaacttactgagatctcaactgtttttcaatcatttctgagatgtactctcctcccccttgttttcatcacattttaatatctttgaaattgagatgctgcttttttttttttttttttttttgagatggagtctcactcttgtcacccaggctggagtgcagtggcgcgatctcggctcactgcaagctccgccacctgggttcacaccattttcctgcctcagcctcccaagtagctgggactacaggcgcccaccaccaagcctgactaattttttttgtatttttagtagagacggggtttcaccgtgttagccaggatggtctcgagctcctgacctcgtgatccacccgcctcagcctcccaaagtgctgggattacaggcgtgatccaacgcgctgggccgggatgcttcttataaatagatggtgtaatcaccgttggccaggtggcagttgtgacatagttgtcatttcctgtttaggtgtgaacctggttatacctgttcatgtaatcaccccttcagttgagtgctacagtgttaaaattagttgccattttaaatgccttccaaacaattacacttagattcagcaatgaaagcaagtgttactttgtatacagagaggaatggaaacaggaggtggggtgtccatttgctgtttctaaagaaaatgtttgttgttgggggagtgaccacaattccacgtttcttttcttttcttttttttttggagacagagtcttgctctgttactcacgctggagtgcagtggcaggatctcagctcactgcaacctccacctgccaggtgccaggttcaagcgattctcgtgtctcagcctcccgagtagctgggattataggtgtataggtgcgtgccaccatgcccggctaatttttgtatttttagcggagacggggttttactcttgttgtccaggctgatcttgaactcctgacctcaaatgatcggcttgcctcggcctcccaaagtgctaggattacaggtgggagccaccgcgcctggcccagttccatatttaattgccaaacaccaccaagtgaattagggcagtggtccccaacctttttggcaccagggactggtttcgtagaagacactttttccatgggtggtggtggtgggaggggaagggatggttttgagatgattcaagcatattacatttgttgtgctccttccttccttacccttccttccttactcttccttccttccttccttccctccctctctccttccctccttccaccgcccgcctgtctcgctttgtcacccaggctagagtacagtggcatgatctcagctcactgtaactccaccgcttgggctcaagcgatcctcccacctcagcctcctgagtacttgggaccataggcgcacgccatcatgcccggctaattttttgtatttttgatagagatagagttttactatgttggccaggctgttcttgaactcctgagctcaagcagtccacccacctcagcctctcaaagtgctgggattacaggcatgagccaccgcgcctggcctgtgccctttatttctattattattatattgtaatatagaatgaaataattttacaacccaccataatgtagaatcagtgggagccctgaccttgtttttctgtaagtagacggtccatctaggggtgatgggagaaagtgacagatcatcaggcattggattctcctaaggagggtgcaatgtagatccctcgcgtgcagaactcaatgtagggttcatgctcccattcgaatctaatgccactgctgatcttgcaggaggcggagctcaggtagtaatgcgagtgatggggagtggctgcaaatacagatggagcttcactccctcactcgcgtgcttgcttggtactggtctgtggcccaggggttggggacccccgcattagggagcttcagagaggccgaaatccataagtgtgtgaagccatgtcacattttgtaactgaacatacagttaggaggattgcatttcacactcaggcaatgcaaccttaggtcagagacactccacattcctcagaaagaaatttcagggctatgagagcctggtgtaactgatgacaactctgtccttgtctgttgttcaggcattttgttgtggtttaatgtgccatattttgtttctcttggtggtgaaaaataatggtacagtctacagtctgacatatttgatgaaatatggtctatgtccagcattgttctagaccatgagggtacacctgtggacaaaacagaaatctctgccctcctgggcattctggctgctgtgaagagaatagataaggaggaaagagcaaaagcagagagaaaggcggccatcgaaggagtcccagggagagatgatgtgggggccaccaactggggttagtggttgagagggggagaaagggtcaaacactagatggtcagatacattttgtgggtagagccaataggattgggtagtgagttgcatgtggagtatgaaagagtggagtccaaggtgcagggatgagttaggttatcatcgagttgattgttgtaacagagagacatgaagtggcagctgcttaagccagatagatgtttatttctctctaaatagaagtctgggtaggaggccggggctggtatggcagctctgcgctcattaggagcccaggtgccttctgtcttgtacctactttcctaccatatggcttccatcttttggcccttgtatgtctgcattctggccagagaggggaggggaggtcatgtgcctcttcatggcacagcttgaaagttgcacagatcactcctgtttacctctcactggctggaacccaagtcacatggccacagctacttgctgggaaggctgagaaatagtttttcttgggcagccatgtgttcagctatacgttctctcacatcagaaagggagagcagtctatgcctttctttccaaacccttctcccgagggagacaaccccggatcaacttcagagtccagaatccctgggtgatgtacattccaggaatctttagtttaaaacaaagttatcaggggctctgctgtcccccatacagtggtggagaggttaggataatggaagtagaaagtcctgtttggaaaagggaagaatggggagtaatactctgcgctggtccatagccattgtcagctcctgccaggctgagctgtgagcgcttcctcccctggcagtactgtgaggttctgacctcgcctttctggcaaccttgattctggtctcttgaaggagctcccttgtgcctggccctctgtagcctctgactttattttctggagagtttttctgtgtttcttttcctctggggtcagatctgaagtggacattggaggctatcctttttgtagggctaaacagtttctccagcttgcttcttgtggatattgaaggagtaggctttttcaaccctacttagccccaaattaccagactctgaaaactttgattgtagaccgcggacattcctcaggcagactgtattccctttcatctttgcatgcgaattggcaagctttggcttgagtctgcttcatgtttgcaggacttcttagccagtaagcaccaaattttgtattgttcgaccagttcccctagaattacaggccatgttggcatgcaggctgttttctaagatatcacgggttttgccaaatgttttattgtgatctctgagggttgccattcttccatcctacagtatctgtgcccatgctgacccctaagccaatgctgcatatttgtattgttaaggttgattacttccagcttccagattctgtgtattagttaggatattgatttgactgctgtggcagaggtcggaaataataatggcttgaacaagatgttgatttttttctatttcaagtgaaaatctgggtaggtggctgagagctggcttagtaactccatgcctgctagggggccagactcatgctgttttgtgcactgtcatcctctagcttataggccaggagggctgctccagcttctttgaggaaatctgcatcccagtccttaggaagggactcaagtgggaggagagggcatgttctatcccataagagcatggccagaaagcttcatatatctttttttttttttttttttttttgagatggagtctcactctttgcccaggctggagtgtagtggcgtgatctcggctcaccgcaagctccgcctcccaggttcacgccattctcctgcctcagcctcccgagtagctgggactgcaggtgcccgccaccacacctggctaattttttctatttttagtagagatggggtttcaccacgttagctaggatggtctcgatctcctgacctcatgacccacccgcctcggcctcccagagtgctgggattacaggcttgagccaccgcccttggcccatatgtcattacttacatctccttggctagagcttagtctcctggccacactcaaatgcaaacatggttgaatgcattttatttattttacttttttagagacaaggtattttttgtcacccaggctagagtacagtgcagcctctaactcctgggttcaagtgatccttctgccttagtctcctgagtaactgggaggtgtgtgccactgtgcccagctaatttttaaatttttattagagacgagggtctccctgtgttgcctaggctggtcttgaactcctgacttcaaacaatcctccttccttggcttcccaaggccctgggattataagcatgagccactgcatccgtcctgaatgcgttttgggaggcaactagcttttctaccacagggataccaggaattttggcttaagcagctcaaaaaatggaattgtcatttactgagatggggaaaattgaaagagaagattgggagggagacgttatcatctggtttgaacatattatgaatatgctgcctgttctttgtccatatggagatgtgaaataggttgtataggagtttgcagttcttgggggaggttggggttagggatactaatctggaagttgtcattgtatttaaaatcatgagaatggacagattttacctagagagtgagcataaatgcggaagacaagaggactgagcctccatccattccagcaattaaaggttgggagatcaggaggactcagaaaaggagactgataaggaacagccactgaggttggaggacagtctagagagcatggaatctggtgtccaggggaagaaagtatttcatgatgtgggggaatgctcaactgtgtctaatgttgataaaattagaggaggaccaagacgtgactatgggatttggcgacatggaggcccttggttaccttgacaagactgatttcattgctgactggagcaagttcaagagagaatgggaggagaggggagggagctcaggagtgaggcgtaggctccaggggtgcactgggaagccatctgtagttggcagaagccatgggttttagaggtgacaggaaaatgtggtgagcttatctttttctgttttaacttttcccattctctgctataatcactactttctttattcattcaacactctgtttctctctctttccccaagggaggaagtaaagaggtagagatatatttgtatatcattcctagcatgaggttttgggcctgaagagttccaaataataaattttgagacataatatggggaacattggatcatattatagtttttagagcttaaaaaaatagttgagtggcaaatatttcagagtaggagacttgaatattatttaatttgtttgcttaatttcaacaaatatttttgggctttgtgccaggtactgagggctgactatgtggagatgctgctcgaatatgacgaagacctggtctttaccttcagtgacctcaggctgcagctggggacacaggaacgcaaccagctagacttcaagtgctaaatagacatttcagtaaagggggtacggttgatggggcagttaattctgatggggaatgtagggaggggactgggaagatttgaattagtctttaaagatgactaggattttgacaattagaacactgtagccagacgcaatgatgcatgcctgcaatccctgctacttgggaggccaaggcaggaggatcacttgagcccaggagtttgagggcagcctgggcaatatcataagaccttttctctaaaaaaaaaaaaaatttttttaaattaggaaacaatgttggctgggcatagtgtctcatgcctgtaaccccagcaatttgggaggccaaggtgggcagatcacttgagtccaggagtttgagaccaacttggacaacatagggagaccccatatgtccaaaatggctgggtgtggtggcatgcacctgtggtcccagctactcgggaggctgagatgggagaatcacttgagcccggcaggtccagggtgcagtgagccatgatccatgtcactgccctctagtctgggcgagagagcaaaagaccctgtctcaaaaaaaaaaaaaaaaagttagaaaaataagtctgtggtgaagagaaatgtttcatttacttcttactctgggcaaattctgttacattcattcttttgaaattgatgatagaaatatgagaacattggagaaaaactgaagatggcaaatatgggatattggtagctgcttgctgatctgaaaggctggttttttttgagacagagtcttgctcttgtcacccaggctggagtgcagtggcgctcttggctcactgcaacctccacttctggggttcaagcaattctcctgcctcagcctcccgagtagctgggattacaggcatgcaccaccacacttggctaattttcgtatgtttagtagagaccaggttttgccatgttggtcaggctggtcttgaactcctgacctcaggtgatccgcctgccttggcctcccaaagtgttgggattacaggtgtgagccagtgtgcctggcctgatctgaaaggttttgagatatatcaggcatagccaaatgtgtgaccccaagctctccaaaaccactaagggtctgcagcagctgaaggagtaggtgatagggagaagttggaggaacgggaaaggggtttcattaaaatcacttctctcctaacattaaccacactgcattgaattatttattcacttggtgtagctcctactgggatatgaactcctggctattcttgtttactgctttttatccaagttctggcacagggcttggcacagagtggctcagaacaaatacttgttcaatgcatgaatgaatgcagtgatacaacatgtcttttcaggactcctattctttttttttttttttttatagaggtggagtttcactatgttgccatgttgcccaggctggtttccaactcctggcctcaagccatcttccctcctcggcctcccaaagtgttgagattataggcgtgagccaccacaaccggcctgcctcccaattctagtattgcaatagtttatttgtttgctgcattaagttgtgttaattaggttaaggtaggcacttgatgaaaaaagcctcattatcagagttctaattcagagtcagacatacttgcaggcttttttggttgtttgctttttgttttgagacaggacttgctctatggcccaggctggagtgcagtggcattatcatagctcactgcagcctcaaactcctgggctcagatgattttcccgcctcagcctcctgaatagctgggactacaggcatgccactgttcctggctcttacctggattttatttggagcaacaaattggatgattctggggaaagtacttaatctttctgagcctcagtttcctcacttataaaatgggggtatggaataccatctcgtagcactgttcttcagattaattggagtgatgtgaagtgtgcatggtgtagtgacctggccgagtggattcttgggacaagttagttctcaaagtaagattgaattgtgtataattggagttttagttggtgtccatataacatctaacaaatcttttgcatataataatgccaacagcataaatagtggtatcttactagttaaggtagcaaatagaccgtggcttatgtgaaaggttgggttggaatcctctcccccgacccattagttccaaaaatctcttctcacccaggggccatcttttgtattgagccacactgctaccactttttctaaaacgtggagtgattggtggcctgaatgtactaagagggtgaaggtggagtgtagagctttgaaagggaaagaagagtgtgcagaaaggggactcgaggagtcccaggagaaatgttctgcatatcaggactaaagaatacagcctgaggtgacacactttactcccatcagatgacttatttttgtcttctgaaagaattgtacccctcccagcagggggagaaaatctctgaattggatgtcattgtattaactactcaacagctgctaaatctttggcatcttgtccagttctttggcagcagtgtcaagactgggaaaagaggtatcttttgggtcctagattgagaagtgactttacctttctaattaaacatgacacattcaatgcatattgcttctttgttccctgtcagtgcttggtataaattctagatgtctaatagtgtcatttttttttttttttgagacggggtcttgctctgtcacccaggctggagtgtagtggtgccatcttggctcactgcaacctccgcctcctgggttcaagcaatccttccacctcagcctcccgagtagctgggactataggtgcatgccaccatacctggctgattttttaatttttttttttgtagagacagggtctcactatgttgcccaggctggtcttgaactcctgggctcaaatgatcctccggccttagcctcccaaaatgctgggattataggcatgagccactgggcctggtcagtggtgatttaattagttagattttctgactagatgaggtagcacactgctttaatggacgtttttgggaattgaacttctaagatgtccgggtagatcatattgagcacccatcgtgccaggcactcctcaggaatcatgtctgtgatcatggtcttttgttagacctgtgtctatacttgtcaccagggccagcttcacaggcatgtgactgcaggcagaggtgccccacgcttggtttaatgctctgctgttgctgtcttgaaattcttaatacatttgaacaaggtagcctgcatattcatttgtcatggggccctgaacattctgtagctggtcttggttgtcattgactttttctgtgtgggtggatatatgcctgggtagatgtcgtagttcatttggactattataacaaaatgccataaagtgggtggcttgtacacagcagcaatttgttattcaccgttctgcattctggaggctgagaagttccaagatcaaggtgctaagagatttagtttcttgagagccaacttcttggttcatagatacctgttttctcactgtgtcctcacttggaggaaggagcaaaggagccccctgggctttcttttataagggcattaatccgcaggtcatcaggggttccgccctcaggacctcatcacatcccaaaggccccatctcctaatttcatcagcgaccctcccacctcagcctcccgagtaactgggaccacaggtgtttacaaccgtgcatggcttttatttatttatttatttatttattttgagtcggagtctctctctgttgcccaggctggagtgcagtggcgcgatctcggctcgctgcaagctccacctcccaggttcacgccattctcctgcctcagcctcccaagtagctgggactacaggcatgcaccaccatgcccggctaatttttttgtatttttagtagagacggggtttcactgtggtagccagggtagtctcgatctcctgacctcgtgatccacccgcctcagcctcccaaagtcctgggattacaggcgtgagccactgcgcctggcctatttattttttatttaatttttttgagatggaattttgctcgtcgcccaggctggagtgcagtggcacaatcaagttctggggtatatgggctggatgtgtaagtttgttacataggtaagcgtgtaccgtggtggtttgctgcacctatcaacccatcacttagtaactgagtccagcatgcattagctatttttcttaatgctctccctacccgctgcatggctgattttgaaaactttttttttttgagacaaggtcttgctatgtcacccaggctagagtgcaggagtgcagtggcgtgatcacggctcacttgcagcctcgacctttcgggctcaagtgatcctcccacctcagccttctaagtatctgtgaccacaggtgttgccaccatgcctggctaattcttttattatttgtagacaaggcctcgctatgttgcccaggctggtcttgaattcctgggttcaagtgatcctcctgccttggcctcccaaagtgctgggattacaggtgtgaaccaccatgtccatctgatattgaatctttagataactcattttccttcatcaaatctttttttgttgttggggtagtaattagaaatattagattttttttaaaaaaaaagacaggatttttgacacataaacatttatttccatattctttttttaatttttatttttgtaagctattttatttcttccatgatgatttagagggactatcttcaaaccaatacaaatattttgtaagtaatatctggctgttttctaaccaattgagtaatttgttgcacagtaagccacctcacatctttcagcaagaaatacattaaatttgaatagtaaagacatggcataatgaattaggacacaattaaaatttgctttaaatagttctttgggcgaggggacaccacacttctactcaatgaagagaaacattttgacagttcagaggtcttttatttttttcacacctcttatgccatgaattcataggtaataggttccagcagctcaggcttcttcccattggttctcacacagtgtgcttctctggtacctttctctttggctttcttctttttctgatcattttccttcatgagttttaggaaatgatgctggcctttagagcgcttaatgtgctcaatatgcatattaattctcttggcaagactgttgccattgttcatttactacaatgccagcagcatgctgggtaacattgtagactcttccagtctagccatggtaacacttgcggggcattttttttggaacagtacccattcccttggtgtctgtaatattatctttctcctttttttttttttttttttgagatggagttttgctcttgttgcccaggctggagtgcagtggtgtaatcttggctcactgcaagctccacctcccgggttcaagcgattctcctgcctcagcctcccgagtagctgggattacaggcatgcaccaccatgcccagctaatttttgtatttttaatagagatggggtttctccatgttggtcaggctgggcttgaactccggacctcaggggatccacctgcctcggcctcccaaagtgctgagattacaggtgtgagccaccgcacccggcgtgtttttactttgaacagatgtccttgtgccaaaaggtttggtgatttctagtttagggaaacatgaataaagcatcttttggcttgaaatgttatgattagaatgggttgtgagtgggagaattttaatgaatgccaattggaacaaatgcttgtgaaaatgtctcgtaggccaccttttcatcattttttcttttcttttcttttcttttctttccttctttttcttttctttcctttctttattctgagacaagatctcactgtttcccaggctggagtgcactggcagcatcatagctcactgtagccttgaactcctgggctccggtgatcctcctgtcttagcctcctgagtagctaggactacaggcgtgtgctgccacacccagctaatttaaaaaattttttttgtagcgatggggtctcgttatgttgcccaagctggtttccaactcctggcttcaagccttcctccaccacacccagccaacatggggcaaaagttaccagaatcagttttatggaatagtgttagaagtagtgaatgctggccaggcgcagtggctcatgcctgtaatcccagcactttgggaggccaaggtgggcagatcacttgagatgaggagtttgagaccagcctggtcaacatggtgaaaccctgtctttactaaaaatacaaaaattagctgggtgtggtagcacgtgcccgtagtcccagctacttgggaggctgaggcaggagaatcacttgaagctggggatggaggttgcagtgagctgagattgcatcactgcattccagcctggatgacagagtaagactctgtctcaaaaaaacaaaacaaaacaaaacaaaaccagaagtagaagtagtagatgcttagtcatctacgttaatcttgtctgttgaaccaagtaggatcaaagatgagaatggagaccataccatccacttctatcccctgggatgtttttggttataaagggcataaagtttctgcagcaggaaaccttctttaaataacagaatgcagttaaaattattctacactcagcatgtttctctgccatgtaatgtttggcagttttaggctcttgatctttttggtttctcttgctcctaatttcacaattagatgacacgtgagatgctttttagtgcttttgtacacactcgtattatttagataaagcagaaccctacacaaaggggaaactgagcctaagaggaagattaaaagagcaaagggatggagaaaactgctaggctgaaattatttttttaaaaaagactatttactgtgtgtcaagtaaacacttttcatttgttcagcaaatatttaccgagtgctctctgggagttaggtactgtcatagttgctgggaatacagcggtgaataaactagaccaaatccctgctctcttggagcttgtattgtactgggtggggataaactataagctgataaatacatactaattctagttgtttgttatattacctttatttctgatgactattttataagataagaaatattttgtcactttcttataaatggggaaatcgaggctcagagagataacccagctggaaacaggtgcagctgggatcctggccagcgctagctacgcgattgctcattgtgtagagggcttgagaagatggggcctggggtagcacttcactcacccattgcacatggtctggtctctgtttcactttcaggtggactgcttcattcatttattcatgagacaaggcctcactctgccacccaggctggagtgcagtggcacattcatggctcactgcagcctcagcctccccagcccacctcagcctcctgagtagctgggactacaggcatgtgccaccacacctggctcatttttgtatttttttttttctgtagagatggggttttgccacactgatcttgaattcctgggctctggtgattggcccgcctcagccttccaaaatgctgggattacaggtgtgagccaccacacctggccccttattattctaatttgaagtaataatattaatattttaagtattatgggtgacttaagaaaacactttaattaggcagttttatgcctttggtccttagttctcaccagctggcagaatggggttaggcgtgtttaacgttcttcatgttatcaattagatgcaaaaaacacaattaacaatttttgttacagtttataaaattccttgtattttaaaaaagatataattactgcctggctttggagaattaaagggtcgcaaccttttttttctccctgagaaaataccatttacagtcttttctcttttttttttttttttttgagacagagtgtctgttgcccaggctggagtgcagtggcgtgatcatgactcactgcagccccaaactactgcactcaagcgcttctcctgcctgagcctcctgagtaggcacacaccaccatgccaggctaattttttgatttttttttagagatggagtcttgctgtgttccccaggctggtttctaactgctgagctcaagcagtcctccccagggaggttgaggctgcagtgagttgaaatcgtgttactgtactccaacctggctgacagaacaagaccctgtctcacagaaaaaaaaaaaaaagaaagaaaaaagaaaaatgtattttgctagtaattgctagaagttggcctttgtaagtattttgtgctttatttttgagatatttactcacctgggaaagttctcaaggaggaggaaggtgacttgccttgcctgcattccggtggcagggaagcaagcatgggaggcagtggagggtatgtaggtaaagagaggagaaggaacagctggactgtcggatgtggggtgaccttctcaggtcatgtccacacaaggactcttgtgagagtaaaagggtctctgttacaattaaagtgggagtgccaggagtaccctgggctgaggccaggagccgacatggatgatccccttctagaggtgacgtgtttgagctgtagcggagtgcttgggtaaaagcactagatactttagggttttgatttgggagtaagtcctggacatagtcatgatattctttggagaagaaatgtggttaatcaatcaagctttttgtaactgttgagtaaacattttttgagttggataagtaacctggaaagtgaagcagaaaatgattggaaaaatgagattgcagggtgaccgtgccattctacccccgtctgtttccactctgtcatattcatcctgtaacatttctctattgcttggaagccttggtactttacttgttagtgcagacttagggaagctggcctcactgagctgttaggtttatatgtgttaaaacttgtgctggagaaagtgcacaggagccaggcagtgaggcatggggtgctgggtggtgggccaggggcactagaagctgggcatggggtacagagctgggggagtggtgtgcactgggagccaggcagtggggactctggaatcacagtgaccacagtcagtgctgcatcctgagcccaccagctgccgcctgcaggtgggcaagggtgcctggcacctggagaagcacttcagcggctggtgtgacactgacctgagccttctgggaggcactgagaaatgctggctgtgattttgacatctgtgtcacctcagggcggaagacagcaatgccgaccccctggacagtattggatgccactgaccagatgtggctcccagtagtgatgacttggtgcacctcctggagtggcactataagggtctgactggcctcaacaaagcagaagctgttgtcaagaaccatgagggccagataaagatctgcatgccggctgggcgcggtagcttgtgcctgtaatcccagcactttgggaggccggggcgggcggatcacggatcacctggccaacatggtgaaaccccctctctactaaaatgcaaaaagttagccaggtgtggcggtgggcgcctgtagtcccagctacttgggaggctgaggcaggagaatggcgtgaacatgggaggtggagcttgtggtgagccaagattgcgccattgcattccagccctgggggacagagcgagactccgtcttaaaaacaacagcaacaacaaaaagatcttgatgcctctgatggagctgaacatttattatacagcaacagcagcaaggattgctggtgggcagactacactgtagggcacctgctcttctgtaagagtctgaaggacactattgtcagagctctgcccttttggaatgaagaaataattccccagatccaggaggggaaacaggtgttggttgaggctcctggcagcagcttttctggcacagtcgagccttgggaggctctcccggaaggggccatcatggagctgagcctgcccactggtattcccattgtctatgaattgaacaggaggagcttgaagcccattgagctcatgcagttcccaggagacgaagaggctgtgcataaagccatggaagcgtggctgcttagggcaaggccgaggcgtgaagggcggcagccgatccctatcctgacaacaccctcccagtctgccccattcctctatgcctctcacctccacgtgtcacagtgaccacagctgtaggcatccgaagttgttgagcgtatctggaggctcccattttaattttaggcatttttttttccactcctttcacacaatcagaatggcacctctggggcataggtcttcagcccaagccaagggaaggcttcttctacccaggagagctgaggggtggcaactctggggtctttgctagtgctttgtttacttgtttactaagaccctgcttgagtaggggatgtggaggaaccatgctaaggcatgaccaatgaggagaagcaagagagcctgtttgtattcctgggagccagtcctgttctattcagtcgtcaggtccctgtgtgtgtgtggagggggttgggaaaggttgggggtagatgaatgtaacctacatggtgatttaaaacaagcaactacagtcatgcatcacttaatgacagggatacgttctgagaaacgcatcattatgtgaacactatagggtatagttacacaaacttagatggcatagcctattccacacgtaggctctatagtataactccttggatacttacggtatggcctaggtattgctcctgggctacaaacctgtactgcatgtaactatactgaatcctgtgggcagttgtacaataacagtgagtttttgtgtatctaaacatagaaaaggaacagtaaaaatatggtattataatcttaccggaccaccagtaagatctggtgatctgacattgactgaaatgtcgttatgcagcccatgactgtatttcctctctgacttccccaggagagctggttccagaaggttcggatgagtcctgaatgtttatgtatggcattttcctttaccaaaacaaaacaaaagaaaataaaaacctttctggggttctagtagccattgaagtactcctaagtgtggtcatcagaaaataagccattctttaacaccttgacttctaacggtagaggttcattttgctgtgtattttagaatccctagtgagctagtgagattctggacaatttttttttttttggagccagtctcactctgttgcctaggctagagtgcagtggtgcaattgtagctcactaggctcaagtgatcctcctgcctcagcctcctgagtagttacgactacaggcacgtgccaccatgcccagctaatttttaaaatttttttgtagagaagtcatcttactatgctgctcaggccggtcttgagctcctggcctcaaatgatcctcccaccttggcttcccaaaatgctaggattacaggtgtaagccaccgcaagagtttgtttccaccttctgttttctgtttttttttttatctcaaaagacaacaagatataaatgagatgcattaatgcagcatactgcaaacctacggcatacttacttgtagaatttgtagtactggaatccaccctttaataacgaggtgtaaaagggagctatcagaagagaggaacagacaactggccacatttctgtaattgtgcaaaacaagtttgtttgtttttttgtgagacagagtccctgtcacccaggctggagtgcaagtggcatgattttggcccactacaacctccgtttcctgggtttaagcaattctcctgcctcagcctaccaagtagctgggattacaggcatgcaccaccacgcccagctaatcttttatattttttattagagacggggtttcaccatcttgaccagactagtctggaactcctggcctcaggtaatccgcctgcttcccaaagtgctggtattacaggggtgagccaccgcacttggccctgagcaagtttttatggaggattgagtgaagggcattgcctgggagagtcatcttttaagattttttggggtaagggatctccttgaaaatcttgagggaattgaaggtcctcctggccttcatgggtcccaggatttggacccctgccccaggtattctcaactctacccagaaatcaagccgcaccagcaaagctgatgcttggatctcttcatttgggctactctcaaactttttcctttgaatcttgttttgccattaagcatctgctgatgttgaggagtgttgtcagttacttactgtgttgctatacgtgtgtagtgtgtgctgatctcactcctggctttatcttcttttttcttttttttttttttttgagacgaggtctcgctctgttgccaggctggagtgcagtggcgcgatcttggctcactgcaacctccgcctcctgggttaaagcttttcttctgcctcagcttcctgagtatctgggattacaggcgggcaccaccacacccagctaatttttgtatttttagtagagacggtgtttcaccatgttggccaggatggtctcgatttcttgacctcgtgatccacccacctcggcctcccaaagtgttgggattacaggcctgagccaccacacccggccctattttttctaccatcattttgcttgtgtcctaatttccttatctctttgaattaaacttgttaatttaattaagttaaattaaaaatacattcgatgtgtgtttttttgtttgtttcttttgaggtggagtctcgctctgtcgcccaggctggagtgccatggcacgatcctggctcactgcaaccttcacctcctgggtttaagggatttttcttcctcagcctcccgagtagctgggattataggcatgagccaccatacccagctaatttttgtatttttagtagagacgaggttttgccattttggcgaggctggtctcgaactcctgacctcaggaggtctgcccaccttggctcccaaagtgttggggctgcaggcgtaagccgctgtaccggccgccttaatgcattttttgttaatcactttaaatctttcctagaacaagaaaataatgatagtgaggccaggtgcggtggctcacgcctgtaatcccagcattttgggtgagtgaggcaagtggatcacctgaggtcaggagttcaagaccagcctgaccaacatggccaaaccccatctttactaaaaatacaaaattagccgggtgtggtggcacatgcctgtaatcccagcgactcgggaggctgaggcaggagaatggcttgtacctgggaggcggaggttgcagtgatccgagattgcaccattgcactccagcctgggaaacaagagtgaaactccgtctcaaaaaaaaaaaaaaagaaaaagaaaatagtgatggcgaataaaacagatgttggggctgggcatactttgggaggccaaggcagggggatcacctgaggtcaggaattcgaaaccagcctggccaacatggtgaaaccccgtctctaataaaaatacaaaaattagctgggtgtggtggcgcatgcctgtagtcccagccactggggaggctgaggcaggaggatcgcttgaacccaggaggcagaggttgcagtgagctgaaaccgtgcctctgcactcccgcctgggtgatagagagtgagaccctatctcaaaaaaacaaaaacaaaacagatgtcggcaacctgtaggacatttttggttgggtattcttccaggtacctcacactcagtaatctaatcataacccatcttcttaaaatctccttctgtattttcaattttagggtattttaccattcatttaggtatccaggcctgaaatctagattattcttcttcctcactttttacttccaaataacagccaagttctgttgggaacacagatcaagtatctccagagctgtccctttcctatgcccattgcgcaggcttgcttgtggcctgcctccattcgttctccacacagtagctagagtgatttgttttaaaaggtacatctgggccgggtgaggtggctaatgcctgtaattccaacactttgggaggccaagtcaggcggatcacttgaggtcgtcaggagtttgagaccagcctggccaacatggtgaaaccccgtctctactaaaaatacaaaaattagctgggtgtggtggcgggtgcctgtaatcccagccactcaggaggctgaggcaggagaatcgcttgaaccagggaggcagaggttgcaatgagccgagaccatgccattgcacttcagcctgggcaacaaaaatgaaactgtctcaatgaaaaaaaaaaaaaagaaaagtacatcttacctggttattcccctgcttaaatccttcaaaagatgtctttcttgccttcacgaacaagttcagtgtcttaggatggtattcacagctcgtcatgagcttgttgcagcttgtctttcttgtctgtgcctcaccatgtccatacacactcattcttaccaactactcagcgttccctaaacagtgtgtgtgctcacaaagcctcccaatctctgccggcgctcctttgttcctcgtctgcctaacccctacctgtcctgaaaaagaaacttaagtcaagtagtaagcacatagcatttgtatgtggttcgattttcaaaattgctctctgggatgattcagttattacatgaatatacagttagtgtaaatgaatttgaatcctgaaaacctaatataagatggtgaaaaaaaggtgatactctatgcacaagcaaactgctgatcgcatctccgaggaattgtagtatttctatgcatacgtgcagtaagtaatagaacatcttattgagcttaagccaaaaatgggatttattttaaggatacaggagtcttctttctgaacctagggatagaaagatagctgggtcacaggaagagactggaatcaagaatccaggtgctgccagggcttcctgtgtctgcatcattatcattacccttcagttccactctctatcacctcgtctctttgtcacttccttttcctctctcaacagccctggctagtccatctctgtgcctactgtgtactgctgtacatggctagagaaaaaaacaaaagccatgctggtgggtctaacttttccctcaactttctattctggacttttttttttttttttagatagagtctcactgtgttgcccaggctggagtgcaatggtgcaatctctgctcactgcagcctccacctcccgggttcaagcaattctcctgcctcagcctcctgagtagctggggttacaggtgcccgctgccatgcccagctaatttttgtatttttgatagaggtgaggtttcaccatgttgaccagactggtcttgaactcctgacctcaagtgatccacccgcctggcctcccaaagtgctgggattaaaggtgtgagccaccgcgcctggccctaaaaatttttaaatctgcagaaaatttgaatgactcacctagattcatcagtttattttttgttacattcactttgtctgtatataaatgtgtgtatatacatctatacacccacacatacttgttggttttggctgaactatttgaaagtatggagaaccactaaagcagatgggaactaggaggaaggaagggaaggcttcattgagaaggtaacatttgagcaaagatccaggtcagggagcaggatatagagcagttatggggcaagtggcgggaggagcatgcgggggaggaaggcacagctccacaataagcaaccaccagtgcccagctgtgtgttgaaggaagaggagaccgctgtacttcactgtattgttgtccacatattcaccacccctgtctggggaaggttctatttccccacgctgcaggggtagtttcggccctgtgactgttttggccagttaaatgtgaacacaattgaatgtgtcaccgctgggccagtgtggagtttgctctgcctcttgccctttgcctgggcgattgctagtgttcccattagaggctgctctttcaccctgggtcttggagtgaagacgttatggagcagggctacactttcatctgaatgttttcccacggtagatgtagtgggaaataataatggttttcattcttttcatcagaaattctgtgaaagaagaaagatgaggaaaaatggaaatttactgtgtcattgccatttgcatttatgtataatttgcactaataataatgttcattataatgtaaatctacatccttttaaaaaataaatggaatcattatgtgtacccttttgcaaccggctttttcaattcaattttttaaaaaatggaaaatacacataacataaaaatatgcctcattttaaaagcagtagatatcgaagtgaatataacatatatcattgttcccctccctccctccccccctccttccctcccccactccttccctctctccctctctaccttcgtacctccctccctttgtacctccctccctctctcccttcctaccttccttcccttttgtttctatttagaggcagggtctcactctgacaccccggctggagtgcagtggtataatcatagctcgcttcagccttgacctcctgcctcagtctccctagtagctggcactacacatcgtgtgtgccaccatgcccagctaattttttattttttgtgggattggggggggagggggtcttgccatgttccccaggctggttttgaacttgtgggctcaagtgatccccctgcctcagcctcccagagtgctgagattacaggtgtgagccaccacatctgaccatgaattttttttttaaggaaactgatgaattttagatcacagagctgtgatgtttggatgtaaatgcattttttggagaaacattgttgggcttagattaggcctactgtgaaattgtcatagcatttaataagtttcaaacatggccagctgtgaaaaaagaaaataaaaccaataataatactaggagttattggccaggcaggtggctcacgcttgtaatcccagcactttgggaggctgaggcaggtagataacctgaggtcaggagtttgagaccagcctgaccaacaaggtgaaacctcgactctactaaaaatacaaaaattagccaggcattttggcaggcgcctgtagtcccagctactcgggaggctgagacaggagaatggcatgaacccgggaggcagaggttgcagtgagccaagatcacgctaccgcactccaacctgggtgacagagcaagactccgtctcaaaaaaaaaccaaaacagaactaggagttattgtcatctttccaaggagactaccccaaagagaaagtatttccaattatttttctttatattggaattcacttttttttaaagtagaaaagtaagacacttttgtagaatgactgtttattaaacttataacagtgttttgtgggtgtttttccccacaaactgctaaaaataagaggaacagtttggcccatcctgtcttagcttctgcctgcaatcacaatggccttcactgttttgaatctatttttagttcatcaggaacgtgagggtgggaagtgctgcgtcatataacagattaggagaaagccctattttaatgtcgtttgtgaaataagaactgaaacagacaagaaaaactctaggaatgagatttcatgattagtatgtgtggctttgagttgtggtttaggacacaaattgaggaattggaagttctttatacttttttttttctctgtgagataggggaaaacaaaattctcttaaaaaaggacttttgtttaacttaaaggagattatgccagtcctttgggttaatgttaaaaaagtcaagtaaacaatgagaaaaatgtttaatcatattttggtgtgttgtgactattttttggtgtgtatctcatatgttctgtttgtgataaaaagtgaggttgcatctcttagtagtcaaattaattagatacacttttttttttttttgagacccggctctcaccgggttgcacagactggattttatggctctctgcagccttgaccttcccagactcaggtgatcctcccatctcagtatttgttgttgttgttgttgagatggagtctcactctatggcccaggctggagtgcaatggcgtgatctcagctcactgcaagctccgcctcctgggttcacgccattctcctgcctcagcttcccgagtagcttggactacaggtggccaccaccatgcctggctaatttttttgtatttttagtagagacagggtttcaccgtgttaaccaggatggtctcgatctcctgaccttgtgatccgcccacctcagcctcccaaagtgctgggattacaggggtgagccatcatgcctggccagtttttttttttttttttaagatggagtcttgctctgttgcccaggttggagtgcagtggcacaatcttggctcactgcaacctccgcctcctgggttcaagtgattctcctgcctcagcctcccaagtacctgggattacaggtgcctaccaccacacctggctaatttttgtatttttagtagagatgaggtttcagtatgctggccaggccggtctcaaactcctgacatgaagtgatcccacctaccttggcctcccaaaatgctgggattacgagcatgagccactgcacctggcacagttttcttttcttttttctttttcttttttttttttgagcaggagtctcgctctgttgcccaggctggagtgcagtggtgcgatctcagctcactgtgacctcctcctcccgggttgaagtgattctcctgccgcggcctcctcagtagctgggattatgggcgcgtgccaccatacctggctaatttttggtatttttagtagagatggggtttccccgtgttagtcgggctggtctcgaactcctgacctcgggccatctgcctgccttggcctcccaaagtgctgggattacaggcatgagccactgtgcccggccagtttttgtatttttagtagagccggtgtttctccatgttgcccaggctggaggtaaacctttatacctgtgattgcacaaagccattctcttgtgagtcccctatccagatattcccagggcctcaggttgctaaaccagttcaaagttaacaccagtgtagaaggcattcagaccacccaagggcattatcctctactgagagccctgctgtgggcagcccagaacgctgccccctgcatggctcttcctaaattttccagcggatctttaagatggggcaaaatgtattctcccaatcttctcctactccttctgtcatgtatggacctgcctctgtctcttaactctttcttcctgcttaatagtctgcaacatgcttcacaaagtcttgattcttcaaccttttttgaaaccttagaatcctttctttcttcaaccgcatattatagtgagtcagaacatttattctctgtttatatcactgagtagaacatctgaatttaacatcttgggctgaacttggcattgaggtttaaggtgacttcatattttttccaacaatagtgggtatgctcttccaatgataatgataacgtcaactaataaattagtcaattttatgttcagtgcatttttctagtatttctcatttattcagcagatatttagagagtacctaccatgtgtcagacactgttctaggcactggtgcaacggaagttcttgcttttaagaaacttcaattagggggatggtaactaagcaatacacaaataaatatatcacacatgtcatagggcagatcagagccacggagaaaaaataagtagggaaagggacagggtggtggttttctcacaaccctgtaaggaagatactggtttttttcttatttttttgagacggagtctcacttcatcgcccaggctggagtgcagcggtgcgatattggctcactgcaacctccgcctcccaggttcaagcgattctcctgcctcagcctcccaagtagctgggattgcaggtgtgtggcaccatgcctggctgatctttgtatttttagtagagacagggttttgccgtgttggccaggctggtctcgaactccagacctcaaatgatccaccgcctcggactcccctcggccgatgatttcatccccattgtacagatgtgcagtgtacggatgtccattgtgcagaaactgaagcagagagctgttaagtgacttatctggataggctccagataagtaaagtagtcagtaataaaggttgaatttgaattagaaatcaagcatgaactcctaaatttagctgtctgtaagataatgaaacttggcccggcatggtggctcacacttgtaatcccagcactttggggggccgaggtggaaggattgtttgagcccaggaatttgagaccagcctgggcaacatggtgagatgccatgtctacaaaaaattaaaaattaggtgggtgtggtggtgcatgcctgtagtcccagctacttgggaggctgagacaggagaatcgcatgaacctgggagggggaggttgcagtgagccgagatggtgccattgtactccagcctgggtgacaagagcgaaactccgtctcagaaaaaaaaaaaaattacatgctacacagaagactatatttaacatataaactatgaagaagaataagatgaatacccatgaactgattactcatagttgtaagtatacaacccagtgagttttcataaagtggacatagctgtgacattagtatccagttaaaattaaaaaaaaaaaaaaaaaaccattaccagatccctagaatctcactcctgcctctcccgagctgcttcctgcccctttcccaccaaggataaccattatccaaactaatggtatagtttagtttttcttattttcaaattttatagaaatggaatcatccactctgttttttttacatctggcttcttttgctcaggggacatgggtaaatctgttaggaagcttttggagatgccctgctgttagtaggagttcaacaaacacattttgaatgaatggattaatttttctctttcaataagatgttgctctttaattatatgttaaaaggaagaagtggcagattgtatttttattgaatcaagtaaaaaaagaaaatctgatcattttgctcctacaagtgatggttaaatttgtgtcttagtgtaacttttgtttctcattgttttagtgaattaaattggctatttattcattaatttattttggaggtggagtctccctctgttgcccaggctagagtgcagtggtgccatctcagctcactgcaattgccctccacctcccgagttcaagtgattctcctgcctcagtagctgggattacaggcacgcatcaccacacctggctaatttttgtatttttagtagagacaggatttcaccatgttggtcaggctgttctcgaactcctgacctcgtgatcctcctgcctcagcctcccagagtgctgggattacaggcgtgagccaccacacctggccaattggctatttatttttaaatcttacctatttgaaatgaccaagttaggtcattttattaaaataacaacaagctttagtgtgttacaagcataggctgggcatggtgcttcatgcccataatcctagtactctgggaggccaaggtgggaggatcacttggggccaggaggttgagaccagcctgggcaacatagtgagacctcgtctctgtcaaaaattaaaaaaaattaattagctggacatggtggtttgcacctgtagtgttagatacttaggaggccgaggtgggaagattacttgagcccaggagttcaaggctgcagtgagctatgattgaaatactgcactccagcttgggtgacagagagactctctctaaaatgaagtgtaatatgcttaccgtaaattcgccatgtcagccaaggaggtgtgataaacagagatggtaagggaactaacatacagtatatacgtatttatgtatgtatttatgtatgtatgaattagaggtgggttgtcactgctttgctcaggctggtcttgaactcctaggctcaagcgattacccccacctcaccctcccaagtagctgagactataggcaggcaccgctgaacctggccaaaatacagttgttaaaaactcaagtgatagagcttgtaggaatactggtagagcgagttattctctcagaagagtacttttgctgaaggcatattgagttgttaaactctggtttggttatgaataatgtcattctctggcagaattgtgtttctgctgattagttatagaatgcccttttcccctcatgttgtagattcgacggaggcgccttgcacgacttgctggtggacagacctctcagccaaccaccccactcacctctccccagagggagaaccctccggggcctcccatagcggcatcagccccaggaccctctcagagtcttggtctcaatgtccacaacatgaccccagctacctccccaataggtgcatcaggtaagcccaagcttcatacctgggactcttttgtaattcttcttagctttttgttaagctgatggttgtgatgtttccagaacagattaaaatgaagcagacatcagctctttaaaatcctccaagcagtagtttaaatatcattgcaatgtgttgtgttatcgcttttttttttattgcaatctgttaaaccaattgcttttctttccataacttccatctttttttttttcaaacaggtttaggtattatctctgatgacaagatgattaagactgaatttggttctgctgattttatgaatttggttgatggttttaagataaaataatctgaaaatgcaagattaaaataatggtcaaaatgaacacctctaattgcagatttcctcgtcttcattctgcattggcacagaactttttctttaacttttcagaggataaaactacctgataggatgtttagaactatctcattaaaaagtaaaagtttatttctttataataaatgagctgatgcttgatatccaggactgtctttgttgggaaatgatatttctcatactgtgtatttgaaaatatctctcttttgtctgtgaacttttctatcaaatatagtattattgtcatataataataattactattttataattaggattctagttgcgtaaagggggtgctaagagaactgcattgatcataatatcatctaataatttgatagccttctgaatcatctgtcttcttgatctagaatcgtgtcaattaaaagtatttgcagagtttttgttgctgtacttctcgttaggtatcagtgtagactatagatatatataaatgtttatacctaatgtggttcaaccaaaacatctgttagtaataaagaagatccttgcctataatgtttcctctgtatgtctctgagaagctctgatggtcttctggtaggattgatgggttcaggattccaaatgtgattttccttggacacagtactgacaacagtgctctttgcctcaccctggtcaggccatacctggaatgctggaatctgtcctggagagaacctctctcactttgtcttacttgcttatttaaaccaggatcttggttaaatcccattccccacctacactggaataaggctatagaaaaactcagaaccatttgaactaattgaaaacttttgaaatgtctgtctcatttcgaattcatgattacatggctgggtgtggttgctcatgcctgtaatcccagcactttgggaagccaaggtgggtggatcagttgaggtcaggagtttgagatcagcctagccaacatggtgaaagcccgtctcacaaaaaaaatacaaaaagccgggtgtggtgctacctgcctgtaattccaactacaagagaggctgaggcatgagaattgcttaaacccgggaggtggaggttgcaatgagccaagattgcgctactgcactccaacctggtgatggcgtgagattctgtctcaaaaacaacaacaacaacaacaacaacatcaaattcatgatcacaaactcgggtagacccttgatactggcaggctgttgcaccatgcttcccagttcactcactctgctgatctgtttcataccttctcgagtgtgcagtacctcattctccatgctcactctctcagctagtggcctggcttcccatttctttctttctattttttttttttttttttttttttggagatgaggtctcactgggttgcccaggctggagcatggtggctgttcataggcgtgatcctagtgcactacagcttaaaactcccaggctcagatgatccgtctgcttcagtctctcatgtagctgggactataggcatgtgccaccacacctaactctggcctcatatttcattgagaaaacagatgcaggcagaacctaggcagggaacctccatcagcctcagtcatcacatccatctgcctacctgtatgtgcgcctggttcttgttatgcacaaattgtccctgctgctgttgaagcttggaccctagatcccatctcccttcagttactcagccttcactccagcagttcctttctctctcttgcttcatcagattttccatctcatatggcctttttttttttaacagcctatataatgccattacttttcccatcatgggaatgaacaaaaggaactctcttgatctaattccccctgccagcttctcccccacatctctgcaccaaaacctttgcagcagaacttccggaatgagttgcctgtcctctccatccccttctgcccttgcactctttgctgaatcaactgcagtcaggcgagggttcccgtggttgctctgtggttgctctgagtcactgtctggtctgacccatcagcctcattagacatggctttcacccacttctcctggaaacacgtttttcttttggcttccagaacagcacattctcctggttttcatgcattctctgtatctgttccttcttcactctttgcctggttccttttcatttccctgacttctaaatgttaggattcaagggctcaatatttaacctcttgtcctttccatccagctttattctcttactgttgtcatccagtgtcctggctttaattaccctcatttgatgattcctaagcttttatctccaacgtggacctgctccttgaacctcagattgacacatccagcgctttacctgacatctctgcttggatgtctaacaggcatgtcacagctagcatgccccaaatcaagctttgctgttgcctcacattttatcttctcccaggtttccatctcaataaatgacaattcatgttttctagacctggattggcaaactctttctgttaagggccagatagtaaatatttttggctttggaggctgtgaggttagaactgtttatctctgcttctgtagcacaaaagcagccatagaacatatgtaaatgagcaagtgtaactgtgttccagtaaaacttcacttacaaaaacaggcagtagcccagatttggcctgtggactagagcttgcttggccctgctctagacctgtcagaaaactagaagcagaccagattctcaccacctgtttcttctcatcacctccaccgctattacccaggtccaaggcaccagcatctcttgcctggatttctggaacagcctcctaactggtcatctcatgcccacccttgcttcacttgagtctgttctcagtgtagagccagaggggccccactaaagcataagtgcaacactgtgtaacagcccatatgctgttatcacaaactaacagaaaggcttgggcattccctaaacggttagttcttgcccgggtacctctatgctaagtagtcctgattatgtttctcacatagtcatcattattcataatcacaaacagttggatattattagccatactttggtgggttgaataaacagattttcatgatttcctaaataagtgaaaaaacaaacagaaaatctctcttaagacaggttacatctattctctgttcaggccaggtgcagtggctcatgcctgtaatcataatactttgggaagccaaggtgggaggatcccttgagcctaggagttcgagaccagcctgggcgacatagcaaaaccccgtctctacaaaaaattagcggggcgtgatggtgcacacatgtagtcccagttactcgggaggctgaggtgggacgattgcttgagcccaggaggtggaggttgccgtgagctgtgatcacaccactgcattccagcctgggcaacagagcaagaccctgtctcaaaaaagagaaaaagaaatttcaagaaaatatgatagctgtccgttaaagagtttaaaaagctggcatgaggaaggtgatggcttgtgtttattttctgtggtcctggaagttagacataggtctaatgggtagatttattatccaccgaatgtgattgagagatttttgttccagactcaaaaagtgcttctttctttctttctttttttttttttttttgagacagtctcactctgttgcctaggctggagtgcaatgacgtgatcttggctcactgtaacctttgtctcctggttttaagcaactctcctgcctcagcctcctaagtagctggattacaggtgcccaccaccatgcctagctaatttttgtatttttagtagagatggggtttcgccatgttggccaggctggtctcgaactcctgacctcaggtgatccacctgcctcggcctcccaaaatgctgagattacacacgtgagctaccacgcctggccaagaagtgctaacagagacaaacactgggtggggtgccacccatggtaaaaagtccttcatccaggagtgcttggcagcagtcatttggtggccctcttagttgggctgttttcagttgcaagtaactaaagcaaggattgagaagctgtagggggtccttccacttccagttgcttctcccatctgcagtcccagccttttttttttttttttttttttgagatggagtttcgctcttgtcacccaggctggagtgcaatggcatgatctcgactctctgtaacctccaccttctggtttcaagctattctcctacctcagcctcccgattagctgggattacaggcgcctgccaccacgcctggctaatttttgtatttttagtatagactgggtttcaccacgttggccaggctggtctcgaactcctgacctcatgatcctcccgcctcagcctcccaaagtgttgggattacaggtgtgagctgccacacccagcctagtcccagcttcttgcagtgccatctgcttctgtagtttcctagggctgctgtaacaacctatcaaaaacttttgaaggcttacagcagcagtattattttctcacagttctagaggctagaagtccaaagccaaggtgttggtagggcgatgcctcccaataaggggagaatcctttcttctgccttccgatagttgctggcagtccttggcatttcttggcttgtggcaacataactccagtcttcacgtccgtcttcacatggccatcttcgttctgtgtgtgtctgtgtccaaatttccctcttatgacagccactggattagggaccaccgtaattgagtatgagcttattttaacttgcttacgtctgctaagaccctccttgcaaacaggagtattatttctttgtttttgatctgcatctcctcttccctttgaatgtaaggttaggcaggagccttgccagtgttgctcatccccttacccccagcaccgtgcttagcacatggcaagcagtctggaaatgccaagtgttatgtggctaaatgaatgaaagaaatatttcttgttggaaatgttagaagcgaagtaagatttgagttcttttgaaaaacagctggctgacattgttcctctcaccacaaccagctggattgtctgtttttcctgatgtgctgagtgctgagcagaattttaaaaatcctcagtctattcattttcttctaaaattagaaaaaaagttattatataaaatatttcaaatgtacatgataacataactagtgcctatggaaccaagtccacaggtcattgctgttccagacttgccattccagatatttcttcatgttttactgcattgttatgtggcactgctcttggctctcttagaactttatatatatgggtgatgcttttcctacagatgaatgccacttttttatagttaacactgattatgctagtttttttttttttgagacggagtctctctctgtcacccaatctggaatgcagtggcacgatcttggctcactgcaacctccgtcacccgggttcaagtgattctcccacctcagcctccgagtagctggggttacaggtgcgtgccaccacacctggctaatttttgtatttttagtagagacagggtttcaccatgttggccaggctggtctcaaactcctgacctcaggtgatccacctgtctcagcctcccaaagtgctgggattacagatgtgagccaccgtgcctggctgattatgctacttttatatttaaaatgtagggcttactgcaggtcagacacagtacttggtcatgggaatgcaaagatgagtgagactcagtttctttccttaaagagcttttagcctagttggggaggaaatgttctttcatttcctgtttaatatctgtgtttattaaattctttggaggacagtctagttttcttagtttcttcccctatctttagatgatttgtgattgcttaatcttcagaacttcttaactgtctcgggttattttattttacagccttgttttggaattatgcttgtcttctctttgatgtttgcctatcaaacatcttgagtatatccaacgaaggccttaaccttcctcgctgttgtgacctctgaagaggaggtcatgattgctcaagagtcccccaacagatcctttatcaaccattttcatcttgacaggattattaggtctagtggaataggtcttccagtggaataggtctgcctgtatactctctagagctggcaggtttcatttttgtttttctaagacaaagtcaggctggagtacagtggtgcgaccatagctcattgcggccacaaactcctgagcttaagtggtcctcctgcttcagcctcagaagtagctgagactacaggtgcgcgccaccatgcctggctaattttttaattttttttgtagagatgaagttttactgtgttgcctaggctggttttgaactcctggcctcaagcgatcttcctgcctcaatctctcaaagtattgggattacaggcatggagttctccattgttttcattccatggttccctttggcaaactggggaagcctttgattggcttctcaaaatatacttttattattattttttgagatggagtcccgctctgtcgcccaggctggagggcagtgacgtagtctgcctcccgggctcaagtgattttcctgcctcaacctcctgagtagctgggattacaggcatgcgccaccacgcccggctaattttttgtatttttagtagagacggagtttcaccatgttgaccaggctggtcttgaacttctgacctcaagtgatcctcctccattggcctcccaaagtgctgggattacaggtgtgagccaccgcacccgacctcaaaatttacttttaaatgtgtataataaaataggattacacaattatataggaatataattatcaacatatttttaaagattgtaatacagttatttatatgcttctttattaatgatttaaatgaaagacttagcaactagtcaaactgcttcagccccttgacatctgtttccatctgtggaccacaggtaaagatcctctgctctgggagcagaaatgaacagtggggcctctttggaactagtgagaagccagatgatatatttggcctctgggctagttctggggtctggatcagaaacagaatttgtttcttttctttggctgctagtttttaacctacttaatgattatttaacttaaaattattctttaacatgttgactcaaatggtcttcatcctgcttccattcatgcacttgaatagttaataaatggcttctgtctgttgggcactgtattgagagctagggatgcaggatggataagtctcaggggcctccaggggctcactgtttagcatgagggcatgaacttgtgaagaggtgcagatgctggtgtcctgtacttgacagagaacagccacaaatagtcactttctcaggctcccggctatgcattgtagatttttttggagcattttcacacaggcatttatctgattgaaaattctactggctgggtgtggtggctcacgcctgtaatcccagcactttgggaggccgagatggagggatcatgaggtcaggagattgagaccagcctggccaacatggtgaaaccctgtctctactaaaaatacaaaaattagctgggcatggtggcgggtgcctgtaatcctagctactctggaagctgaggcaggagaatcgcttgaacccaggaggcagaggttgcagtgagccaagatcccaccactgcactccagtgtggtgagagtgagaatccatctcaaaaaaaaaaaaagaaagaaagaaagaaagaaaattctatgttggtgagagtgtaaatttatatagccattttacaaaacaatatggaggtccctcagaaaactaaaaacagagctaccatatgatctggcagtcccactgagtatatatccaaagaaattaagattcatatgctgaagagatacctctactcatgttcattgcagcattattccaaatagccaagatatggaagcaacctaaataatccatcttcagatgaatgggaaaagaaactgtggtatgtatccacaatggaatattattcagccttcaaaaagaaagaaattctgtcatttgtggcaacatggatgaacttggaagacaccatgctaagtgaaataagccaggcacagaaaggcaaatattgcatgttttcactcatacgtgggagcttaaaaagttgaactcatacaaatagacagtagatggtggttaccagaggctggggaatgggggtggatgaagaaggagatgttgatcgaagggtacaaaatttcagttagatcagaggaaaaagctttagtgatctattgtacaggatgttgactgtcataaataataacgttttatatattttttaaaattctactttttaaaaacaacaatattattattattattgagacgaagtttcgctcttgttgcccaggctggcatacaatggcacgatcttggctcaccgcaacctctacctcctgggttcaaacgattctcctgcctcagcctcctgagtagctgggattacaggcctgtgccaccatgcctggctaattttatttttggtagagacaggctttctctatgttggtcaggctggtctccaactcccgatgtcagatgatctgcccacctcggtctcccaaagtgctgggattacaggtgtgagccaccatgcctggcaaaacaacagtattattactttatataatatagggaacaacatccttccatatcctattataattggtttttttatgttttattttgagatggtcccactctgtcacccaggctggagtgcagcaatggaatctcgaatcactgctgcctcaacctcccaggctcaagtgatccttttacctcagcctcccaagtagctgggactcctggcacgtgccaccatgcctggctaattttttttttgtttgagttggagtttcgctcttgtcacctaggctggagtgtaatggcgtaatcttggctcgctgcaacctccgcctcctggattcaagcaattctcctgcctcagcctcccaagtagctgggattacaggcactggccaccacgcccaattaatttttgtatttttagtagagacgaggtttcaccatgttggccaggctggtctcgaactcctgacctcaggtgggctgcccgcttcggcctcccaaagtgctgggattgccaccatgcccatcctaatttttaaattatttgtgcagacaagttctcactatgttacccagtttggttttgaactcctgggctcaagtgatcttcccaccttggcctcccaatgtgttgggactacaggcgtgagccactgttcctggcctattcttatccctccaaatttgcttgatatgttttatctattttatatgtttgtttatgttggttgttacattgatttattgaatgctctaaattcacgtaggcttcacttaatacatatttatttaaatctccctatgcagtaggttctgttgtaggctatgtggcttatattttagtgagagaaaacaatttaaatacccagctgggcatggtggctcatgcccgtcatcctagtgctttgggaggtctaggtgggaggatcgcttgaacccaggggtttaagactagcctggacaacatagcgagacgttacctctacaaaaaaaatacacaaattagccaggcatggtagtgcgcacctgtaggcccagctactggggaggctgaggcatgagaatcacttgaacctgggaagtagaggtagcagtgagccgaaattgtgccatgcactccagcctggacaacagagtgagactctgtctcaaaaaacaaaaacaaacaaaaccacaaaatctttcagatgatggtaattatagaggaaaagagagcagtatgttggcataagtaccactgggggtgtgtacataatcactgtaggtcctattaagaaggcgactttttttttttttttttttttttttactttaagttctgggatacatgtgcagaacgtgcaggtttgttacataggtacacatgtgccatggtggtttgctgcacctatcaactcatcatctagattttaagcctctcatgcattaggtatttgtcctaatgctctccctccccttgaccccaccctccccctattaggccccagtgtgttgctcccctccctgtgtccctgtgttctcattgttcaactcccatttatgagtgagaatgtgcagtgtttggttttctgtttctgtgttagtttactgaggatggtggcttccaccttcatccatgtccctgcaaaggacatgatctcattcttttttacggctgcatagtattgcatggtgtatatgtaccacactttttttaatctatcatcgatgggcatttgggttggttccatgtctttgctattgtaaatagtgctatcgtgtacatgtgtctttatggtagaatgatttatattcctttgggtgtatatacccagtaatgagattgctgggtcaaatggtatttctggttctagaagaatgtgacatttttagcagaggcctgaatgaagtgagtaagcaaaccaagtggatatctgtggggcaatctttgcagacagaaggaaaacagatgcaaaggtcctggggcaagaatggacttgccagtgattgatgcaaggcagggctagagcagtcatcttcaatttcccctcattttccttctccaattttgagtctttaatgaacattatgattgcttattagtacatctgtaggaatgtcaacaagatcaaagccattcttttatggtaagttgtctttggctaagaatgctatccacaatgacaatgaaattctaactttggtcctatcattgattgctatattaaaatccttttttctttttttcctcttctacttggtccagagcttgggagaaagaattcgagggtggttaagcagctggctagaggcagaggctcagacagaagccccaaggcctgagggctgcagcaggaaccctaaaaggctactgagttcaggaggctcctagaagaggttgaaatcctttgctttttgcttattcattttaattatgagttggaacaggtgtgtcctatgctggcatgggtacttcctcgaattggactggccttcgggcccccaaaggggtatgttttattagttctgggctttatcttacagcattattcctagggtcatactaattactttgtgaatctggttaaagtgctcatgatatcttgttcttgagacgtgtgcagtgctgggaatcaatacacttcctgttttgacttggggttgattcttgcacttttccctatccgcagcccccaccccctgccccatttttgctaacctggtcctgcaacctctgctgtgcttgtagttttaccaactgcctgcttctgactccaaactgcccagtagcactctccccacacagtgggatgtgaactgtgccacggtactgcatggcctttgtcatgtgcccaagcctagcaaaggcacaggggcaaatactgtgtgtgagagtgatttctataccatgtgttcctgtcccttaaggatcttatggcttagtaggagagataatacatgtcactcacctgcttgaaagccttcctcgtctccttatttccaattataatctaatccgagggcttgcaaggtgctgtatcatcatgttccaccctcttcatgtaattcactatcttgattttcagagcatgttccctgttgctgtcccagtcaacatattcaccccaaaaggcctataaccagtagagatcgtgccacacaaaccactcttagttttgggtgcatttgtctggtcttccaaactagattgaaagctctgaaaaaaaaaactatcttgtgtttctatctgttgagctcatagtaggtatccaggaagtagtagggttgactgcattgatttgggactacactgggagttttcttcgccatctccctttagttttcctttttttctttctttcttttcttttttttctttttttttttgagatgtcgtcttgctcagtcccccaggctggagtgcagtggtgcgatcttggctcactgtagcctccacctcccaggttcaagcaattctactgccttagcctcccgagtagctgggattacaagcacccgccaccattcctggctaatttttttttttgtatttttagttgagacagggtttcaccatgttggtgatgctggtctcagactcctggggcctagcgatccccctgcctcagcctcccagagtgttaggattacaggcatgagccactgtacccggcctctctccagtttccagttggaatccaagggaagtaagtttaagataaagttacgattttgaaatctttggattcagaagaatttgtcacctttaacacctagagttgaacgttcatacctggagagccttaacattaagccctagccagcctccagcaagtggacattggtcaggtttggcaggattcgtcccctgaagtggactgagagccacaccctggcctgtcaccatacccatcccctatccttagtgaagcaaaactcctttgttcccttctccttctcctagtgacaggaaatattgtgatcctaaagaatgaaaatagcttgtcacctcgtggcctcaggcctcttgacttcaggcggttctgtttaatcaagtgacatcttcccgaggctccctgaatgtggcagatgaaagagactagttcaaccctgacctgaggggaaagcctttgtgaagggtcaggagatgttcaccagccaaggttgtgtggttcagtttctcttttgttgataagatttgtcactgttttgataggggatgcataatggagtatttggatttgttattgtaaactatgcagcatggttttcaaaaaacaacaacacatctttataactttaatgcaactgtaaagggttataggtttttttttaacatcagttctatcattttacagagaaactgaggtagtaagaacaagtacagagttcactaacagcgtgcatttgatgcagccaccataaattcagaaaatatcctcaaagccctcctgtattcagtgacttttttttttctttgagacagagtctcgccctgttccccaggctggagtacagtggcgcgattttgcctcactgcaacgtctgcctcctggattcaagcaattctcctgcctcagcctcctgagtagctgggattacaggcacccaccaccacgcccagctaattttttttattttttattttttatttcttttttgagacagagtctcgctctgtctcccaggctggagtgcagtggcacaatctccgcttactgcaagctccacctccctggttcacgccattctcctgcttcagcctcccgagtagctgggactacaggcgcccgccaccacgccaggctaattttttgtatttttagtagagatggggtttcaccgtgttagccaggatggtctcgatctcctgacctcgtgatctatctgcctcggcctcccaaagtgctgggattacaggcatgagccactgcgcctggccaattttttgtattttttagcagagacagggtttcgccatgttggtcaggcttgtgttgaactcctgacctcaggtgatccacccgccttggcctcccaaagtgttcagtgactattaaatatgcactgtgaaatgtattcttagttatcagggaggggttgcaggggagaggaagtgaccttggatgtagagataaatgaggtatggggggactcaaaatcccgttatatgcatatatcctttttagctacaagagttaggtggattataatttacatttgtttgttcattgtgagttgtttttaacaagtaatgtcaatatagaagcgtcagtggatccataggaattacacttgtgtgattatttgaaatgataggttgagagagaaaagtcattcaacagtggtgggataaggttccctctctcttttctcttttttttttgagatgtagtctcactgtcacccaggatggagtgcagtggcatgatctcactgcagcctctgcctcccaggttcaagcaattctcgtgcctcagcctcccaagtagctgggactataggcatgtgccaccacgcccggctaatttttgtaattttagtagacacagggtttcaccatgttggccaggctggtgtcaaactcctgatctcggcctcccaaagtgctgggattataggcttgagccaccgcgcctggcctccccgtctcttttttagtacttaggtatgctaaaagtggacaagaccagagcagatgttgtggtaacaaggcaaatctgttctttacagtggagtttgccctgatttctcattctgttctcgtctgacgcatacaggtgtatctatagaacttgtaaacacgttcacattggtttttttcattggctcctcaaagtagaactatgaagtaggctgcacagatgccagtattaccagagcataggtaaaaatattaagtaagaagacttaagatcacaaaactagaaatgatggaactgggttccagtcctagtttctttgtaaaatgaacatttattttggactaactttcaatgtacagaaaagttatgaagatagtatacaggattcctgtgtacccttcatccagtctcccctaatgttaatgtctggttcatttgtcaaaactaagggattagcctggatatgattttgactaaactaaacatgagtctccttagtctccattggtctacaacagtatctcagttctgttttcatgatcttcacagttttgaagaatactagtcattactttgtagaatgtcccttaatttggctttgtctggtgttttgctcatgataagactggggttgtgggttttggggaagattatgtcacacaggtgaagtgcccttcccatcacatcgtatcaggggtatataatatccacatgatgtccctggtgctgttaaacatcatcacatgcttgagttagtgctggccgtgtttctccacttaaacttagtatttttccctttccatattcagttctttggtatcgagttcctaagtccatcccacacttaaggggtgggaattaaacttcacctactggagtggggaagtacatatgtaatctggaattctatgaggaaaacttgtcccttctcccctgctatgtatttaatctcttagatcagtatgaactcacacacatttattttatactttgggttatgatttcagtagcaacattacttattttacaggaattattccagctttgaccatgggagctctttcaagttggatccttggtccatttgacatgcctcttcttttatatttttgagcactgtctttctagcaccgtatgatgctctagacttatcttggatttttcctgccccagccctagaaatcagccagttctccaaggagcagtcctggtctactgactccagatgtatgattctatgcatgattctgccttttgacactaaggagaggaatattctgtcttgtaaatatgaagatcaaagtgattttctaattccggctgttggttttcttatcccagtatttaagataccattgttgttcttcacagacttgaaatgtcattttattttatttgttttttaaatttattttatttttttttgagatggagtctcactctgttgcccaggctggcgtgcagtggcgcaatctcactgcaacttccgcctcccgggttcaagaaattctcctgcctcagcctcctgagtagctgggatcacaggtgcccgccaccatgcccagctaatttttgtatttttagtagagacggggtttcaccatgttggccaggttggtcttgaactcctcagctgatccacctgccttgtcctcccaaagtgttgggattacaggtgtgagccaccacgcctgaccgtattttattattttattattatttttgagacaggttctccctctgtcacccaggctgggggacagtgacgcaatcatggctcactgcaagcttgacctctgggctcaagtgatcctcctacctcagcctcctgagtagctgggactacaggcttgcaccaccatgcccaactaatttttttattatttgtagagatggggtctctctattttgcccaggttggtcttaacctcctgggctcaagcgatcctcccacctcaacctctcaatgtgtcgggattacaggcgtgagccaccacacccagcccactttatttttgtttagtcacaagaacaaaatgttttctttttttgagataaagtctcgctctatggcccaggctggagtgcagtggcgcgatctcagctcactgcaacctctgcctcccaggttccagtgattctgctgcctcagcctccctagtagctgaaactgcaggcatgtgccactgcatccagctaatttttgtatttttagtagagacagggtttcaccatattggccaggatggtttcgatctcttgacctcgtaatctgcccaccttagcctcccaaagtgctgggactacaggcatgagccaccgtgctcagccaagaacaaaatgtttttatcaggaaattagctgctaagaaaatgtcagtctgctctatgaaatagaatatgtttattataatcagcattgaggcagaagtctgaagcaggaggatcatttgagcccaagttccaggctgccttgaactatcatcttgccactgtaccgcagcccaggtatcactgagaacatgtctctgaaaaaaaaaaaaaagttttcaggggtgagacttggtgttaaccaaataaagtgcaagtatactttgtattttccgtgaatattaacgctttagcttaattcattgtcaagagctatataaataagctttaggattttgattaatagaattaatgactccttttataaacctaattatttttaagttttacttttgtaattttttttttttttttgagacggagtctcactctgtcttccatcctggagggcagtggctcaatctcggctcactgcaacctctgcctgcaaggttcaagcaattctcctgcctcagcctcctgagtagctgggattacaggcgtgcaccagcatgtctggctaatttttttttgtatttttagtagagacagggtttcaccatggtggccaggctggtctcgaactccttgatccgcccacctcggcctcccaaagtgctgggattacaggcatgagccaccatgcctggttgcttttgtaatttttgagtgtataaaataggtaactttgttttaaaatatttgatccaaaggactgttcagcagtctggggtaaaggaattacagcattatgttaggaatcaggcagcctgtgtgtgtgtgtgtttttttttttaggcatggtttcactttgttgcccaggccgaagtgcagaggtgccattgtggctcactgcagcctcagcctcctgggctcaggtgacccacccccctcagcttcctgagtaggtgggactacaggcgcataccatcacgcttggctcatttttgtatttttcatagagacggggtctccctgtgtcacgcaggctggtcttgaattcctggactgaagcgatctactccaccttggcctccaaaagttctggaattataggcgtgagccaccatgcctggctgagacctgtgttttactctttgctctgtttctaacaggcgaggaggtcctaagggaagtttttagactctgtagacctagatattcttatctgtaaaagaggagggaagatggttggccattacctttaagaccaatgcccccaacaaaacagatttattgaggcgttttggttttttaaaaaatatgttgtagagatgatgtctcactatgttgtttaagctggtcttgatcaagcgatcctcttgcctcgaccgcccaatctgttggaagaacaggtatgagccaccacacttgaccttttattgaggtttcaaggacgcttttgacaattctgtgctctttttacggtggaatttagaagcctatgcatttgtgtgtgtgtgtgtgtgtgtgtgtgtgtgtgtgtgtgtaatactggaacaggcctaatgttacaagttaaaggtagatatttggtctagtttgtacttgaaagggaacatcattcaggaaatattacaatactaggagaaagtcttacagacatgaaatttttatgtcctttgatgttctgatcttcccacatagaatgcataatttcctttagcaaactcttctcagttatagaagttggatactgccgcctagaaggttgctaattcctgtttcctgaagcagacatagctttctccattctgtgttacacacctcacttgtggaaggtttgttctatagttgatatgtggggagtttattcatcttctaaaagagggttacagcagattatgttcattttttaattctttaatatctggctttgtgaagatgaaggaagaaaaaacctgtattccttgagacttggcttcctgaccatgattcctcaagtttggggtgggagagggcatgaagacaagggagtgtgtgaggtttgaaaacagtgatattttgtactattgatttgatgtgtttttagtcgcaatatttaattcacattgatttctaaataaaatcaaagacaccatcaggtttttgtgtgtgtccttttttttttgacacagggtcttaaaaaagacccatctgttgcccatgctggagtgcagtggtatgattatagcccactgcagcttctaattcctgggctcaagcaatccttccacctcaccctctcaagtagctaagattacaggtgcatgccaccatgcctaatttttattttttttttaagatggagtattgctgtgtcacccaggccgcagtgcagtggtgcgatcttggcccactgcaacttccaccacctgggttcaaacgattcttctgactcagcctccctagtagctgggattacaggctcccgcctctgcgccaggctaatttttgtattttagtagaaacagggtttcactatgttggtcaggctggtctctaactcctgacctcaagtgatccacccgtcttggcctctcaaaagtgctgagattacaggtgtgagccactgcgcccggactacctgactaattttttaagtattttgtagagacagggtctctgtgttgcccaggctggtctcaaactcctggcctcaagtgatcctctctccttgactccccaaaagtgctgggattacagatgtgaggcacgactgaccatcagtattttaaatttaagaaaggagagaaatgggttatggtggcatatgttctttgtttcagctactcagaagctgaggcaggaggatcccttgagcccagaaggttgaggctacagtgccctaggatcacacccctgcactccagccctggccaacatagtgagacccatctcttttgttttgttttgtttttgagacagaatcttgctctgtcacccaggccggagtgccgtggcacgatcttggctcactgcaacctccgcctcccaggttaaagcgattcttctgcctcagattcccgagtagctgggactacaggtgcatgccgccacgcccagctaatgtttgtatttttagtagagacagagtttcaccatattggccaggctggtctcgaactcctgacctcatgatccgcccgcctcagctcccaaagtgctgggattacaggcgtgagccactgtgcctggctgagacccatttcttaaaataaggaggccaggcaccgtggcttatgcctgtaatcctaacactttgggagactgaggcaggtgaatcacctgaggtcaggagttcaagaccagcctgacaaacatggttaaaccccatctctactaaaagtacaaaaattagctgggcatggtggcgcatgcctgtaatcctagctactcgggaggctgaggcaagagagttgcttgaacctgggagatggaggttgctttgagccgagatcgtgccattgcaccccagcctgggcaataagagtgaaactctatctcaaaaaaaaaaaagaagaaagaaaagaaaagaaggaatggagtcccctggtgtttagagattgaggagcacttgtatacataataaattgttgcagaattgccccacttgatccgaaatgtgaagatcatgtggaagatgcaggaaaaaatgaattcagatgatctctttgatgccttataaaaatattacaaatgcagtatgttacactatgtgatatacactggagctatattgctacagtattattgtacacatactatactatactacagatacagtttttaaaacaatttgtaattatgtgtttaattttataacttgttttgtagggtagaaattttaaagcctgcttatttactaccataatgatcattgaagtttattattgattaattttaactaaaaagttacttggcctttaattgtgataggtaaaataatattctcctaagaaccttgtgatggtgtattatttattccttcaataagtattttttcagggcttactttgggttatatttcctgaaattaatgaatcaaaagttttactgtattctgtgaacttgtttcagaattctcactacggtagatgctttgtgtattttacttgagtcctaggaagagagaaaatttagtttcttatttccttcataaatcctgcagaagttttaataaattagtacatgtgaagaactgctttcaggaatggataaatgttttataatattcttcaatgaagagaaacattaaaaagtggcaagtttactgtcatagaatgctggaagggttaaaattgtatttattcagtgattgttttcactacaacgggtaactcaagtttctctgttttcttttttcatacttttttttttcttttttttttgagacggagtcttgctctgtcacccaggctgcagggcagtggggcgatcttggctcactgcaacctccgcctcccaagttaatgcgattctcctgcctgaacctcccaagtagctgggattataggagtgggccaccacgcccagctaatttttgtattttaactagaaacagggtttcaccacattggccatgctggtctcgaactcctgacctcaaatgatctgccttcctcggcccctcaaagtgctgagattacaggcgtgagccatcgtgcccagccaatggtttttttaaacatgtgtcattttccttttcagcaccataggtatatatattttaaagtatttgcaaatgcctgggtaaacattcttcttttttcataggaagatattcatagagttaaagtaatttttaaaatttcaatgtaaaacatgattttaaagacattgatgggaaattgctgtgagaaatcatctgtccctgtactagtgactacagtttcactgtactgtcagctctgtgagggcaacaaagtgtcaggtttttaatttccactaaggtgttcaatcaataaatggatcgatctatatcaaaggacattgttgagtccacttgaatttttttttcaatattttactataaaaattgtaaacatacagtaaagttgagagaattttgcagggaacacccgtatactcaccatctagattctatcattaactttttttttttttttttagacggagtcttgctctgttgcccaggctggagtgcaatggcgcaatcttggctcactgcaacctccgcctcccgggttcaagcaattctcctgcctcagcctcctgagtagctgggactacaggcgcccgccaccacgcccagctaatttttttgtatttttagtagagacggggtttcaccatgttagccaggatggtctcaatctcctgaccttgtgattcacccgcctcgacctcccaaaatggtgggattacaggtgtgagccaccacacccagcctcattaacattttattatactcgctttatcacatatttttctataggtttattaatatatccttttattgtttttgagatggagtctcgctctgtcacctaggctggagtgcggtggtgtgatcttggctcactgcaacgtcttcctcccagattcaaaggattctcctgcctcagcttcctgagtagctgggattacaggtgcccagctaatttttgtatttttaatagacatgaggtttcaccatgttggccaggctaatcttgaactccaaacctcaggtggtccacctgccttggcctcccaaagtgctgggattccaggcatgagccactgcatcggcctggtttattaatatatcttcttttgggcgcatttcaaggatttttctggactatcatggaagttaatttgtatttctaatttgtatttgtgggccatagtttgaattggtgcaagagaggtgatgaggggtgagttttaggcattagatgtagctctgttactgacctcatatgaagtatattgataacttatgatttcttagtaatgttcctatgattttattattgtttccagctttttatataatcttctgatagaaattcctcggttgctgcaatgtcatgatgggtgactgcagattgtgcgtgtttactgtcgctattacaaataacttgaacattatttcacatggggcttcatccttcctgtgttttctgtttaggagtagcccatcgaagccagagcagtgaaggagtcagttctctcagcagctcgccctctaatagccttgaaacgcaatctcagtctctctcacgttcccagagcatggatatcgatggtgtctcatgtgagaaaaggtaaaatgaagccagttttctaatatgctcttttatttagggaaagagaaagatccattcactttagcctctagtccatagtcagaaatgccagctagagacccatgccagtccttagcaaattagtgtcaaatgtattaaatttaaagattttgtattattcagaaatattcttcatacttttgttgctgttgagacagagtttcactctgtcgcccaggctggagtgcagtggtgcgatcatggctcactgcaatttccgcctcccaggttcaagtgattctcctgcctcagccacctgagtagctgggattacaggtgtgtgccaccatgcctggctaatttttgtatttttagtagagacagggtttcagctgttggccaggctggtctcaaactcctggcctcaagagatcttcctgccttggcctcccaaaggactgggattacaggtatgagccactgtgcgtggcccactatacttgcatattaaatgtcttttatgaaataatggtgtagtcagttaaaaaaaatctattgttctcattttgtaaatataaagttggcaagcatatgcctctccctaaaacttttactaattagtgaaatttaaaagtttggaatatttcatacaggtaagccaaataaataccctatttgcttcgtacggatcaaggtgtcttgaaagagccctcctgtgttgcatatgtgccaaaaatgggtggtaagagtggctgaggtattgactcctttcatggttgagcaagtcagactccttggacctggctcctctcccctcaagcagtggcctcggtttgtgtcagtgggctaaacagatgaagaggggaattaagtccgggctcgatggctcatgcctgtaatcctagcactttgggaggccgaggcaggtggatcacttgaggtcagaagttcaagaccaacctggaaaccctgttgctactaaaaatacaaaaacttagctgggcctggtggcaggcgcctgtaatctcagctactggggaggctgaggcaggagaatcacttgaacccaggaggtggaggttgcagtgaaccaagattgtgccactgcactccagcctggccgatagagtgagactccatctcaaaaaaagaaaaaggagaattaaaaatatgaataaggggctgggcgtggtggctcacgcctgtaatcccagcactttgggaaacagagacatggatcacttgaggccaggagttcaagaccaacctgtccaacatcgtgaaactccgtctctactaaaaatacaaaaattagctgggtgtggtgttgcatgcctgtagtaccagctacttgggaggctaaggcaggagaatcacttgaacctgggaggtgtaggctacagtgaactgagatcacaccactgccctccagcctgggtgacagagtaagactctgcatcaaaaaaaaaaaaaaaataataataataataataaccaaatagaatatctagaaatgaaaaggtaatttacattgagaacttgctgtaagagttaaataggggttagacatagctgaagaaagaattgacaaactgaaagagctgaggaaattacccagaacgtaccacaaagaacaaagcagatgaaaaatataaaagatatttagagatacagaggacagagtccttggtttctcctgaaatgtatctaggattgaaatttctgggtagaaaattaaaattgtagtgaatgcagatgttcagctttaaaaaagaaaaaaaagacaacaggggtccaggatatatctaaacatcaaaaagggagaatagagagttggagagatttccttctgctcactcttattccacatttttttctctactggtttgaaagatattattttaaaaaatcaggccaggagcatttgaaagatattattttaaaaaatcaggccaggagcagtggcttacgcctgtaatcccatcactttgggaggccgacgcaggtgttcacttgaggtcaggagttcgagaccagcctggccaacatgttgaaaccccgtatctactaaaaatacaaaaattagcggggcatggtggcatgtacctgtagtcccagctactttggaggctgaggcaggagagtcgcttgaacttgggaggtggaggttgctgtgacctgagatcgcaccgctgcactccagcttgggcaacagagtgagactttgtctcaaaaaaagtaataaataaataaacacatcatggaaaattgggtgtccatttcctcaagcatttgtccttattttttttggagacggagtctcactctgtctcccatactggaatgccgtggcacaatctcggctcactgcaacctccgcctcctgggttcaagcaattctcctgcctcagcctcccgagtagctgggattacagacatgggccaccacgcatggctaatttttgaatttttagttgagatggggtttcaccatattggccaggctggcctaaaactcctgacttcaagtgatccacccgcctcagcctcgcaaagtgctgggattacaggcgtcttatatttcaattaagtttgctttaaaataatacaatataatataaatatagtatatcatgatcaatttaggcttactttaggaatgcaaggatgcattgatattagaaaatctataaatatcatctaccatattgcatgttaaaaagaaaatccttataatgttggtagctgcaagagtttgataaaattccacattaattcatggtaataagaaaatgaggaacagaaaggagtatctttaaactcacagtgtggcacagacaaagttcaccaaatattccacaggctccccagaatttcccattctcttttacagttagattggggccaatgactagttctgtcctgtagactatgaactagagtgacgtgtcacttttagatgaaggcagttgagccaatgttcctcctccgtccctctcttctcttgctccagtgaccttggaggctgtgtattgcagatggcatagattaaagatggagtaaggatgcttcactctcatcagactttgtgtaagcaagaactaaatccttacagtgttaagcctcttaagatttcagagtgtatgtgttactacagtatagcctgtcttactctaactaatataaagggcatctaccaaaaaactacagcaactctcctattcagtggtgagaagttagcatcattttctgtaaaatcagcaataagaacaaggatgactgctatttcttcttgtatttagcagtgcagtaaaacaagtaaggattggaatggaagaaacaacagtaataatttgcagataaattatttacatgttggctgggcacagtggctcacacctgtaatcccagcacttttgggaggccgaagcagacagatcacttgaggtcaggagttcgagacaagcctagccaacatggtaaaaccctgtttccactaaaaatacaaaaaaaattagccgggcatggtggtgcgtgcctgtaatcccagttatttgggaggctgaggcaggagaattgcttgaacctgggaggcaggggttgcagtgagccaagattgcaccactgcactacagcctgggtgacagagcaagactctgtctaaaaaagaaaaaattatttacatgtaaactttctatgtataaataaataagttgcttataagaagtgtatatttaaaatcagttgcattcctgtctgccagcaacaaaaagttagaaaacgtaatttttaaaaaggtgccattcacaatttcattaaaaagtattaacatatggtacctaggaataaatttagcaaaagaagtataaaatttttatagagaaaattactaaagcttattgatagaccttaaagaagatcttaatacttggagagtaatgaaaactcagtaatatattacttctccccaagttgatctctaagagtgaaaaaaattttggtcaaaatcccgggagggtttttaaggaattcctcaggctgattcctaagtatgtgtagaagaggaaagagccaaggatagcaaaacctcttaaaggagaagaataaagtggagacattgacctagcagatatcaagatttgtgaagttttagtaattaagacaaagtggtattggccagggacagacaaattgtctaacagaacagtaatgagtctccagaaatagacccactcgttaatgaaaattggacacgtgacataggagctttcatattaatgtaaaaaggatgatctttccagtaaatggtgctagggcaattgttcaatcggggataaatgatatgtacttaaccagtttttataataagacttcagttgagttttttattttcttaattaaattttttatttttattttttatttttttgagatggagtctcgctctgtcgcccaggctggagtgcagtggcgcagtcttggctcactgcgagctctgcctcccgggttcaggccattctcccgcctcggcctcctgagtagctgggcctacaggtgcccaccaccatgcccggctaattttttgtattttttagtagagacgggtttcaccatgttagccaggatggtctcgatttcctgaccttgtgatccgcccacctcggcctcccaaagtgctgggattacaggtgtgagccatcgtgcctggcctattttctcaattaaatttttaaaaatgtttatttaattttttttagagccagagtcttgctatgctgcccaggctgggatacagtggttattcacaggcacagtaatagtgcatacagcctcaaacttctgggctaaagtgatcctccagcttcagcctcctaggtagctcggaccataggcgcatgccaatatacctggcctggttgaattttatgtcattttaaaatactatatataggtaacctactttaatgatatacttttatttatttatttatttgagacggagtttcgctcttgttgcccaggctggagtgcaatggtgcgatctcggcttaccgcaacctctgtgtcctgagttcaagtgattctgctgcatcagcctgccgagtagctgggattacaggcatgtgccaccacgcctgactaattttatatttttagtagagatggggtttctccatgttggtcaggctgatctcgaactcctgacctcaggtgatccacctgccttggcctcccaaagtgctgggattacaggcgtgagccactgcactcggccaatgatatacttttaaaaagtaagcccaagaaaatgacaacttaggaaaaatatttccaacatgtataagagacaaattgtttagatcctaatttatgaagaactcttaaaaattaataagaaaaaagatggaccattatcattttcctttcctgattaactgatattttaaaacattttctcacccagcagctacagtgacattgtgcggatttataaaaggtaaaaggcttgtttgtcttttgtactttaagcatgtcccaggtggatgtggattcaggaattgaaaacatggaggttgatgaaaatgatcgaagagaaaagcggagcctcagtgataaggttggtaagcgatgaagcccttggtacaggtaatagaaataaacacatttcatgtcttgtatctgtagagtctgttagattggggccacccgaaatcaggaagtcctaggcaggtgattatttttattcttttgaggaaaaatgaataacctagattacccttattcatgaaagtgtaactcagtcctttgatctgataatatccatctgtttttggttcagggccatgattttatcagtaaatttaggttgtaataggaactaatttagagcaaattagaattctttctgttggtcttttgcttttttttttttttttttttttttttttgagacagagtctcgctctgtcgcccaggctggagtgcagtggtgcgatctcggctcactgcaagctccgcctcccaggttcacaccattctcctgcctcagcttcccaagtagctgggactacaggcgcccgccaccacgcccagctaattttttgtatttttagtagagatgggttttcaccgtgttagccaggatggtcttgatctattgaccttatgatccacctgccttggcttcccaaagtgtgggattacaggcgtgagccactgcgcctggcctggtcttttgcttttaagcaagtagatcatcacatctttagcagtattctgaggaaaatgactgggaattgaagcaagaatatgtagaatctagtcgcaagtagaaggttttggaaaacatgaagcctttatatttgaatatcacctgagcttagtgctctgcatttagggtgtgtgtgtgtgtgtgtgtgtgtgtattaatatagataattacatcactttctgtttagtaaattattaggaatcctttagcaacacatgttaatgattattggaagttgcactgtaaacaaaaataaagacaaacaaaggaaaaaataagaagttgcactgtagcctcctagtggtgcagtgctttattttgtatagttctttaatgtttacaaaattcttttttatatgctgttttatctgtggtggtatgtaatgagaaatgttacaattttgaaaaattcctggaggaaaattggtcatgcacctggagtgttaacctggtcctatggaattcagaaaagtaaatagataggatatgtacatcctctgtcacatatttttccttggtgacttttgataatgactttgctctttttttttttttttttttttttttttttttttttttgagacagggcctcactctgttgcccaggctggagtgcaatggcgtgatcttggttcaccacaacctccgcctcctgggttcaagcgattctcctgcctcagcctcccaagtagctccgagtagccaggcccgcaaccgcgcctggctaatttttgtatttttagtagagacagggtttcaccatgttggccaggctggtcttgagctcctgacctcaggtgatccactggcctcggccttccagaatgctgggattacaggtgtgagccaccacgcccggccatctttgctcttttatgctccccatagattgtattgtaagctcatgagacttagatgttgtaactttgatgttataggaataggcttacttttcccctaatcagtgggtgaatggtttcatgcatttttaaaatatcatcactaataatgaattaaatcagaataacgtattcctattgaaacacctaactcatacctcttatttgaaattaacctgcaaatcttcttcttcaccaggagccttcctcgggccctgaagtgtctgaagagcaggccttacagctggtctgtaagatcttccgtgtctcttggaaggaccgggacagagatgtcatctttctttcttctctttctgcacagtttaagcagaacccaaaagaaggtaggaatctagctcagcagtcttactgcagagtactcgacaagaaaataagatgtgagatctttgccctctgttatccacattcactccatcttgctcttgggttgtatttttgatgacagggatacttcttgatgaggacacaattgtttagccactttcttccctttccactgatcttatcgataacttatttttcatttccatgatttctataatactatgtaaataggttaatggtctccattttctcagggttgaagtttttctctttgtagtaagaaggtgcttagagcattacctcctctttatttatttatttatttatttatttatttatttatttatttatttattttgagatggaatctcaccctatcaccaggctggagtgcagtggcatgatctcagctgactgcaacttctgcctcccgagttcaagtgattcttctgcctcggccactggagtagctgggactacaggcgtgcaccaccacgcccagctaatttttgtagttttttttgtttgttttgtttttgtttttttttttttttttgagacagagtcttgctctggcaccaggctggagtgcagtggcgcagtcttggctcactgcaactcccacctcctgggttcaagcaattctccagcctcagcctcccgagttgggattacaggcatgcgccaccacacccagctaattcttgtatttttagtagagacagggtttcaccatgttggccaggacggtctcgatctcctgatctcgtgatccgcccgccttggcctcccaaagtgctgggattacaggcatgagccaccgtgcctggcctcatttttgtagttttagtagagacaggatttcaccatgttggccaggatggtctcgatctcttgacctcgtgatctgcctgcctcggcctcccaaagtgctgggattacaggcttgagccaccgagcctggccttacctcctcttatgaagtatagatatagtgggtggtctccagggatcctgagagaagtgttctgtatgagctatacctgctttaagtgcctatgaagccatgtatagacggtggaattggtctatttggttaaattgcttagcaagatagaacataatgacattttgctgtgtttctgatattccactttaagaggccaagcttgtaacaaaataataaaactcttagcaagatatcagcatcatagggcactatcctttttctttacagtagtcatttggaacgcagaagaggtatgggaggtgtgctggagtggtttttttggcctatcactggaatgtaacttccctcatggtagggatttttgtctgttttactcattgatgtatccctagaaggatatcttgcacaaaatagtccctcaatagatagattttaaatggatgcgtgaatatcaaggagatcacctttctcttttctatgctgcctatcttctgaggagggaaaaaaaaagtcctttgtatttctggaggatagataagactatttctgattttacttattaactctgctaatggagcagaccatgtatttgaaactctgctacttgttattcttattataaatcttaagattctctgtcttacacatgtaagtggcaaatctgtcttacacatgtaagtggcaattttaaataaccaaatcagataaaatttccatgagttaaaacttttgttaaaacaagtgtcttacacatgttaagtggcaactctgtcttacacatgtaagtggcaattttaaataaccaaatcagataaaatttccatgagttaaaacttttgtttagtggtatttaaaatgtatctaaagaccaacagtaaatcaactgggagctgcaaagaataagaaggaagctagaatgtagcatttgctcctgaaagccacatggtgactagatgttggacccttcataaaatcttttgaaccttggacttaatagttttattactatctataaaacatatctagactaagaaatattaacccagttgcatttgtagtataataaagtaacctctatagttgggagtagcttctttttacaattaatatacatcagcggtaactctcaatgactgtaccccaactttctttttaataaacttttaattttggaatagtttcagttagtgcagggagttcctatatatactttacccagtttcccctgacgttaatatcttatataaccatggtacatttgtcaaaactaagaaattactactaactaaacacaaggctttatttaggttttccactaatatccttttaccattccagaatctaatccaggatactgcatcgaaccatttggggtcagctggcttattcaagggctgtgtaacctgtgttcgaactgtgtgtaacctgttctttgttctgcctttccaacagtattctccgattttaaggacttgattggccagattttaatggaagtgctaatgatgtccactcagaccagagatgaaaacccatttgccagtctgacagccacatcacagccaattgctgcagcagcacggtcaccagacagaaatctcttgctaaacactggctccaatccaggaacaagccccatgttctgcagcgtggcttcctttggtgccagctctttgtctaggtcagtgtggttctctttgcacatcttactggtagtaaaataactgtgaactacgtaggagaagggaatgtttgttgacagtgttaatcagtgtcatacagggtatggcatatatcatatttggggaggtggatttagtcattggaagtggaattctcttttctagattattattttttggctctctatggttaagatattgctagatgaaattttagaagcagttggctgtgtatactacatcattcttcgaatggggactttatcgtcttgtaagtatagcctctagatcaatagggcaattagattataattatttagatgtttatctgctagatatacttgaactgaaatgattctcctttaaaagcttgatattttctgttttagttagttatctcaagtttttctttgatttttctcttctttcctccctttctcaactaatttagcctctatgaaagtagtccggctcccactcccagtttctggagctctgttcccgtgatgggcccgtctcttgcctcaccttcccgtgcagccagccagttggctgtgccttccactcccctcagtcctcacagtgcagcctctggaactgctgcgggaagccagccttcatccccgcggtatcgcccctacactgtcactcacccatgggcgtcctcaggcgtctccattctgtcgagctccccaagtccccctgccctcgccagtagcccccaagcagtgcccgccagcagttccagacagaggcccagcagcacgggtccacccctaccacccgcctcacccagtgccacgagcagacgcccctcctccctgaggatctctcctaggtatttatcccacaggagagttgcatgtgtgtttgcggtgcagggaaaggagattaacacggtttggaagaagtgctgtgtgacactgactctgttaaattgttgttttgggttattaacctgtgtggctaactagtttggtaggcacgtactctgagtccatgcttctgccaggctctaatcatgctggaaagtttgggttgctctattctattgtgaatccctttcttccctttgagagttggggcacacaggaaccctttttggccttttgtcctgttgccagtggtagttgaaatgctatcagaccaagcaggtgtgggagcaaatctgggcctggtgttttttacttctggtgagtggggtgggtcggttcatgtcctgacgtgttgagttttagttatatgtaagttcagtctcttagaaggaagcagtatcagaattccactaatccagtggccccttctctcaaatgtacctgtatgtgtttctataatttaggtgaattatgtttctgcatgtcagtggccaaaagttttagtgtatggtttatttaaaaggacagcagttgcaaaagcttctccccgtcttgttttttctttgttctctgatggccttttttgcttttgttgtggtagtatgtacgacaatcctttctccttcctcttcctcgcactttctggggacagtagtgatgaagaagatgaagaagaagatgatgatgatggtgatggtgatgatgaaggtggtggtggtggtgatgatttttcttgtgtccagtttgggtccaggtatcagaggaatggagtcttacccctgcatgtgcgtagatgcttaggaactaacttctataagctctaacaaggggcgtgctttgaatccaggcaggatagggtcaaatgaggtgggctccagagtatattgatgtgttcagaccttctcatgggataaagtagcacataggagaattttctttttttctttctttctttcttttttttttttttttttgaggcagagttctgctcttgttgcccaggccggagtgcaatggcgcaatctcggctcacggcaacttcctcctcctgggttcaagtgattctcctgcctcagactcccaagtagctgggattacaggcacccgccaccatgcccggctaatttttgtatttttagtagagacagggttttgccaggttggccaggctggtctcgaactcctgacctcaagtgatctgcccgtcttggcctcccaaaatgttgggattacaggagtgagtcactgtgtctggccccagaattttcagagttgtcgcctggcaagtttggaggaaaactttatgtataatcatttttcaaaagcatgaaaacagattaaagatcagtcatcaagtttatccacctttagatctaaaatgagggacccttcatttatctattgcgagaatgttattgtgaactaccagatgtgacaacttgtactctctgaggcatgttttcttaagtacagttgcatgaattgctgctatttagtaacgggagaggggctgggatttgggggaggtgtgtgtgtgtgtgtgtgtgcgtgcgtgctcccttcccaccccctcccagcctccaccgcccccctgttcacccccattgagctcagtctgggcaatccatcgaagaacatatgaggtcataccatctgcataactgtgactttgctttcatgtctagccttaaatttctcttagcacctcctggacctcagtgaagccagaccccatttgtttaaagagcctttgaaatgaccgcagaggctgaaacatagttccggatgttgctgaatgtttacccctggaaaccgagtgaaaagcactacttgggttgtgtaggtgactttgagcaagagaatataatagcaccttctttctaatcctctgactcattgtcttacaattttgctcttaaattgaagtttcctgtggactgagttggtgtttgtgcccagcactgttcaaaaataactccaggctataaatagagactgcagtaggagttaggtacacttcattcaattcgatggtgttcagaagaatcattagagaatacgtaaagagacagaggaatgttgatgcaaggttgaatattgattcaggaaggttgatatttgtattacgctgaacattttatcaccatttctcaagtaaatttcccaaaggtgaaagtgtctttttcacgtagataaaatcctattgcatgattatagtaataaagcaggcatccttcctaggaaccagtttccacatggtaaaagtgctgtgttacctgttttactgtaaattttctgtgggagaaattctctctccctggcctatttagttgtgactttctctaacaaccgtatcagattgtgtgctgcttttactaatacctctctttctggacttctaacaccccagccttgcctcagatctaaattctctccctactaggaggaataaaatgtaccaagtgtataaaaatagctgcaaatactcatggagcattgtgcgccagatgtggtgtcagctctgtccatgtatcagcccctttactcctcgctgtagcctgctgtgaggaagtggcagggggaacgggggggccggggggacagacaagagggtcaaaatcatagaaatgcattcagacttgagcatcctgaatccagactcatgttcaccaccgcaccgtgctgccacccacttttccatttctgcccaaataggtcttgtttgttcttgttccttactactgtttttgctgccgagagtctgtgcatctactcggttcctttggcagggaagtgccagcatttcactccttaattacaaaatgccatcccagtcagttgatatgtcccttgttggccgttacagtgaactgtgatcatccagattttggcagcttataggttcttagttgatataaaaaagaatgccaaagcatgggtaaaaatacatgacataactatgtaaacaagtagaagaacttagggttcttctaagtagggtcagagccaagatgagctagcaaaaaaccttgttacttttttttttttgagacggagtcttgctttgtcacccaagctggagtgcagtggagcgatctcggctcactgcaacctccacctcctgggtttaagcaattctcgtgcctcagcctcccaagtagctgggattacaggtgcatgccaccacacctggctaatttttgtatttttagcagagacaggatttcaccatgttggccagagtggtctcaaactccacacctcaggtgatctgcccacctcggcctcccagagtctcaaacttctgacctcaggtggtccgcccacctcggcctcccaaattgctgggattacaggcgtgagccactgcgtccagccaaaaccttgttactttgagcagtcagcaaagaaatagtactttatccttccccctttctcattgatcttcccagaatttttttactctgaagtaagcaattttaacactcacttcttgcctggtaagactaatgtcatagaagaaagaatcatcaggggttggatcgctctctccatctgctggcccagtggattcgatgtcttataaatctttttggaagtagttgggacatacatttatatgttaagtatttataggggtgatgataaggattaattttaaaaaggtaaaacattccttctgtaatgttttgcagacttctgagaaaagaactgtttgagatataaagaactgctttttgcgcgagtggcataaatgagtgaagtgagaattaccgtgtgtgaaaagataactgttgggtggtgggcttaatgcatgggtgatgaaataatctgtacagcaaacctcctgtaacagaccttcatatgtacccccaaacctaaaataaaagttaataaaaatcaataaatcaataaataaaagctggaagttgatctgaaaaaaaaaattaccccatggtaaaggtaccgcagaagttatccggaggaaaatgtttctaattgtttcctaggaagttgatgactagaaagaaatttggtggttttgtgtttgttttttaactgtaaatatttcagtgaaggaggtcaaatcttgaatgtcacaagccttatatgagtagagaaagggaaaattagtgaatagtgaaaaacgttgacattgactctcctgtttttgctgattgtcactgcttggggttgaaacatagaaacagtggaaaagaaatcattctggctgggcacagtggcaagcacaggtaatcctatcactttggaggccgaggtgggaggcttgtctgagcccacgagttagaggctgcagtgagtcgtgatcatgccactgcactccagcctgggtgatagagtgaaaccctgtccctctcttctctctgtctctctctgtctctctctgtctttctctgtctctgacacacacacacacacacacacacacacacacacacacacacacacacagtctttccaccatatctatccctaagatcccccagtgatttcccttctcacacagagtaaaatccaaagcctctgaccatggtctacaaggccctgcatctcacgtacactccacatactacacacacacacaccacgcgctacacacacacccccacaccaagcatacatgcacatacgtgccccattctaacttaatctccctctacttgtctacttcccctaactcatgtactggactcctgttctttgcacgtaatactccctcctgccttaggcctttgtacttgtttctccccttcggaccactctccccactagacagctgtatggccggctccctcactctcctcaggtctatcagagggtggccactgacctcattgtctcaaacattatatagaacacacacgcacccatgcacgcacaccgtcgttcttcatccgcctggttccgtgcactattccaggacctacagcagtgcctagaacacagaacatccattagcaacatttgtttaatgaatttatagtgcctaaacctgcacaactctgactttgccttgctattagaaaatgcaaggccaggcgcggtggctcacacctgtaatcccagcactttgagaggccgaggtgggcggatcacttgaggtcaggagttcaagacaagcctggccaacatggcgaaacctcttctttactaaaaatacaaaaattagctaggcatgatggcatgtgcctataatcccagctactagagaggctgaggcaggagaatcacttgaatccgggaggcagaggttgcagtgagccaagatcacaccactgcactccagcctgggcaacacagcaagactctgtctcaaaaaaaaaaaaagaaagaaaatgcaaattccaaaggctgcatttgagaagtcagtaaatgggagagtaattatagaagaaactgaaacagagtcgctttaagagcaagttttgttagtgcatttaaaatgggattcagtctgcacagatcggatgcacgtgtaatccctaggcacatttacattgtgttttcagaaggatgcagctctgtttctattatgtgaagtaattacttggttacattggactgctaatgtagttatcagaaagtggtttgcatattctcccagagggaggtataattttctagatgctcttaggacttcaatatgacatatttccaagattttaggatgtcacagttgtaaaagcatcatgaattttgtacagctgagggaaaatattaaatactactttaaatatttagaaatatttcttttttgttttgttttgtcttgttttagacggagtctcgctctgtctcccgggctggagtgcagtggcgcgatctcagctcactgtaacctccatctcccaggttcaagtgattcacctgcctcagcctcccaggtagctgggattacaggcacccgccaccatgcctggctaatttttgtatttttagtagagacaggattttatcacattggccaggctggtcttgcacgcctgacctcaagtgatctgcccccctcagcctcccaaagtgtagaaatatttctccatagcataaatttatgcatgtactatattccgctttctccttcagtatcacactcaaaatttgaatctacctctttcagtttgaatctaaaaattcttgtaaatcagtttttgaccattgacacttaacgcttgtattagtgaaactggccacttttcttacttgtgatcatgatttactctggcacctttaggattaatattataattttgaaacacattgacaaatactgaggttgatgctacatttcctgtttggttaaagctttgtttaactccccccatctgccgccttgcaagtcagcttgtttggtgcctggctggtgatcactgtgttagtccatttgcattgccatacagaaagggtaatttataatgaaaagaggtttaattggctcatggtacctcaggctgttcaagaagcatgacaccagcatctgcttcttgtgagggcctcagaaagcttccagtcatggcaggaggtgaaaggggagcaggcaggtcacatggcgagagcaggagcaacagagaggaggaggatgtcccagactcttttaaacaaccagatctcacgtgaactcactgagtgagaactcactcatcaccagggggatgttgctaaggcattggtgagggatctgcccccatgatccagtcacctcccactaggcccgtgctccaacactggggactgcatttcaatgtgagatttggacaaacatcccaaccatatcaatcaccaaaacacactgagctcttttagctttgaacattctctcatagatcctgagtgcctttccttgcattgcctggcacaagaaaagcaatcgtctacatagtcttctacatacattgtcacttttcatgtgtgagtgcacggtttgtgaaaatatttcaagtggcagtgagggtttcaaatttaagttaaaatgaagtcggatgtattgctaggaatgggagtaatttcagtggcagttgcatgagccagcgccatctaagcctgctgagttcacaggcacgctcacatgctggctgggggtgctgcatcagactgaggcctggcagctggcaaggacctattgacatcaaacataagatgcttttcggccggacgcagtggctcacgcctgtaatcctagccctttgggaggccgaaatgggtagatcatgaggtcaggagatcgagatcatcctggccaacatggtgaaaccccgtctctactaaaaatacaaaaattagccaggcatggtggcgtgtgcctgtagtcccagctgctcaggaggctgaggcaggagaatcgcttgaacctgggatgcagaggttgcagtgagccgagattgtgccactgcactccagcctgggtgacagagcgagactccgtctcaaaaaaaaaaaaaagaaaaaaaaaaaaaaagatgcgtttcttcccagaaatgtaaagatgtgagaagaatggggcttattatcaagaaatagagtttcatattttcattttaaacatgaagaagatctattttcattgtcatctgcaagagctgttcataggaaaattaccctcaattgtgtgtaggtacaagcctgttttagcaaagttcatccttgcaaagtgcagtgaatatagtcactgagttatgaatgttagcagcagaggagggatcgcaggtcttgaaactaactaaaattgctacaagcaaagatagatatttattttttcctttcggggggttccctgcacttctctcattggttgatggctttttctgtttgttctagtgtgtgtttttcctgtgctttattacagtactcacttttcagttatcaagccagtcagcagataccagatcctgccattaattaataaagtataccaaaaaattagttgctataaagacacaataattggccaggtgctgtggctcacacctgtaatcccagcactttgtgaggctgaggcagatggatcatttgaggtcaggagtttgagactatcccggccaacatggtaaaacactgtctctactaaaaatacaaaaattagctgtacatggtggcgagcgcctgtagtcccagctacttgggaggctgaggcacaagaattgcttgaacccagaaggcggagtttgcactgagcagagatcacaccactgctctccaacctggatgacagagcgagactccatctcaaaaaaaaagacacaataattaattgcctttgtttgttaagggatcccacacggacctgcccagccttgtcatgactctggcgagggctttgtaggtggcttagttacctactcagtcggcagggagttggctgccttgttcctttgactgcttctcagcctcattgtctccctttgctttcacctgtcaggcctatgttataggttgttggagttcaaatttactagactctgggctgaacgccttgaatttcaaagtagcattgtttctccttcttactgaaatactttaataccatactttttttttttttttttttaatagcaggccaggctggtctcgaactcctgacctcaagtgatctgcccgccttggcctcccaaaagtgctgggattacaggcatgagccaccgtgcccagcaaatatcatagtcgctctcttgcccaggctggagtgcagttgtgtgatctcagctcacagcagcctctgcctcccgggatttaagagattctcctgcctcagcctcccaagtagctgggattacaggcacacgccaccatgcctggctaatttttttgtatttttagttgagatagggtttcaccatgttggtcaggctggtctccaactcctatacctcaagtgatccacctaccttagcctcccaaagtgctgggattacaggcttgagccaccgcgtttggccaatatcatacctgtattccaaggtcaattatgtgtagttttccaaagtctaaggacaatgatgtccatacagacatgtgtcctttaacgagagggatacattctgagaaatggatcgttaggcagattggtcattgtgtgaacatcatagagtatacttacacaacctagatcatacagcctactacacacctaggctatgtgatatatagcctgtttctcttaggctacaaacctgtactgcatgttagtgtactgaacactctaggcaattagatgcttatgccaattatggtgagtatttgtgtatctaaacatgtctaaacatagaaaagatacagtaaaaatatggcattataaccttgtgggaccactagggtatatttggtccatcacagagtgaaatgttgttatgtggcgcatgtgttacaaatgtgttccaaaattagttatgcatatctatctgtctgtaaaacatgtcaattcctcttggtcctgttagtttctagacattaattgtgtgtcctgggttgaagtagggatgtgtctctcacattcctgatgttcccatactttttttcttttattttaggacagcgtctctctttgtcgcccaggcaggagtgcagtggcatgatctcggatcactgcaacaacctcctcccacggtcaagtgattcttgtgcctcagcctcctgagtggctgggattacagacgtgtgccaccacgcccaacaaatttttgtatttttagtagaaacagggtttcgccctgttggtcaggctggtcttgaactcctggcctcaagtgatccacctgccttggtgtacgaaagtgctgggattacaggcatgagctaccatacccggccatattaccatcctttatcatcttctgtatgtaggttttttgccaagtttatgttttctcattttcttcatttcagtactccttactttttcctgtcgtaattaatccgtatgtgtcttttatgtatatcaaatccgtttgtgagttaaacaccagatttgttatgtggcctgtcaatggttgattttaactttgtttaatgtcctcaaatttaacccttgtgcttatgtttggtttttatctcagaggatagttactactaacataacagtgcttcacagtatagactgctgatattttacaaagcacctccacattatttcattaaaaccccactgcaaaagagatggaggttctagcttcaggtaacaagtaagcagtggggttgagactagaacccacgtctggttactcctagtacaatatttttgttttgtcttttactatactactttacctttttcactgatagttttagagtttttatgtcgatagcaaatatgttcatgtctcctcctaactggagagtttcttaacctttggttctattgccaaatgttagatgagggcttttgagatccatggtagaagtcacaaagatgagggctattttgtcagtcccttataacttttcccccaaagagtttgattacagcagtagcatagtctggctttaacctacagccctctgagtgatgccattctttttggttaaagtacctgtgatgtcccttccaatgcttaacacttggtaccagttcttagtgcttctggttttctaagttgccacctgcagtaagaagcagcccttcttaggtccctgaaatgttaccaaaagttactattgttggctttggagcaggtgaaacaagcagtcagggtggatcttggccgcatgggtgtttgtgctttgttatgtgtacagggatcctaacaggctttctgctgcagaaatgcaaactctgccaaaaataatcaagagataagaatcagaatttcttcttgtcttctctgaagtttgggagcctctggtggagcaagtaattgggattcctacagtgaccatttcaccattgaaacctgcaaagagacagatatgctgaactacctcatcgagtgtttcgaccgagttggaatagaggaaaaaaaagcaccaaaggtaatatgaaatggattaacttaaaaaaaaaaaagcctagttatttgtttgattatccccacccctggagcattcattgatttattcaatcagtaaagcaattattgagcatttgccatgtgccaggcacaatactaggaacttaggatgtgtcgatgaacaaaacagagatccctgccctcgtggaactcacattctaatagagacagagccaaggtttgaacctagatggcctggcttcagagtcctctcttgaccacactgtagctcggtaccgccagtgactcatatggccctgataattctactgctttgttataataaccaacattatagagcctctgtagattgccaaggactgtgccaggtcgacattagcttgtatcctcagttgctctgttagtgcagtggaacccggtataacataggcattcttttttcaacgtatgactaagcaaatgactctcagagagattaagtacttgtccagaatcacgtaaataataagttgcaaggctgggcttaaactcagtaagctacccttttcccatcacttctcttgactggcttcattgttttctcattttattcctatttcattttctgattttaattttacgttagaaacgaacctcgttgcccactggttagtttcatatttgtaaagggccttctttgggctttgttgtacttagccttagtggaagcgaaatgagtgggcatgtctccaaggttttttgttttttttgttttttgagatggagtctcgttctctcacccaggctggagtgcagtggcgctatctcagctcactgcaacctccacctcctaggttcaagcaattctcctgcctcagcctcctgagtagctgggattacaggcacctgccaccacacccagctaattttttttttttcttttgagacggagtttcactcttgttgcccaggctggagtacaatggcacaatctcggctcaccgcaacctctgcctcctgggttcaagtgattctcctgcctcagcctcccgagtagctgagattacaggcatgagccaccatgcccggctaattttgtatttttagtagagatggggtttctccatattagtcaggctggtctctaactcccgacctcatgtgatctgcccaccttggcctcccaaagtgctgggattacaagtgtgaaccactgcacccggcacacccagctaatttttatgttttttttagtggagatggggtttcaccatgttggccaggctggtctttttttttttttttttttttttttttttttttgagatggagtctcactctgtcaccaggctggagtgcagtggtgcaatcttggctcactgcaatctctgcctcctgggttcaagtgattcccctgcctcagcctcctgagtagctgggactacaggcgtgcaccaccatgtctggctaattttttgtcttttagtagagatggggtttcaccatgttggccaggatggcgtcgatctcctgaccttgtgatccgcccttcttggcctcccaaagtgctgagattacaggcgtgagccaccgtgcccggcccaggctagtcttaaacttctgacctcaagtgatttgcttgccttggcctcccagagtgctggaattacaggtgtgagccaccgcgcctggcctctaaggttcttaagtataagtttggtcacctcaaacttacgcttctttcttctctgacatcagtttctgcagaggcagtacacttggaaggcacagttactgtagctcgttcactaagaataaaggaagaggaaagcacgctgtttactgatggtccatcccttttaactcttatttttaacagcatggaattgtattgtttgtttcttgtcgtcctcacttccacctttccttttcagatgtgcagccagccagcagtcagccagcttctgagcaacatccgctcacagtgcatatcccatactgctttagtactacaaggctccctaacacagcccaggtatgaagacccgtgacgtgcttgacattagcaggcagagagccctagccgtcagtggacatcaggctctctggccattcttgcaccaccttagataactcccttcctcacctgtaaaatgaaggtccctttccttcgctaaaatactatgaaaataaacactcctttcttcctcatcttctaaagtagtacaaagcatattttaaaaagaaattagttatgttttaagaattctgcctgctttttgaaatagaccattgttgaactatgtggacaagcatggcagaaaattagtaactgactatacagcaactgcctgaagttggtggaggtatttgataaaatgtgtagatcatcaccttccatgtataacacggtcaatttctgttactgagtaataaacaatagtaatggaatggatagtttaggaatcaaccaaagtgctacattatttgcttctgagaatcctataaaggttgcaaatttttgtttttattttgtttttaaaaattttttttctttgcctctcagtcttctaaaggtagcaagtttttaaaaaggatgtgtatttcatttcttttatataaaaaatatctaaagggaaaagcttacatttaaaagtttaggccgagcatggtggctcacacctgtaatcccagcactttgggaggctgaggctggcggatcacctgaggtcaggagtttgagactagcctggccaacatggcaaaattccgtctctactaaaaatacaaaagacttagctgggcattgtggcatgtgcctgtaatcccagccacctgggaggctgaggccagagaatcgtttgaacccaggaggtggaggttgcagccgagatcgtgccactgcactccagcctgagtgacagagcaggactctgtctcaaaaaataaaaattaataaaataataaaaaattaaaagtttacaggccaggctcatgcctgtaatcctatcactttgagaggccaaggcagatggattgcctgagctcaggacttcatgaccagcctgggcaacatggtgaaaccctatctctactaaaaatacaaaaaattagctgggcatggtggcacgcacctgtaatcccaactactggggaggctgaggcacgagaattgcttgaacccgggaggtggaggttgcagtgagctgagatcacgccacttcactccagcctgggcaacagagcaagactgtctcaaaaaataataataatactaaataaataaaaattcacaaacataacattacatttatttattctaggtgttcttatgttattttgtatgccataaccatatgtttttgaaacttttcaaaaagaaggaaaattatatacatgtaccaaaactttaaaaaacgttccttgattaaaattaataagccctcagccactactaatattttttcccccaatttagatgaggcataaagaaacatataatacggccaggcgtggtggcttacatctgtaatcccagcactttgggaggccaaggcaggtggatcacctgaggttaggagtttgggaccaacatggtgaaaccccatctctactaaaaatacaaaaattagccaggcgtggtggcaggcgcctgtagtcccagctacttgggaggctgagcaggagaatcacttgaacccgggaggcggaggttgcagtgagccgaaattgcgccaccatactccagcctgggcaacagagcgagactccatctctaaaaaacaacaaacaacaacaaaaaaaacatataatacttcttttttatttttatttatttatttatttttaagagacagaatctcactctgttgtctaggctggagtgctcactataacctcaaactcctgggctcaggcagtcctcctgcctcagccttccaagtagccaggactccaggcacacaccatcttgcccagttgatattttcatcttttgtagagacagagtcttgctgtgttgcccagactggtcttcaactctgggcctcaagtgatcctcccacctcagcctgccaaagtgctggtattgcaggcgtgagccaccgtgcctggccatgcttccttttttcagtgcttcatttttaaagggctctatgtaggaaaagatgaattctttgaaaattcccatagtgtctcattaaaaagaccaaaaagtgattactattggtaagaagggttagctttcgcctgaaactattttgcagaatatttgggagatgtcaagtttgacttttgactgggcagttgttgctgacatgacatttcacgtgcctctgtagtgagttgacttcatcaccgtccctaatgttcatgggtccacaggtccttgcagcagccgtccttcctagtgccgtatatgctgtgtaggaatctcccatatggcttcattcaggaactggtgagaaccactcaccaggatgaagaagtgttcaagcaggtacggtcgtatgagtttgctcttgcaaattttagcctgagagcctctatgtcgaggctaatttctgaccattgaaaacttttgcctgaattcgaacatccatgtgttattagagagaaggcctacccaatattcttttgaggaaatcagattgacagctgcattgttcaaatcatgtgcccatttcaacgaatcagtcaaacatctatcttctaaacaaggtctgcactaggtgcttcgggcaatatgaaaaaaatatgtaaggccccgttcctgatttcaaggagcttttaaaacaagaatacccagagacggcataaggcatgatatgcatttgccagataagtagtgtcaaaaattcattctctgagtttgtaagattaacttaatgaccatattagctcattggcagcctgcatgccatatagaatctttgtcttcttcccactaggaaagatgtctcatatcttcctaattatttcatttggtatttatacattgttttggtatctcattgtgtaaagccaggtgaaaatgcagatatgtagtgcttaaaaataaagctgtgtacgtagtcttgaaggtttcttccaaggtgaaactttgttgttaacattgctgtttgaaggacctgtttgggaaagtaagcactttgcctttagcaactgtcacacaagttttttccctgatgaaagggcttttatcaaattttcttacagtttgctgtatcatcacttccttttttgtgactacagagaataacagaggcaatagctataattggtatgattcctttcactctgttttatacctaagattatttataactgttaattttaagacctttgaattcttgggaattgtgttttcagcagtcttcaaaatatttgtaaaagaagcagccaggatccaagaataaaaattccagttagtgttgtgtattctgtctggaattcactagctgtttatcttaggtgatgatcttactgactaatggaaatattaatggcaacatagtgagcttttcttctctagaagggtaagtgaactctcaggaaaataaatcactgtcggccgggcgcagtggctcacgcctgtaatctcaacactttgggaggctgaggcggatggatcgcctgaggtcaggagttcgagaccagcctggccagcgtggtgaaacccggtctctactaaaaatgcaaaaattaactgggtgtggtgacgggtgtctgtaatcccagctacttgggaggctgaggtaggagaattgcttgaaccaaggagacgaggttgcagtgagccgagattacaccactgcattccagcctgggtgacagagcaagactgtctcaaaaaaaaaaaaaaaaaaaaaaaaaattactgtcttggaaggtttgagtgatgcactacattaaagaggtaatgggtagtaattagaatacttttcctattcaagaagataccatttgaggaatcgagtagttctctctatataaaatcagcccagtgaccagctgaaaggggtatattgagcctactttattcataaacaaacttacacaagaggttatgaaatgacctctgggtgttttttgtttgtttgtttccccatcaccagctttggacagagaagtcctgcattttttaaattaagatgaaattcatataacatcaaaccaccgttgttgttttgttttgttttgttttgttttttgagatggaattttgctcttgttgcccaggcctaagtgcaatggcatgatctcggctcactgcaacctccgcctcccgggttcaagcgattctcctgccttagcctcccaagtagctgggattacaggcgcctgccaccacacccagctaattttttgtatttttattagagacggggtttcaccatgttggccagactggtgttgaattcctgatgtcaggtgatccacccgcctcagccgcccaaagtgctgggattacaggcatgagccagcacacctggcctcaagccatcattttgaagtgtacaattcagtggcatttactacattcacagtgttatacgaccaccacagacctgtttattctattaattaattaattaattttgagggtgagtctctctctgttacccaggctggagtgcagtggcgccgtctcagctcactgcaacttccaccttctgggttcgagcgattctcctgcctcagcctcccaagtagctgggattataggagcgtaccaccatgcccagctaatttttgtatttttagtagagatgaagttttgtcatgttggccaggctggtcttgaactcttggcctcaaggctggtcttgaactcttggcctcaagtggtccgcccacctcggcctcccaaaatgctgggattacaagtgtgaaccacagcgcctggcccagacctgtttgtttttaatcccagaattctgctgacttttcagccactcagtgttgaatactctttgtcttttcttatgtgctaccatgtgttttatctagagaggaatgataactgggatggagctgttggactgcaaagcagcattttacctttttgtcttgaaagagtggcaaatgtgaattattaaatctttgactgaaatatctacctccttttaatgtttgagaaatgttcacagataaataaatagcagctagaatttaggactggaggtggatacttacagtatttttaatcagtgctaggaggtattcatttgaaaattgaagaattatttaaaatatataggtcaggccaggcatggtggctcacgcctgtaatcctagcactttgggaggccgaggcaggtggatcgcctgagctcaggagttcgagaccaggctgggcaacatggcaaaaccccatctctactcaaaatacaaaaaattagctggcgcagaagtgcatgcctgtagtcccagctacttgggaggctgaggcaggagaatctcttgaacccgagtgatggaggctgcatttagctgagatcgcgccactgcactccagcctgtgcgacagagtgaaattgtgtctggaaaaaagaaaaagaaaaagaaaaagattatgcttagtaatattttacctgtgcaatgcacaaaaggataactatacaagaaagtgtaattatattttacttgtagcctccctaaaaaaatttggagatttttcaggacaaccagttatgaactaatttttggtgattctggaacctctgtttgtcttttcttcctcattacaatgttggcattccccagctccacacctgagtgttacttctccatttttatctggcatatgagagcaagttacatctaccttgattgttggtattgcagaaaccatagaatgatctcttccagagctgtattgatatctcacaacactccacggacactttgtcatccagggcacctgtgttttatactgtgctctttaaattattaaggtgctcatggaatgaaattagtaggaaagggaatttttcaagttttctagtggctacatagtatactcctattacaacttgttggcattcagattgtcagctgttgtttacaacatttctatttaatgttattagccttgaatcccaaccaactccctaaatgtgttgatcagtgcttgcattgtgaaatttgaagatgagctaggctgagtaaatcttacatggtgttacctggtattaatcataaatgtataaaagcagatttgagttcctttaagtgccaatagcaggttaatgtattaattacactatatgtggaggtaaggctttctaactaaagctttctttgtaaatttcaacatttaccaactagctctttgctctaatttaagtttaatgtagtaataatgttgattgttggcctgtttatcttgttttcctcaaaataaatggggaaaagcttttaaaaaatattgatagagggccaagcgcggtagctcatgcctgtgatcccagcactttgggaggctgaggcgggtggatcacgaggtcaggagttcgaaaccagcgtggccaacaaagtgaaaccccgtctctactaaaaatacaaaaattagccaggtgtggtggcacatgcctgtaatcccagctggctcgggaggctgaggcaggagaatcacttgaaccccagaggcacaggttgcagtgagccaagactgtgccattgcactccagtctgggtgacagagcgagactccgtctcaatatagatagatagatagatagatagatagatagatagatagatagatagatagaaaggaggaaatattggaacatttaattgaattttttaacaggttatagatgcttggtaatcaagaacatattagttgctgagatgtgcagaatttaattgagtagagcaacgactcctggagagttcttcaacaggctccaaatgtatgggttttgttgaattactgggttttgttgaattactgggggtcctgtcagagtattagagttcaccaaactcctcttacttctggagaattcagctgtattactttatggttagacttgtcaaagaacaggtcaacactctggctgaattctagacttttatatgcaaaaaagcttttccctggggaaggaatgaaatttggacattcagttctagcaccttatttgacatacttcccactcttagattctcttaaacttatatttctgattttgttttttttcttatagatatttatccccattttacaaggcctggctcttgctgccaaagagtgctccctcgacagtgactactttaaataccccctcatggtaaaactttgttctttttctttaactcattcaatagatgtttttctttcagattattttgacatatacttttctttcaggtccatgagatcaaccttgttttcaaatttaaaacatgaaatcactgtgttggccatgcagagtgtttggtgtgcagtgagatgcatcagtgaagacagttagcagcctggtacatcttccacctatccaagtcctagacaggagttaaatgcacttattacaatgtactttgtatagcttatgaaaaagataacttatctcctagcaatgagcataccatagttgggatgaaattttgttacttaaaaaaaaaaaacctattaaaaatgcaaataaaaaaggcaaagctgtacatactaagaaaatgaatacaattttatctttatgtgtttactttgtgcagaaaatctcagtgtagctctcttgttcaccctccctgtttcctaaggtcatatttacttgggaagtagaaatctgcttagctctttaacgcacttagagcaggcatacattgtggacagaagcttcagctagattcccatggggaggcttgaatgttgtgaaaatgctgaaactagaatgaaaattagaagctcctttctgttctgaattcgcttatttgaaattttgggagaaaagtattttgaagtgttactgaatattttcgttgcagaagtgtaaaggaaaaaatatcaaaatgaaattagtttattctatgtataaattaagtcttatgtaaattgagaccatggttgtttttcttactgtatttatttcttttacttattccactgattggattccattataccatgaattcattactgacgatctgttctgtgctagacactggtgatacagaagctaggaagacaaggtccctctcctcaaggcactcataatctactgcaaaaataagagctacagcgcaacagttgaacagatactgtgataaatgttaaaacagagctgtacacaaagggtgtatttatctatttaaaaaattcaaacctgtcatggcactaaaaggctacaagaatgctgggaaattagaaggtgaaaccagaattcctactttaaaaaataattttaagtggatttatgccagagctctttccattgtacatgttattggggctcctggtaaaattatttgaatccttatgtattgttctccctgtggcagataaaaggaagtggaataatctgattgtttgagttcagtgatgaaatattttagtgaacactaattatcaccatattatgtagatgttccttcatgggactgttggcttttgggttgtggtgtgaattagcttgatgtttcagtgaggagcttttagcatctgatatcaccaaaatgtccttttgttcaaaagacagaggcctccattgtggtagacagtgatttcattttgtgccattattgatgcttgcataataacgaggacacagtgagtgagagggtacaataatgagaggcaggaagcggaagactgttgaagctaaaatcagaaatcattgtgatcattctctaggtcagtggatcctgctgtgccatacgttggaatcaccttggaatcagctggggatctttaaaggtgtttctgcctggctccccaccccagaccttgtgatttaattcaccaggggtgtggcatggcattggggtttccaaaggcttcccatgtgatcctaatatgcagccacgtttgtgaactcctgcactaggcagtgagaacgcttccttctgagttgaggctgcctgaacctcaaaggcatctcaacgttgtgtcaatgcctaaatgcactcttcggctcatgtagcaacttctagagctgcgtccgaatcacagaggaaattaactgttgaaaataatgtttgattgagttaccatgggcatgctaaattatgtttatgtccctaaaaagtgtttttcatcgttctctaatgttaggatggttggatgtctgaaggaaagtgttggaattcttaaaagtactagaaatcttgaaaccaagttatgtttttaaatatgttttgaatttgatagcttattaaattgtaattatttatagtcatgtttaacactggcaagaggagccatctaaagtttatgaaataaatctttttgacatggaaagatatgaagtggaaaaacttttttgtaaaaaacatatatagatacagtacacaaaaatatatctgaaaactgttgctcaaaatatcaatagaggttatctttgagggtaaagcttgagtaatttttagtttcattttatatttctgttttatttcaagttttcacattgcatgtgttttagtttattaatcagaaaaagtagtgaagctgctgccatttcagagggaatgcatgtgtgccattttagagggaacgaatttatagcagcagttaaaactgtttctttatgctacaaatgacagtcagtttaagatgaaatgcatttaaatgactctgatcttatttctaggcactaggtgagctctgtgaaaccaagtttgggaagacacaccctgtgtgcaatttggtaagcactcacctgatgggcttgcacattttcagtgaatatatcataacccagaaggcattcctctagtgagatggcctggaaaatgtctcttgaaggacatttaggtgtaggcggaggtaacgtgtctgggaggctctcaactgttacatttttgttagacacgttatatcctgcattacagttgttcatttctatgatttttttcccttttttttctaagaatctcactctgtcacccaggctggatggagtgcagtggtgggatcttggcacactgcagcctacgcctcctgggttcaagtgagtctcgtgcctcagcctcccaagtagctgggaatacaggcatgcattaccatgcgaggctaatttttttgtatttttagtagagatggagttttaccatgttggccaggctggtctcgaactactgacctcaggtgatccacccgcctcagcctcccaaagtgttgggttacaggcgtgagccaccgcaccgggcctgttttttttcccttgacaagtattgtacaactaaactaacaagaggtatggaaaagttattcgagtcctttggtggtataagaagagttcatttgaacttcatccaatagtatcctgaaacttaaacattcttttttttgagacagagtctcactctgtcacccaggctggagcgcagtggcgcaatctcagctcactgcaacctctgcctcctgggttcaagcgattctcttggcctcagcctccccagtagctgggattacaggcgcacaccaccacgcccggctaatttttgtatttttagtagagacggggtttctccatgttggccagggttgtctcggactcctgacctcaggtgacccacccccacccacactggcctcccaaagtgctgggattacaggcgtgagccaccatgcctggctgaaacataaaagttttaataatatcttgtgaaaatacagaggagctggagagttttcattacatttttaccccaccggcctgttcagcggcttgactggctcttccatcttctgcctaggttgcttctttgcggttgtggttgccgaaatccttaagtcctggctgtgggcgggagctgcagagactctcttacttaggggctttctttagcttctcagtctttgcagaagatgatgtaagtatagtggctacttgtactttgctgcccttttattcagattctttcccaaatgtgcattatatgttgactgcattttttccttctctttccaggttaaagtggttgaaaaatacttctcagggcctgccattaccctggaaaacactcgtgtggttagccaatcattgcagcattacttagagctcggaagggtaagtgttcagaaaacaaatccagaggaagtatcaaagatgagctccagatacagagcttttattttgtagactggactatgcccagtagacaaacggctaacaaaagccaattcgatcttacataaaaaagataaactataagtaagtagcctgtgtcttgaataacaggttgtaacaacagcagtatgctgcctttgtatgtagcatcactgggaactggtcctaagcttagtggcccggctcctcctccagctggcccttaggcatttacactgtgagggtgagcaaggattgttagtttgcacacaccctcactgacttgcttatcccaaatgcagattaatatgtcttcaattctcaaacttaaaggcagagaagggccgggtgtgatggctcatgcctgtaatcccaacactttgggaggccgagtggggtggatcacctgaggtcaggagtttgagaacagcctggccaacatgacgaaaccccgtctctactaaaaatacaaaaattagccaggcatggcagcgcgtgcctgtaatcccagctacctagctactcgggaggctgaggcacaaggatcacttgaacccaggaggtggaggttgcagtgagccaagatcacgccactgcacatcagcctgggcgacagagcaagactccatctcaaaaaaaagaaacaggcaaagaagttacaggcttgggtaactaaggtaattttgatcatgggaaagaagtaacaaagcctattttattaaaactgtaactgccggctgggcgtgttggctaatgcctgtaatcccaacactttgggaggctgagatgggctgatcacgaggtcaggaagtcatcctggccaacatggtgaaacctcgtcactgctaaaaatacaaaaattggccaaggcaggtggatcacgaggtcagcagtttgagaccagcctgaccaacatggtgaaaccccatctctactaaaatacaaaaaaaattagctgggcatggtggcgggtgcctgtaatcccagcgacttgggaggctgaggcaggagaatcgcttgaaaccgggaggcggaggttgcactgagccgagatgtgccactgcactttagcctgggcaataagagcaaaactccgtctcaaaaaaaaaaacaacaaaaatgcaaaaactagctgggtgtggcggcgtgtgcctgtaatcccaactactcgggaggctgaggcaggagaatggcttgaacctgggaggcgcaggttgcagtgagctgagattgcaccactgcactccagcctggcaacagagctagactctgtctcaaaaaaaaacaaaaaactgtaactgcctacctcccccactccatattctgctttcatgctcattactttgacatagttggatgtggatatttcttatattctttcactcaggctcttctaaaatgagtagaagtgggagaggagagaacgtgggaagtaggctagctgttcgtgaagtcaaaaaggaatcatgtgcaaaatagttttaatttgtttcttctttttaaaaataaatttcagcaagagctttttaagattctgcatagtattttgttaaatggcgaaacccgtgaggctgctctcagttacatggcggctgtcgtcaatgccaatatgaagaaagcacagatgcaggtaggattcctacagactgcttttcgctgtttgtcaaattcattcatctgacccagatttagtcagcacctaccaggcactgttctaggagtgggggtacagtattgaacaaggtagacgagcttcctgcttttgtggagcccatgttccacagaataaacaagtagacatataaatacatgattttagacagttgtataatcagtgaagaaaatagagcaaagtaaatgacatgagaagaactgtaggtaccagaaggaagatctgaaggtgatttttgattgggtggcaggaaaggcctccctgaggaggtgacatttgtttcataggaaggagccagccattgtagtggctgagaaaagagctatccaatgtggaaacgaagcagctttggtacaagcccagcacgcaggcttttgtggctggagaagagtgaacaggagggaatgtcgggtcctggagttagtggataggcagggcgccatcgggttaggtttacgtgatcagaactgtcatgggagggttttcagcagggaaaccacaaaagctgctatgtagacggaccaaaacagaagggggcagccaggaacagacccaagggggcagccaggaacagacccaagaaggcagctgcaagggcgtgagtgcttcggtccgggtgagacaggccagtggctgcagctgctttgccagaggagaaaagggcatccttccttgactagtaataaataatgaatgaatgatgtgatgtgtatactcagaagcaaaaatcatgtagagagaagagcacagatcttgtgatttctgatcgtggttccaccgtttactaactgcgggaccttagacagtgactcctctgtgcctccatttcctcatctgctaagctgcggtactactggtactgggtttattatatataaagctgttagagtggtgcctggtacacagtgatcactcaaccaatattaactatcattcttatcattgttgtattattatttttttcttaacagaggtaatcaagttacattgttatattgctaatgcaggagcatgctgatgctgtcacctagagaaacaatgtcacatgataagaagtggagcaacttgttttgatgctcttgagggaaataaagaggagaaagaggccgggcatggtggctcacgcctgtaatctcagcactttgggaggccgaggtgggaggatcacttgagcccaggcatttgagaccagccctggcgacataatgagaccccatctctacaaaatatacaaaagtcatctgggcatggtggctggtgcatgcctatagtttcagctacttgggaggctgaggcaagaggatcacttgagccagggaggtcgagaccagcctgggcaacatagggagaccctgtctctacaaaaaaaataaaaaattagccagtatagtggcatagacctgtagacccagttattcaggaggctgaagtgggaggatcacttaagcccgggaggttgaggctgcagtgagctatgtttgcaccactgcactacagcctgggcaacagagtaaaaccctgtctcaaaaaaaaaaaagaaagaaagaaagaaacatttattgtgtttctacttactaattttgagcctcaggcaaatcacttcagggtctctgagtctttatttcctcctgcataaaatgttaacagcagtattactgacctgtaagaattatcgtgatggttcagtaaaagaatgtataaaatggccaagcgtggtggctcatgcctgtaatcccagcaatttgggaggccgagacgggcgtatcacctgaggtcaggagttcgagaccagcctggccaatatggtgaaaccccatctctactaaaaatacaaaaaatttgccgggcgtggtggcgggtgcctgtaatcccagctactcgggaggctgaggcaagagaatcacttgaacccgggaggcggaggttgtagtgagcgaggatcgtgccactgcattctagcctgggcaacaagagtggaactccatctcaaaaaaaagaaaagaaaagaaaagaatgtataaaatgcctcttatataaataataattatataataggcggtattcaacaagtagcacctgctaatatagaattaatggaatgacagtggtgatgagatatatgtcttctcattgactttaggatacagttatgtttgaaagttcagtctgctttcttacaaagtttgccaaaatttctattcatgttattttaaatactttttcttggctggtcacagtggctcacacctgtaatcccagcactttgggaagctgaggtgggcggatcactttaggtcccagctacttgggaggctaaggtgggaggattgcttgagcctgggaggtggaggttgcagccaagatcacaccccttcgctccagcctgggcaacagagtgagaccccatctcaaaaaaaattttttttaatgtttaaaaatactttttcttttcaactttcacagacagatgatagattggtgtctacagatggatttatgctgaatttcctttgggtactgcagcagctaagtacaaaaatcaagttagaaacagttgatcccacgtatatttttcacccaagatgtcggattactcttcccaatgatgagacgcgtgtgaatgcaacgatggaagatgtgaatgactggctgactgaactctgtgagtactgtgttcgtgactcggtcattaaaacactgccctcttgtctgtgtgctagtagttcctcacagattgttaccacctcaccataaaatgaacttaagagatagagaaacataataaaaattaatacagtaggcctggcgtggtgactcatacctataatcccagcactttgggaggccgaggcaggtggatcacgaggtcaggagttcaagaccagcctgaccaccgtggtgaaaccccgtctctactaaaaatacaaaaattagctgggcatggtggcacacgcctgtaatcccagcactttgggaggctgaggtgggcagatcaaaaggtccggagttcatgaccagcctgatcaccatggtgaaaccccatctctactaaaaatacaaaaattagcgggtgtggtggcacgcacctgtaatcccagctactcaggaggctgaggcaggagaattgtgtgaacccaggaggctgagcttgcagtgagccatgatcacggcactgcactccagcctgggcaacagagtgagactctgtctcaaaaaaaaaaaaaaaacagatacaaattgaaaaaaaaaatcaagttatcataatatatctataaaaaagccaaaaccaaagtgataaaatagaatgtaagtttttgaagaagtaggtgatatttaatcaatttatttaacctatctgaagtgaattctggtgattcatagcaaaaaatataatactgttgttctcaataattctacttttcaggttatattcccaaagttggaggaaaaaggaataattttgtttacataaatcctcccagtagtaacattatttataatagaaaaaaattagaaaaaagaaatatgcagggaaacggctctggaatcagtagtttattaacataatttaataccatttcgagatttaaatatttctgtattgtgttgaaaaatggagattttatacaatacatcagtaaggaacatcaccaaagattgttgatgggctgggaatggtggctcacatccataatcccagcacttttggaagctgaggtgggaggagagcttgagcccaggagttcaagaccagcctgggcaaaataaggaaaccccatgtctacaaagaaaaaaattagcccagcatggtggcacatgcctgtgttcccagccacccaggagactgaggcaggaggattgcctgagcccaggaaattgaggctgcagtgatctgtgatcttaccactgcactgcactgcagcctaggtgacactaggtgacagagtaagaccctcttaaaaaaaaaaaaaaaaaaagattgtgatggacatctgtatgcacatttaacgaggtaggacagaatacggtggtccttgaatggagctaacaggaattctcttcttcttgtagtattgtttaagtttataattgcaaaagtatccttaaacttctggcggggcatggtggctcacgcctgtaatcccagcactttgggaggccaaggagggtagattgcctgaggtcaggagttcgagaccagtctgagcaacatggtgaaacctcgtctctcctaaaaatgcaaaagtagccaggtgtggtagcacacgcctgtaatcccagcttactagggaggctgaggcaggagaatcacttgaacctgggaggcggaatttgcagtaagccaagatcgtgccattgcacttctgcctgggtgacgagagcaaaagtccatctcaaataaataaataaataaataaacaaataaaaagtatctttaaacttcataaaaattcaaatgtaattttctcttctgaattcagctttttctctgattgagacatgtaatagattttatttagggaatgatgttatttttcctagatggcgatcagcctccattttctgagccgaaattccctacggagtgcttctttctcaccctgcatgctcaccacctctctattctgcctagttgccgtcgctatatccgcagactccgggctatccgggagctcaataggtatgtgccatgataccgtgtcctgggattgcctgagttaccactttttctcaggggcaggcaattccattgtgaacagtagttttgaatgttgggggaggtatgtacgttatatagtgttctgtctgcctccaccgccacatccatgttgctcagttgtccagagttctttacctggtgaagtgatccaaaccttgatttctgagagttctgaaccctggatatttcactctgtttatggttactacagacttccattaacttttcccactgggcatacattaccaggaggcacttcaaactttaaaagtttaaaggatcccctgggtttcagacataccccttcttccctggactgtgaaaaagtaaccatggtttcccttgataaccaggatcatttactcctgcctacatgtaattctctttttggcttgttctgtggcatgaggggtccaaaatggccagatagcagcctcaaatttccaattcattagcaccatggttgtgtttcttactctaagcattttttcctgtgtactaacaccaacaaacagaagtcacaggaacacagaagcaaatatttttgagcaggttatctggaataataatgatgccacttctgctttttggtctagaacctgcgtagtctgtctatgagagaaactgaatcatatttatatctctgtatctaccttgcttaaatcacttactaattctttttttttttttttttttttttttttttttgagacggagtctcgctctgttgcccaggctggagtgcagtggtacgatctcagctcggtgcaacctctgcctcccaggttcaagcgattctcctgcttcagcctcccgagtagctgggattacagatgtgcaccaccacgcctggccaattttttttttttttttgatggagtctcactctgtagtccaggctggagtccaatggcatgatctcggctcactgtaatctctgccgcctgggttcaagcaattctcctgtctcagtctcctgagtagctgggactacaggcgcccaccaccacacccagctaattttttgtatttttagtagagacggggtttcaccgtgttagccaggatagtcttgatctcctgacctcgtgatccgcccgcctcagcctcccaaagtgctggaattacaggcgtgagcccatgcacctggcccaattttttgtattttttgtagagacggggtttctccatgttggtcaggctggtctcaaattcctgacctcaggcgatccgactgcctccgcctcccaaagtgctgagattacaggtgtgagccaccgtgcctggcctaaaatcacttactaattctaatagttaactctgcaaattctttatgatttactttctacacataatcatgtctataaatgatgacaattttatttcttttactttttttttcatgccttagtgcccaggctgtaatttttagtacaatgttgaatagaaataaccttgaaatttccatcttgtttcagttggtggaggaaagctttctatatatcctcagttaccagattaagaaaatttccttttatttcaatagttagttcccttagcactggttgaattttattaaatacttttgccatatctgttgaggagactagacttttttcttctctattctgttaatgtggttgaattatatcagttggttttctgttattaaaccagtctttctttcctggagtaaacttaacttttatattaatgtttttatatctaattggatatacaatttgctaatattctgtttaggatttttgcatctgttcaaaagaaagcctgacctgtaattttcatttcttgttaagtgcatctcaaattttggtatcaaggttatgctgccttatagaagaaactgggggctgggcacagtggcttacgcctgtaatcccaacactttgggaggccgaggcagacggatcacctgaggtcaggagttggatgctagcctggccaacatagtgaaaacccgtctctactacaaaaattagctgggcatggttggcgcatgcctgtaatcccagctacttgggaggctatagcaggagagtcgcttgaacccgggaggcggaggttgtagtgagccaagaccgagccactgtactccagcctgagcaagagtgagactctgtctcaacaaaagaaaaaaaaaaagaaagaactggagaatattctcctgttttttatgttccctggaagagtttattgtataagaattatgttgtttcttccttaaatgtcagaaaaaattcagtgatgaagttgtcagggcttaagagttttctgtgtggggatgtttttaattatggatttaagacagttaatatatataagactatttagattttcattacatcttgtgtcagtttttctaaagtttgaaaatgttttggcatgaagttgttcataatatccttttatcattttaatgtctgtaggatccttattatttctgcttttatttatttattttagtttttgagaggaggttcactcttgttgcccaggcttgttgcccaggcaggagtgcaatggtgcaatcttggctcacctcaacctctgcctcccaggttcaagtgattctcctgcctcagcctcctgagtagctgggattacaggcatgtgccaccacgcccagctaattttgtatttttagtagagacagggtttctccatgttggtcaggctggtctcgaactcctgacctcaggtgatttgcctgcctaggccttgctgggattacaggtgtgagccactgcacccggcccattttaattggctttctactgcctcttgagatggatatttagatcatcctttccaaccctttcgcttatgtgtatatttaagactattttgtttccctcttagtgtgaccttagctgcatccctcatttttgttatatcatatcttattactcagttcaaaatgttttctaatttttgtttgttcttatgtaacctgtgggttatttcaaaatatattatttaaattctaggttcttagggtatttgtctatgtatcttttgttaattgatttctagataaattccatcatggtaagaaaatatattttatgtgatttgtgtcttttgaagtttattgaaatttactttatagccttttacattagtagacctgaaaagactgctatctgtgttgtttttacagtgttccacatatattatttaggtcaagtttgttaattttctgttcaagttttccttatatctaatgattttatcagcttataatatcaatcactgagagaagcttataaaaaattcaaactatgattgtggatttatctgtttctttatcctccgatggattacctcctgggatacagtcactcccgctggctttagagggtccatttcaatggaaccatctagaacctttgctcctggcttgcagcagatagcctttattgtgctttccagagacatttatgttcacctcatctgtgtatttttcaatgctgtgatttaagaagtatcttctaggacatagttggggtgtgtatatgcgtattggaaagaggattatctgagcaaatcacataaagtaaatccaccttaattttccaagctctttaagttttgaatcatttcctctgaattagatcaaagaatatttggcaactcagcttcattcagtataggtcactgtcaattcaaagtttgggtcaactagttggttgcataatatgaacctctcccaactcagaataatactgaattcagggtctctggtaggtataatcatgtcagtgattttagccctacatagaagtatatcagcattttcttctcttgctgatcaagcatcctcagaatccattcccatacataatcctacataaccgtcatgtttctgcagtacatatgtggttggtagagtaatggcatctcaaaggtgcccacatcctggtctcggaacctgtgaatatgttatctaacttgattaaagggactttgcagctgtgatatcaggttcatgatcttgaggtggggagattatcctggattatgtgggtaggtccagtgtcattgcaaaggtcttcataagagggaatcaggagggtcacagggagagacggaatgtgatggggaagcagaggttggagtggtttggggtcatgagccaatccggtaacctctggaagctggaaaaggcgaggaaacttgttctcccctagagcctccagaaggaaccatccctgctgaccccttttagacttccagaactctaagactataattgtgtggtttggagccactgaggttgtggtaacttgttacagcagcaatagaaaactagcataacacattagcaaatcttgccattttttttcttcaaatatgtgcttctgttgcatccaattttgtaataatgccataaggacagtccttgatctgactctagctgtggttctggaagcgaagagggatgatgggttagaacctaggggaaaatagcattaccctgcaaggtgactatctctgatgaggtcattatagaaactgcttctgctagcaagcaaggctcagggaatttagagatttaggtacttggagtcagctagttctcccaaactcctccatttgaactctttgggtcccagtctttgccttaactttcagataagaggtccagcaaagttattaatttcttctgtactgtaatttgtagaactggagctgctcctttcctttaacaacagtcttagaaactcctgattaattcacatttcctggagataagaatttaaaatctgaagcctgtcatttttttttttctataagctccaccacataattagaggtagccactccacatcctcattccagatcaccagggatcatgtatatagctgtttttctactcagagccttgggctaccagtgttccatcctcaaatactaattgtatcttcaccatgcagcccaatcaaagaactgatcccagagccccatttttttcatgaaggcctgttacctataaactcttgtgatacccgtagccatataggtcattatcttagtttcctatgactgcaacaacaaattaccacaactttagtcacttaaaacaacacatattacagttctgaaggtcaggagtcctaaaatcggcccagcgcagtggctcacgcctgtaatcccaacactgggaggccgaggtgggcagatcacatgaggtcaggagttcgagaccagcctggccaacatggtgaaacctcgtcactactaaaaatacaaaaattagccggtcatggtagtgcatgcatgtagtcccagctactcaagaggttgaggcaggagaatcgcttgaacacgggagacggaggttgcagtgagctgagattgcgccactgcactccagcctgggagacagagcgagactgtctcaaaaaaagaagatgaaggttgcattccctgcagaggctctaggggagaatctcctttgccttttccatcttctgaaagctgcctacgttcctctgctccttatcaccccccaccccaccccaccttactgtattttcaaagccagcaacatagtatctttagatctccttcgcttgcctggtgtatcgcagcactttgggaggctgaggtgggtggatcacttgaagtcaggagtttgagacccgcctggccaacatggtgaaacccttttctaccaaaaaatacaaaaattagccaggcatggtaacgcacccctgtagtcgccactactcaggaggctgaggtacgagaattatttgaacccaggaggtagaggttgcaatgagctgagatcgtgccactgcactccagggcaacagagtgagagaccctgtctcaaaaaagcaaaaaacaaggctgggcacgtgtctgacacctgtaatcccatcactttgggaggccaaggcaggtggatcatttgaggtcagaagttcgagatcagcctggccaacatgttgaaaccccatctctactaaaaatataagttagccaggcctggtggcaggtgtctataattccagctacttgggaggctgtggcaggagaatcgcttcaacccgggagtcagaggttgcagtgagccagatgatgccagtttactccagcctgggcaatagagtgaggctcagtctaaaaaaaaaagacaacaacaagatctccttctctctctgacctttgcttccattgtcccattgtcacatctccttctctgtctctgagtccttttttctcttagaaggacctttgtgattatattgggccctccaaaatcatccaagatactcttcccatctcaaatccatacccttaatcacatctacaacgtccctttcgccatgggagatcacatgttcacaggttccctcgaaggattcggatgcgacaagtttggaggagccattcttttgtctaccatactcatgtttcagttgtagacgaaagaatccaattcttctgggataagcagaaaggggaactagttggtttactgaatcattggaatggctataatagaagattcccagagctatactttgaacaaggaagctgcttcggaggtcagcctgacagcacagcctctgccacagcttcagccaaaacccctctaccactgtacttccagaaggatcatgcaatcacgcagtcacttcacagtactcactctgccttcagtgagggttcatcttggtgaaaactaggtcttacagaaatgctggcaggaggggagtctaggaaatgtagcttttggagatttagcagcctctagtattacacacaacatcatgatagaaaggggttgaaatagtgttaagagagtcggtcttcaaaatatgcagcctattaggtgatggggaagccttttactgcagagacagatggtgtttgagcagacacctgaggggagtgaaggagcaaagccagagataacctcagagaagagcattgcgagcagagggaacagttgtaaaggacgatgccgttagtaaaatagccttttgttttgggtaattgaataggcaaagtaacctcgaattttcatgagagacttctttttttccctcccagaaaaataagggaacaatgtactttcttgcaacaaaaaagatgattatattcaccaaatctgtagtgccatccattcaaagacacatcattgttttaggaaccaataaaaaagaaaaatatggcccgacgcagtggctcatgcctgtaatcccagcactttgggaggctggggcaggcagaccacaaggtcaggagtttgagaccagcctgcccaacatagtgaaacctcatctctactaaaaatagaaaaaattagctgggcatggtggtgagcacctgtaatcccagctacttgggagtttgaggcaggagaatcacttgaacccaggaggcggaggttgcagtgagctgagattgcagcactgcactccagcctggtgacagagcgagactctgtcttaaaaaaaaaaaaaaaagaaagaaagaaagaaaaatgctgccaattaaactatgatttgccgctggttgtaagatatactctgattttaaagatgttacaatgcgaaaacaaacaactgcgtgtgagagtcagtgaaatgagcaagatgaatgggtaagatggatccggctgttttctttcatttgactgttagtctttgatttcagaactgtagaagatttgaaaaataatgaaagccaatggaaagattccccactggcaactagacaccgcgaaatgctgaagcgctgtaaaactcagcttaaggtttgtatagctaagtggaataattatagaccagcctcatagtgataattttcccaacagaatatatgccttgagtgagcagtttagtgtcctcactttttctttgttattcttttcccttccaataaaatagtatattttaaaacttgttgataccttacttatatgtgtatataatgatttcagtctcaggacagaatatggatagatatgcttctgctgtgattatgaattcttaatgggttttatgattctcagtttaacatcacctcccttggccgggcgcagtggctcacacctgtaatcccagcactttgggaggcctaggcgggcggatcacgaggtcaggagatggagaccatcctggctaacacggtgaaaccccgtctctactaaaaatacaaaaaaaaattagccgggcgtgatggcgggcgcctgtagtcccagctactcaggaggctaaggcaggagaatggcatgaacccaggaggcagagcttgcagtgagccaagatggcgccactgcactccagcctgggcgacagagcgagactccgtctcaaaaaaaaaaagacaacaacaacaaaaatcacctctccttccctgccttatgcagggccctcctcacctgctgtctcccacccctcgccccaacactcatccagtatatctagccatgcatttccatgatatttgacaaagagtatctgtggtagtggaaagatctctttcctttgcccctcattctttctttttaattgaaattgattcatcacacaaaacctaactatagatgggaatattcttgctggtgagacatagctaaaaacatatgccagctgacattgtacaaataaagcatagatagcaaatttatgcatttttcttctattcatgttccagttataaacctgagtgttagctggtcatgcattctgttgaacagtaggataatatgtggaaagtttacctgacatagctttctagtaccagttaagatttcagttttatttactaatagactagacttcttcaagatgcacaattaacaaggggcccttatctggggtctgtgcacccccctaagcagtccacagatgtgtttcaaggggatctataaactgcttaaattgccaggcatggtggctcacaccagtaatcccagcactttgagaggccgaggcaggcagatcacctgaggtcaggagttcgagaccagcctggccaacatggtgaaaccccgtctctactaaaaatacaaaaattaactgggtgtggtggcacacgactgaaatctctgccattcgggagactgaggcaggagaattgcttgaacctggtaggcagaggttgcagtgagccaagatcgcgccactgcacttcagcctgggcaacagagcaagactctgtctcaaaataaataaataagaaacataaaaactgcttaaatgtatacatcagtgtgtgcatgcatgtgtgtgtaattctgtcaacaggcctctaggtaggaattccatccttagtggccagcattttgcccgagggcagctcgtaagaggcgacactggaattcagacactgattgtttggctttttcccactaaccaccctgacacccaaagggcctccctgtcgccaccctctcctcatcaggttatttacttgtgactgttggaactcaacattttgagctttaactgtgtgctagacctggtggtactcggtggtttgcttgccacgcctttgtttttctcaggaaaaaggtcttgagacacaaccagcatcttatagctagttaggagatgaagctctagaagctctggaacccaaatttcccatctcctggccccagtccctgcccagtccccctgtagggacttagctactgactgatctttgggtggggacatccctgcttccacagaaactggtacggtgcaaggcctgtgctgatgctggcctacttgacgagagcttcctgagaagatgtctgaatttttatggccttctcattcagctgctgctccgcatcctggaccccgcatatcccgagtgagtgtgcttcttcctgtttcccttgtccctccttggctgggctctgttgtctttattgtccttcaaagttgataactaaaaccaaaaccctttctttatcaagaattcacttctctgcaaggcgcagtggttcacgcctgtaatcccagcactttgggggaggctgaggcagatggataacttgaggtcaggagttcaagaccagcctggccaacatggcgaaaccgtgtctctactaaaaatacaaaaattagccgggcttggtggcagatgcctgcagtcatagctactcaggaggctgaggcatgagaatcgtttgaacccgggaggcggaggttgcattgagccgagatcatgctactgcactccagcctgggcgacagagcgagactctgtccccacccaaaaaaaaagataattcacttctcagtttccagattgcatttatatagattatgtagttatattgataggtgttttccctgtaattagttacaataataggcaaatgtcaacacctgttattttaattttgacaagttttctttaaaatttgctataaagtctttgattgatagaaagagaaatctataaattggaagccaaaagctggagataatattaggccctcctaagcactgggtccaggaatacccacctaattcagagagtgagctaagaacattgttgatcactttgtcatcaactggtcatctcctccaggcaaaccatttttgttttatttattattattattattttactgttatgaagtctctggttcactgatgttggtgagattggcccaagacccgtgaaggcgtggaaaatattatttaaaatatgtgtgtaggccgggtgcggtggctcacgcctataatcccagcactttgggaggccagggcgggtggatcacatggtcaggagatcgagaccatctttgctaacacggtgaaaccccgtctctactaaaaatacaaaaaattagctgggcgctgtggcgggtgcctgtagtcccagctactcgggaggctgaggcaggagaatggcgtgaacctgggaggcggagcttccggtgagcggagatcacgtctctgcactccagcctgggtgacgagcaagactccatctcaaaaaaaaaaaaaaatgtgtgtagctctgttgtttccgtttgagttgcacaaaatgaccaaataggacctttttatttccttcccattttacttattgcattaaccttagcaagaagtcaagaaggctgggcgtggtggctcacgtctgtaatcccagtactttggaaggctgaggcaggcggatcacttgaggtcaggagttcgagaccatcctggccaacgtggtgaaacaccgtctctactaaaaatacaaaaattagccaggtgtggtggtgggcgcctgtaatcccagctactcgggaggctgaggcacaagaattgcttgaacccaggaggcagaggttgcagtgagccgagatcacgccactgtactccagcctgggtgacagggtgagactctgtctcaaaaaaaaaaaaaaaatcaagaaaagggccaggtgtggtggctcacacctgtaatcccagcactttgggaggccaagatgggtggatcacttgaggtcaggagttcgagaccagcctggccaacatggtgaaaccctgtctctattgaaaatacaaaaattagccaggtatggtggcacgtgcctgtaatctcagctattcgggaggctgagacatgataatcgattgaactggggaggtggaggttgcagtgagccaagattgcaccactgcactccagcctgggtgacagagtgagactccatctcaggggagaaaaaaaagaaatcaagaaaaggaaaacatttcacacatacccttgcatatgcactgtcttcattattccctgttcatttctggttgtagtttctttgcctacatatttattacatagtattacagaatgattttcttccccaaatgaaatacttatccgatggtaatgtaatactccttgtagtttgatgtaccataatttcatttaataaattgtcctttttttctctttgacagtataacactgcctttaaattcagatgtccccaaggtatttgcagcgttgcctgagttttatgtagaagatgttgcagaatttttattttttattgtacagtaagtgcctttaatattttacatagttctaatatgtttttatgcataatagtataatattctgagctatgttgcaaacctccatttcatgcctgaaatttgatgtaactgttttaactgaatgctgcctagagactggaaaaaataaatccaactgtggcatcagtccaattccaataatatctcaaagacagaggcaggattaacagtgcagataatgtattccttgaaaattgagttgaatttctaatagttaaatatgtgtttctgagcaacagaaggaggaaacagtttataaatgtctgaatgaacatcccaaaaccagaaatatccacatctatattttgtactaaaatttgtctcaattgtaaaattggagaatgcttaccaagaaatggtttgaatttctaactggtattgtagggttttaatttttttttcaaatccttatttggtttatcaaattaacattttatttctaaaacattacaggttagaagaattacaatttcaatcccttggcaccatgatagcacctatgactagctgagggagtggtatgtgaagtctattgtgaaaagtaaaagtcatgctgggcactgtggctcatgcttgtagtcccagacatgcaggaggattgcttgagcctagttcaagaccagtctgggcaatgcagcaagtctgcatctctttaaaaaataaataaataaatagtataggtccccagtcacagaatacaaattgtgaaagttttgtaacaaacaacaggaaaaaaacaaaattagtataaatgattttaaaataagggccaaaagtaaatggagcaagttaatattgctgtcataaaagctgcctttaaaaaaaagcccaaatcaaggcagaggttgcaatgagcagagatcatgccactacactccaacctgggcaacatacacaaaaaaacccaaatcattggtgacacgtgattttgattggtatgaaattttaaaagtgactcaaaaacgtggtttatttgttgaaaaaccaaccttggaatttaagcaactcaagtcacattttaaaatttgttctatgcacagtgatacaaaagacacctatttgaaaaatttcatttattctcattttcagcagagattaaaaaaaaactatcaaaatttttatgttttggtagtgatgatcttttgtgaagtttatctgatttgatcataggttttgtttatagttaatataacatgctacagccagtaaccatgtttggttttaaatctgtcttgttacagtgtgaatagtcactgtaggctgggtgcaatggctcatgcctgtaatcccagcactttgggaggccaaggtgggcaaatcacgaggtcaaaagatcaagaccatcctggccaacatggtgaaaccccatctctactaaaaatacaaaagttagctgggcatggtggcaggcacctgtagtcccagctactcaggaggctgaggcaggagaatcgcttgaactttggaggcggaggtttcagtgagccgagattgtgccactgcactccagcctgggcaacacagcgaggctccatctcaagaaaaaaaaaaaaaaataggctgggcgcagtggctcatgcctgtaatcccaccattttgggaggtcgaggcgggcggatcacgaggtcaggagatcgagaccatcctggctaacatggtgaaaccccatctctactaaaaatacaaaaaaaattagccgggcatggtggcaggtgcctgtagtcccagctactcgggaggctgaggcaggagaatggcgtgaacctgggaggcggagcttgcagtgagccgagatcgcgccactgcactccagcctgggcgacagagcgagactctgtctcaaaaaaaaaaaaaagtcactgtaaactgaatgagttcaagggcactcccaaacctacttatcctgccttcccctcctcacttactgacaccagccttcacccaagatgagtttctcagcagtttctcagcggtctctttcttgctcttcttgcctctgttcagatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacaggtaggttgctggaacacagtgtagcacatggcaggccaacttaggtaaggtcatctaaagctagtggacgacgttgctctaagcctgttacctaatatcctgctacctgtgtgtatagcctactaacctgtggcctgcagaggatgtacttttggttcttcttgccctgagtagttaggaataggacaaccattccacctactggtctctgatgattcagcaggaactactgaaagtcagatgattggcaccgagacccagggtatcaagagcacaagttggtagtgttatctgaatggaattatctggttcattttacctttgaacttacagcatttgttttttaacactatcctataacccactttccaaagtgtgggtgaaacagggagcttgttaaaaatgcatattcttggtccgggtgcggtggctcatgcctgtaatcccagcactttgggaggccgaggcgggcggatcacaaggtcaggagttcaagaccagcctggccagtatggtgaaaccccatctctactaaaaatagaaaaaaaaattaaattagccgggcatggttgcaggtgcctgtagtcccagggcggttgagggaggagaattgcttgaacccgggaggcagaagttgcagtgagccgagatcccgccactgtattccagcctgggcaagagaacaagactccgtctcaaataataataataataataataataataataataataccacttttcacctgtcaaatttatttcttaagttgaaaatacctggtacaaacatggttgtggagaagtaagctaacctgcaaaaaaacctgcttaatctaccctatagccagtgtgcagatttagtgctatgaaactctcatgagaatgcaaatttaaagcctttctgaaaggcagtttagcagcccacaccaagagccttaaaaatgcttttatcggggccaggtgcggtggctcatacctgtaatcccagcactttgggaggccgaggcgggtggatcacctgagatcaggaatttgtgaccagcctggccaacatggagaaaccccgtctctactaaaaatacaaaaattagctgggtgtggcgggcggcgcctgtcatcccagctactcaggaggccgaggcacgagaatcgagtgaacctaggaggcagaggttgcattgaactgagatcacaccagtgtgctccagcctaggagaaagggcaagactccgtctcaaaaaagaaaaaaaaaaagcactgggataacaaatagtaggtgcaggaagtagccatcttctatccctcagtctggggacccaagggaagagcctggggatctcagaacccagctgccctgatgagggcttggacggagctaggacccagtcctctgtggaaggcccttggccagtaggtgctggtgtctctctcgggggttgtgcacggttgctagctctgggggtacgagacaaagctgaaaattggaaccaactgctactgctgacagtaagtgcaaggtcctaagtcccttgtttctccttcagttttccagttctcctgcagcaccccctattggcaaccctagagagggcgggctgccaaaggaaagattctgcagtgccagccccagaatcacaaagccaactacaaagagtgcatgtgggctgggcacggtgactccagctaataatcctagcactttaggaggccaaggtgggaggattgtttgagcctaagagttggagaccagcctgggcaacatggcgagaccccatctctacgaaaaatttaaaaattagatgcctgttgtcccagctactaaggaggcagaggtgggaggaaggcttgagcccaggagttcaaggctgcagtgagctatgatcttgctgctgcgttccagcctgtgaaacaaagcaagaccctgtttctaaaaaaaaaaaaaaaaaaaaaaaaaaaagggtaaaaagactgggtttcggccaggcacagtagcttacacttgtaatcccagcactttgggaggccaaggcagtggatcacctgaggtcaggagttcgagactagcctgaccaaaatggtgaatcctagtctctactaaaagtaaaaggccgggcgtggtggctcacgcctgtaatcccagcattttggaagactgaggtgggtggatcacaaggtcaagagatcgagatgagcctcgccaacatggtgaaaccccgtctctactaaaaatacaaaaattaggcctggcacagtggctcacgctgtaatcccagcactttgggaggctgaggtgggcgaatcacctgaggtcgggagttcaaaaccagcctgaccaacatggtgaaaccctgtctctactaaaaatacaaaattagcctggcatggtggcacatgcctgtaatcccagctacttgggaggctgaggcaggagaatcacttgaacccgcgaggcagaggttacggtgagccaagatcgcgccattgtaatccagcctgggcaacaagagcaaaactccgtctcaaaaacaaaaattagctggacatggtggcatgtgcctgtagtcccagctactcgggaggctgaggcaggagaatctcttgaacccgggaggcagaggttgcaatgagccaagatcgcgctactgcacttcagcctggtgacagagcaagacttcatctcaaaaacaaaacaaaaaacaaaacaaaacaaaattagccgggtgacgcatgcgtgtaatcccagcaacttgagaagctgaggcaggagaatagcttgaacccgggaggtggaggttgtagttagccgagatctaaaaaaattttaaaaaaaaagagtggatttggagctacgagacaacagctgaatagctatactctgacataagaatttaatttcttgaaatttattcaatggaaataattacgaatgtttgtaagtgatgttctccacagcattatttataaagcagtgcagtgaaaataataaaaacaactggccgggctcagtgactcacgcctgtaatcccagcactttgggaggctgaggcaggaggatcacctgaggtcaggagttggaggcttagtctggccaaaatggtgaaaccccgtctctactaaaaatacaaaaaaatttagctgggcgtagtggtgcacacctatagtcccagcttctctggagtctaaggcagatgaatcacttgaatcagggaggcagaggttgcagtgagccaagatcgtgccattgcactccagcctgggctacaagagcaaatctccatctcaaaaaaaaaaaaaaggaatgtagggaaggacatataccaaaatagtaacagcgcattggttatttttgaatggtagcattataaatagtttttatttttattttattatctgaacttcttaatttttctacagtaaacatgtattgttagtagtaaagacaaaacaattttagttaaatttattttgtagtcagtgttctgggcctgtcactgtggcttcaggagagagagagagagagagagtgtgtgtgtgtgtgtgtgtgtgtgtttgtgtatttgtgtttacacaacagaactgggcctgttgcctataagacgagtgctgggcctagtggagtcctgctgggaatgttccagaaggaattgggtgggggttgttctctctttcctctttgccatgtgtgccctctggcctggaccacctcttcagtcatagatggatgacatctgtactaataatagccaccacttattgaatgcttactaatcctttcacttaatccccacggcagtcctaaagatagtactataaatacatccactttacaaatgaggaaactgaagcttaaaagggtcaagaagcttgctgaaggtcagtggctagcaagtggcagcaacctcgcagatgccctttagcacaggtccccctggctactgtgctggtcttcctacagctactaagggaccggtgtgagggtacccctgagggaggcatcacagacatagtccccagtgctcatcacctccatgtgaagacctggctgattaggtcctggtccctgagcagatgggaccctcagatataaattaaaagttgccacacacaagatcagtatgtggaacaagctcctcttaacaccacagagatagtattctagcttagaaaatgctcaagttaggctgggcgtggtggctcacgcctgtaatcctagcactttgggagtccgagacaggtgaatcacttgaggccaggagtttgagaccagcctggccaacatggcgaaaccctgtctctactaaaaatacaaaagattatccgggtgtggtggtgggggcctgtaatgccagctacttgggaggctgaggctggggaattgcttgaaccgggacctgggaggtggaggtcgcagtgagccaagatcttgccactgtactccagcctgggctacagagtgagactccatctcaaaaaaaaaaaaaaagaaagaaggcagcaagaatacctggggggaggagggagaggttcaacacaagtctagtccacctacggccttctagaacaaggacctgggaattagaacttgggctggtatgactttgagggaacagtagaagtgaataagaagaaaaaaaaactgttgggagaaatgtatattgttttgtttcattttcttttcttttttttttttttttttgagctagggtcttgctctgtcacccacgctagagtgtagtggtacaattacagcaccatgcactcttgacctcccgggctcaagtgatcctcctacctcagcctcccctgtagctgggactgcaggcatgtgccaccacacccagctaatttttgtggtttttgtagagacggggtttcacgatgttcaccaggctggtctcaaactcctgagctcaagtgatctgcccacccgggcctcctgaagtgctggaaatacagatgcggggccctgctgagatacatattgctacataataaattaacatttacttagtctctactatattcagaattgggtgcagatattggggcattttagatgatatgaggcgttgggttggtcctcctgtatcttcctcttgtaggctatccttatgtcaacactccacactttagctcatgcttttatacaattaataaatgacatttagtttattttaaggaaaggttacttaatgaatatacataagtactttcggatcttagtatgataggtgttaattatcttattttatttttaaatagctgtttccttttttggtcacacacaaaaaaatgtgttctttggaaaatacagaaaatatcaaagacaaggtatagtggctcacacctgtaatctcagtactttggaaggacgatgtaggaggatcgcttgaggcaggaatttgaaaccagcctaggcaacatagtgagaccccatctgtaaaaaaattaaaagtgaaaaaaaaaatttttgagacagagtcttgctttgtcgcccaggctggagtgcagtggcatgatcttggctcactgcaacctctgtatctggattcaagcaattctcctgcttcagcctcctgagtagctggaattatgggcacacaccaccatgccctgctagtttttgtatttttattaatagtagaggcggggttttgctatgttggccaggctggtctcgaactcctggcctcaagtgatctgcctgcctcggcctcccaaagtgctgggattataggcgagagccaccacgctcagccataaaaaataagccacgcgtggtggatacacctccagtcccagctacttgggatgctgaggtgggaggatcacttgagcccgagaggttgaggctgcagtgagccattattcacaccactgcactttaccctgggtgacagggcaagaccctgtctccaaaaaaataataataaaatagttgggcacggtggctcacacctgtaatcccagcactttgggaggccaaggtgggtggatcatgaggccaagagatcgagacaatcctggccaatatggtgaaaccccatctttactaaaaatacaaaaattagcagggcgtggtggcgcatgtctatagtcccagctactagggaggctgaggcaggagaattgcttgaaccccgaggcagaggttgcagtgagctgagatcgtgctactgcactccagcctggcgacagagcgggactctgtctcaaaaataataataataataataaaatttgtcatgaattctgaaatttctcatgcctaagcttttgccatttggacaaacaagtttgatttttatccctctttaatagatttagggatgatagacacattggtgttttttcaacaccaaaaatggtcaatagatagacacatttagtaaatacatggccctcaataaaattaaacctaactttttatccgctgaagtatgtccatttgaggtgccatagaatttctgtaaattaataacttaaaattaggtggggggagtatgataattcagcttttggtcattggtaagttgatgttgtcctaatgatgggagttttcctagccccgttcctttaggtgttgtgtcattgtcaaatcttcattgtgaaacttttgtctttaaaagcagcttataatttctgtcgtgccctacatgcaaaagaagtgcaaaatttcaccagctctctgattttgcaggtttacattcactcagtatcattgttggggcaataactggatttggaaagcaagaaaatacatatccctcagtacctttgtctttcttctttagatgttgagcataccggagccaccagtgagttttatgacaagttcacaattcgctatcatattagcaccatttttaaaagcctttggcaaaacatagctcaccatggcacctttatggaggagttcaagtgagtatggggcccctcgtgtcacaacttgctttcttgcaaatcgcaggtaggattgcagcttaaaagcatgcacagctgggttcttgttgactgtttgcttggtctcagactcctttgagtttaccacaagatgccactaaatgtgggcaggattttttaaatggctttacttgcaagatattgctgaattttagatttgtcaagatactttgggggtggtacacaagcgaagattgtatagggcagggcgtggtggctcacgcctgtaatcccagcactttgggaggcagaggcgggcggatcacttgaggtcaggagttcaaaaccagcctggccaacatggtgaaaccccatctctattaaaaatacaaaacattaactgggtgtggtggcgcacgtctgttatcctagctacttgggaagctgaggcaggagaatcacttgaacccgggaggcagaatttgcagtgagccgagattgtgccagtgctctccagcctgggtgacagagcgagactccgtctcaaaaaaaaaaaaaaaaaggaaaagaaaagatcctataaatatgctgagatgatgggttaagtgtttttttggtgttttctacgatgacagtgttaaatgaagttgtcagaatgagtgaaatgaaatcttagttcctgaatgttggaaggactttagattttgcaacaattaggtcagagttgtcatttaaagtatcattctttgtggtaaggccctaaaccttaattaaagacttttcatatacctacctgaaatctgagtgactgcttaaacctggacattagtaattccatctaaattatctgtcagtgcctaaaaacaaaagggagatgaagatgctgaactcttgaattattcttcaaaaattttatcccatctaagggccgggcgtggtggctcatgcctgtaatcccagcactttgggaggccgagcagggcggatcaggaggtcaggagatcgagaccatcctggctaacatggtgaaaccccgtctctactaaaaataccaaaaaattagccaggcatggtggtgggcgcggtggcgggcgcctgtagtcccagctactcaggaggctgaggcaggagaatggcgtgaacctgggaggcggagcttgcagtgagccgagatggtgccactgcactccagcctgggcgacagagtgagactccgtctcaaataaataaataaataaataaaaattttatcccacctacttggatcttttgcaacccatgttagatctttgatcaaatctagctatacttgttaaccgaattactagtcaataatatacaaattaccagtggaataactatttgccagatagatttctgtgaagcaaactttttaactttttgtttccataaactgctcttatggtcagaattgtgttccagctaaagcctggcacgaggcaggcccatggcttggtctgaatggtgctgattggagcgcttgtcctgaacttgccatgttcctgagatcgaggcctcctgcacttgttcacaggaacttctcttctccagcatgggcttaccaccccgtagttgcacagttgtagaccctgaagtgtagcttctttttttctctacgaatctggcatctccagagtctaacagaggtaggccaagctatttcagttcaccagcaagttctcattataacacgatctgcagaacagttccttagattggaggcttccagttttaaagtaagttaatatcccactttatcaatattacaggttccaatttttcttccatgcgtcagtctttgtgataaggaataactatatcagttgttttcttatctgttgtatgtggttaattatttgcattttcttggtatattggtgagtatatgcgtttttcctgttctagtctggaagaagtgttttctctccttaaaaacattgagggagtgagctaggggtgtgctggtaagcctgctctgggaagcagggtgggggagtcagcatttgctggttttccatggtgtgactgtttcctctgttgcccaatttaaggtgccaggggaatctggttataaaattctggaatatttagcacttgactgtcatcagccgtgcaaggtggctccaaataccactggaatgagcttatcataaacaatttaaaagaataacaaaatccaggccaggtgtggtggctcatctctgtaatcccaacattttgaggggctgaggtgggaggaacgcttgagcccaggagtttgagaccagccctggcaacataacaagtccctgtctctacaaaaaatacaaaagctgggcgtggtggtgtgtgcctgtagttccagctacttaggaggctgaggcaggaagattgcttgagccctggaggtcgaggatgcagtgagctgtgattgtgccactgcattccaggctgggcgacagagtgagaccctgtctcaaaaagaaacaagattaacataatctaaagagaagcttggtggtccttgaattccatagtgcctgacttgtgccagggtagccaggcttttagggtgagatagttgcagtctgggtggaggtgcttgttccctgggatttgctgtggcattttgcttcagggagatgtatgaccatgtacaatataattgcctttccagctccgggaagcagtttgttcgctatataaacatgttgataaacgacacgacgtttttgctcgatgaaagtctggagtctctgaagcgaatccatgaagtgcaggaagagatgaagaacaaagaacagtgggaccagttgccccgggtgaggacgtggtccagaggcttggacagctttgcaggccatctgcctccacacacgggcagagctgctttggggctgcatttgtgggtctgatgatatgcgatctgacatgctgggattttccttccatgaaatcatattgcaggattggaataggaaaattcttaaataccttatctgaagctaagaaatgggttgagaagtctttgaaaatgtacactgaaaactttctctgcctttttaattttaaagggcttttttggagatgagcttttattgtctgaatatattaatattcatgaacataattaggaaagaaatctctagaattatgtctgctggacaagaatttgatttgttcctatgggcttctctaggcaactgtgtgaatcactcaggatcctggcggggtgttttttccctttcagttgatcttgggttttatattcagttattaatagaaaagaggcctggcttgccaggttccatggaaagcacgtgccgtgccagtaccagtgctctttcctgacgtgcgtagcagccactgagatacttccttggtcgcttatgaggcccttgacagttgctggtgacttcttagattggcttaggtttattgattctgttcttggaattgtcaggctcagaatcagaactgatttccataaggggttctcatgtcaaagtggggactgctttttcttcactttttcttttttttttttttttgagacggagtttcactcttgtcgcccacgcaggagtacagtggtgcgatctcttctcactgcaatccccgcttctccggttgaagcgattttcgtgcctcagccttctgaatagctgggattacaggcgcctgccaccacacctggctagtttttgtattttgtttgtttgtttttgagacggagtcttgctctttcacccatgctggagtgcagtggcacgatctcagctcactgcaatctttgcctcctgggtacaagtgattctcctgcctcagcctcccaagtagttgggactacaggcacctgccactacgcctggcttattttttgtatttttagtagagatggggtttcaccgtgttagccaggatggtctcgatctcctgaccttgtgatccgccttcctcggcctcccaaagtgctgggattacaggcgtgagccattgcacccggacaatttttgtatttttagtagtgacggggtttcaccatgttggccaggcctgtcttggactcctgacctcaggtgatccatccgcctcagcctcccaaagtgctgggactacaggcgtgagtcaccgcgcccagactttttttttttttttttcttttttaatttcaacttttattttagattcaggggatggggtacatgtgcaggtttgttacatgggtataccgtgatgctgaggctttatgattcagcctgtcacccagggagtgagcataatacctaataggtagttttcaaccctcactcctccctcactcccctcccttgtagtccccagtgtctgttattcccgtctccgtccatgtgtaccaatgtttagctcccatttatacctgcttttcttcttatgtattaaagttctacccattctctgagtaaggtcctatccaaatactccctcaggtttgtcttcgccaatcagcatagctgaaaattctcacctttctccttacttctgtaacacccactttataccattcacagtgcttggtatgcccagcttatattttatttacttatttgttttttattattattaataaataaagacagagtgttgatctgtcgccttggctggagtgcactggcaggatcatagcacaccacagcctcaacctcctggactcaagtgatcctcctgcctcagcctttgtagatccaaagagctggatctacaagcatgtaccaccacgcttggctaattaaaaaaattttttttatagagacaaagtctcacatgcttgcttcagcagcacgtatactaacattggaacaatgcagagaagattaccatggcccctgctcgaggatgacatgcaaattcataaagcattccatcctttaaaaataaatattaggccaggggtggtggctcacgcctgtaatcccagcactttggaaggccgaggcgagtggatcacaatgtcaagagatcaagaacatcctggccaacatggtgaaaccccgtctctactaaaaatacaaaaattagctgggtgtggtggcacgccgctgtagtcccagctacttgagaggctgaggcaggataattgcttgaacccgggaggcggaggttgcagtgagccaagatcgcaccactgcactccagcctgggcgacagagtgagactccgtctcaaataaataaataaatattaaagagagagagtcttgctagttttcccaagctggtcttatattttatttacttactatttttattattaaattattttttattttattttattttattttttgagacagagtctcactctgtcacccaggttggagtgcagtggcgcaatcttggctcaatttatgcctgctgggattacaggcgtgcaccaccacgtccggctaatttttgtatttttagtagagatggggttttgccacattggccaggctggtcttgaactcctggcctcaagcaatccacccacctcagcctcccaaagtgcgggggttacagacatgagccaccatgcccagccttattattattttttaatagaaacagagtcttgaccgggcacagtggctcatgcctgtaatatcagcactttgggaggccgaggccggcagatcacctgaggccaggagtttgagaccagcctggccaacatggtgaaacccagtgtctactaaaaatacaaaatttagccaggcatggtgacaggtgcctgtaatcccagctatttggaaggctgaggtgggagaatcacttgaacccaggaggcagaggttgcagtgagctgataccatgccactacatttcacatttcagcctgggcaacagagcgagactccgtctcaaaaaagaaaaaaaaaaagaaagaaagagtcttgctctgtcacccaggctggagtgcaatgacagatcttagctcactacagcctacaacctcctggcctcaagcagtcctcccacctcagcctcccaaaatgctgggattatagttgtgagccaccatggctggccagcgtatattttagatgttggaatgcaggtctatagcacattctcgtattcatagtcagtacttaatagcatttgtttatgagccaactgaacaaataatattgatttttcctgtgttaatggatgaaaaaggcccaaataattcccacaattgctatttcagaaataatttttatttggctttgaagtcactttctacctcccactgccctggctgttcctgctcatctccctgacgtctgagcttggtgagctccagcactcagcccttaggcttcaatttctttcccactcatgctctctaggttagtgtttctcaacgagggcactagttggaattttgagcctagtggaatttggtataataataactcatgatgagaaaccatcccatatattgcaggacatttaggatctctgtttcctgccatttaatgtcagggatgtaccctcctacccccagccttcaggcaacgagaaacactgccacacataacctgatgtcccccggtgaacatcactgcttggtgagctcaggtataccaaggcattaaatacctgtgttctaaagactccagaatatatctccctggctcagatctgactgcagacttgcagaccaagtatttgtctaatcagtgtctcaaactcactgtgtccaaaacggaacccttgatgttgtccacatctcctgcctgagtctgcccaatctcagtaaatggcgccttcattctaccagctgctcaggctcgatgctttggagttgctcttgatttctctgcgtctctcagcaaatgcctctaagctctgtcttaaaatatatccattatctgacctcttctcagcacctccagaccgttggcatctcttacctgggttattgcagtagcccactgcttggtcttcaacctccactcttgagcatgtccatatcagggatggtgttaaacatctcagtctgatcaacatcaccactcagctcagccattttgggcttcccttatcactcagagccaaatcctgtggtgagagcagcctacagcacgcaggaggacctggccccacaatgtgtttctgctctcagctttggacagtctcttctccactcactctaccccagccagactcacctcctggcccttccactgacacgtgagggcctttacacctgctcttccccctacctggaatgctcttccctcagattttccgactccttcagatataccctccctcagggataccttccctgaccaccctttccagaatagcattccctgactcctgaccctgcttcatttttcctcatcactgtcagacttactgtgtgtctgtctgggtatttgtttctatgaagcagatcctccctaacggaatctaagctgcatgagagctgggagcctttttattctatctccagtgcccaaaggctgtagaagggcctgttgagacacccaggtacacatttaggtagttcacgcctggctgttcttgtgtctttcctggctctgcctttctttcagtaggctcattcttgaccagggaacggcaggccccccagtatccctgcagaatctccatcaagcacagactggagcactttcccagagggcactcaccggccagcttcagctctgccagctgtgttcctttcccaacaagaaaaggcctctgaacagatgtaagaattgaggcttttcctgatgggtctgtgtttgacccatttcagagcctgcagtgcagtacctgattgtatccatgagtcaaacagctcttattatctcctccccagcccatggcagagttgaaggaggaaagtgcgccagaggtaagcgtgctgacagttctgtggtgtgacagcctcacagtttggaaagacaaaattttaaaagcttagtagtccacaggcacttgtagaggcagagaggcagacccgataggcctcaatacggtggcacactgcatctcatagttttaaaataatgaagactggctgagcacggtggcttacacttgtaatcccagcactttgggaggcctaggtgggcagatcagttgaggtcaggagtttgagaccagcctgatcaacatagtgaaaccccatctctactaaaaatacaaaaattaggccaggcgcattggctcacgcctgtaatcccagctctttgggaggttgaagtggatggatcacctgaggtcaggagttcaagaccagcctggccaacatggcgaaaccccaatctttaccaaaaatacaaaaattagtcaagcatggtggcacgcacgtgtaatcccagctactcaggaggctgaggcaggagaatggctcgaacccgggaggcagagattgcagtgagccaagatcgcgccactgcactccagcctgggcaacagagtgagaccctgtctcaaaaaaaataaataaatcacacacacacacacacacacacacacacaaaaaaaaaaaattagctgggcatggtggtccactcctgtaatcccagctacttgggaggctgagacatgagaatcacttgaacctgggaggcggaggttacagtgagccgagattgtgccactgcactctagcctgggtgacagaggaagactccatctcaaaaaaaaataacaataataatagagggccgggcacggtggcttacgcctgtaatcccaacacttcgggaggccaaggcaggctgatcacctgacgtcaggagttcgagaccagcctgaccaacatggagaaaccccgtctctactaaaaatacagaattagccgggcatggtgacacatgcctgtagtcccagctactcgggatgctgaggcagaagaatcacttgaacctgggaggcggaggttccggtgagccgagatcgcgccattgcactccagcctgggcaacaagcgaaactccgtctcaaaaaataataataataataataataataataataatgactaagtaaaagttattattaagggaaataaactaccctttcttagtgccatgatgtgtgtcagatactatgttccattatcttatttcatcctgaatagaagttgatggtgacttttttttttttttttttttttgagacggagtctcactctgtcactaggctggagtacagtggcgcgatctcagctcactgcagcctcagccttctgggttcaagcagttctcctgcctcagcctcccaagtagctgggactacagccacgcaccaccacccccagctaatttttgtatttttagtagcgacggggtttcaccatgttggccagggtggtctcgatctcgacctcgtgattcgcccaccttggcttcgcaaagtgctgggattacacgcgtgagccaccacgcccggcagatggtgacttcttttatcattgaggaagcagagttaaataaggcaccaacatcacctggctggaagtctcaaagagctccgatgctgaaaggatgaaacttcagttatctgggacatgtggcaggcggttctgtcattccctaagcatgttgggtttatcacgcactttccagttatgtgcttggcgctttgctgagctgatgaccaggaccgagccttactcagcgtctgttcgatgtgtcctaggatcagcagcaggctcgtcagtctcagcttgctcaggatgagcgtgtgtcccgctcttacctcgccctggccaccgaaaccgtggacatgttccacatcctcacgaagcaggtccagaagcccttcctcagaccggtgagtagaaacccggggctctgtttggtggtttggactccacattcagactctctcacttataactttagcagttgttgaagttctggaaattttaggatcacagtcatcaataagtgaaattctgtgactgattttgttcccagttatgctaattgataccagactctgttgatggactgaagagcagatgtctgatgtcaccacatagtctacagccacttccaaatgccttactgcactttgtgcttagacagtacattggattattcatgttgatgtcatgacatatttttaccattattgattcctatattttacttatagaaaaagcataaggtgccgggtgcggtggctcacgcctgtaatcccagcactttgggagcccaaggcgggcagatcacgaggtcaggagatggagaccatcctggctaacacagtgaaaccccatctctactaaaagtacaaaaaattagctgggcgtggtggtgggcacctgtagtcccagctactcaggaggctgaggcaggagaatggcgtgaacccgggaggcagagctggcagtgagccgagatggtgccactgcactccagcctgggcgacagagtgagactccatctcaaaaaaaaaaaaaaaagaagaagaaaaagcataaggtaacagctgttgacaatggaaggatattaagtagaataattgagaccgtgtaaaatctttggctctcttagctgtacctttgttacactcaggaagccaaaggttaatgggagccggccatcactagggtttatggtggattgcaaatagtcagaatgtttgttctcaactagtaagacctggttcctatttctaaaattgaaactgagcagcatcactgaagatttctgccctgcttcagccacccccaccacaaagttgaaaagttttatggtgtggccaggacaagggtagtgaggaaggcaagacggggacctaagattcggtagccatttgcctatgtggagacatgtttactttacaatggaatatgacgttactgcatatttcccctgattttctgtatttgctcttaccttcgttatgtgactctctgttatgtgactcctgtcatcagcagaggcactattgccactccctggcctggggacaactcttttccactcttttaactttccacctcatgtctcttcataaacagatttcagtgcaagagccatggaacacgaaacaaaacagctcagacactggcctcccttaaaagtttgcaaagtgcaaggccatggagcatgaaacaaaacagctcactggccagacactggcctcccttcaaggtttgcagaattctgtgaaggccagatagtaaatagttgattaattcctttgtaacaaggtcaacacccacctattttgtacacttgttgggaagactaagcgaaaacacacatagaagtacctggcataaggccaagcacggtggctcatgcctgtaatcccagcactttgagaggccaagaagggtggatcacctgaggtcaggagttccagaccagcctggccaacatggcgaaaccccgtctctactaaaaatacaaaaattagccaggcgtggtagtgcatgcctgtaatcccagctacttgggaagctgtggcaggagaatcacttgaacccaaaaggcagaggtcgcagtgagccgagatcacgccactccaacctgggtaacagagcaagactcttctcaaaaataaataaataaatttattttaaggcctgctcatagacctgagccatctgtacactgtagccctgttcttttggccccagcctgtgcctgtgcctgctgtgatgttttcatttcctttgctacactatttactatctggcctttgcagacaaagtgtaaaggcatttcattttgcaaacctttaaggtttgcattttcaccttctttactgactagctcagatctctcctacttcaaacagaatgaccaactctgtcctgttatgactcttttatttcacagcttctcaacagtgaaatacaggagtactctgtgcaaaagcaaattcttgaaaagctaagtatatgttgaatttgtataaatccagttattacatttcatgaaaaccttgtgacttaaaggaatgctttcgtgactcccttttatggccagtgtttaatgctctctaagccacatcttcctgtttcaggtttgcttaaaaccatgtatgcccaaccgtagtgggtactgagtcaccttgtgagattacagcatagattattactattttccaggtgtttcatttaagtttactctgtctcattgactagatttaaaactattcaaggcataacttttatcttctttccttgcattactttgttatttgtatctgataagtacataagaatgacacagactgaactgccaggggcttttaacatttatggggaaaaaagtttatgaaatactggctggaagagctgactcaaaactttttttgctcagataatggtaagatttgtataattttctctcttttacttgtttctcaatgaatttggagtgatactttttttaattaaaagcataaatgtaaagaaaagtttggcttcttttggtatttataaataaatatttcatcagcctgcaacattccattaagtattagaattatcagatcagaaatggggagtaaagttgaaatataatgttgtctttcttcagcttatgatacacagcacctgtaaggattctttgaagattaatccaaccaattcctgttcctccactgaaatgggagtttttggtccttttcacttgtctcaacagcatgaattgtcctattatcctgtgatttcctaggagcttggaccccgattggctgcaatgctgaactttaatcttcagcaactttgtggccccaagtgccgtgacctgaaagttgaaaaccctgagaaatacggctttgaaccaaagaagctgttggaccaactgacggatatttacttacagctggactgtgctcggttcgcgaaagccattgctgacgaccaggtcagtgagttgagttggtctctctgtgagtttactggcagatttggagataataaccacagtggccagggaactcgtctggtgtaaatgaagatgagtgggttgttttcctttgagtgtgaagagcagatttgggctgggcgcggtggctcaggcctgtaatcccaacattctgggaggccaaggcagggggattgcttgaggccagactgcagtgagccgtgattgcaccaccacactccagaatgggtgagagagtgagatcctgtctcaaaaacacggtggctcacgcctgtaatcccaacactttgggaggtcgaggcgggcagatcaagaggtcaggagtttgagaccagcctggctaacatggtgaaaccccatctctactaaagatacaaaaaattacctcagtgtggtggtgcatgcctgtaatcacagctactcgggaggctgaggcaggagaatcgcttgaacccaggaggcagaggtttcagtgagctgagattgtgccactgcactccagcctgggcaacagggtgagactctgtctcaaaataaataaataagtaagtaagtaagtaaaaaacaaaagtaaagagcaggtttggcgctctgagccctctccagttgagttcttaccccatctttttaagggccttcttgacaaatccattacatttctgaaaagagcccggtttctcaagggatcagaatcttctttcctagtctcctgctagagtgctgttatttttggggttgtccagattaaaaatcttgtgtggttttctttacattcttccctctcctttattccgtgggtctcctgtgagcagatctgtctgtgtgtgcttcatttccacagccaccgatttaggctaagctgtccctgcgtgatcttctagtcatcccataaagggctggccccctccatggtccgttctgcctcattttcaacgtcctcacagctaatgtttattaactgtacacctcatttcacccacttttcgtatctccacccatttagtcctcacaaaatcctttgaggtaggttctgtaaagtctttgttttaaagtgaggaaagaggcacagagaggttaaatagcttgctcgaggtcacagagttagtgtgggacagaggcatgatccatgtccaggcagcctggccttgaacccatatcctcagtctctctgctgtccacttaaaatgcccacaaagaaccatgcttgtctctgtgtctctgtctttgttcacactacttatccaaatactattcatggctcaagttaatcatcagtaggcattctagaaggttctttacccatatctcatccaaaggagtaatattacaatagaagcattgtaggtacttttttttaatgacagctttattgagctataactcacatatgtaggtgctttctgatgtagcaggggaagtggtcttaacaaaggatttgcagtgaaaaaatacatagtcatgtgctgtttctgtcgatgctggaccacaaagaccatgtggccccatcatattataataccgtattttcactgtaccttttctgtgtttagaatactcaccattgtgttacaactgccgacaggattcagtacagtcccacactgtacagttttgtagcctaggagcaataggctataccatagagcctcgacgtggtgtaggccacgccatctaggtttgtgtaagtaaattctatgatgtttacacagcaacgaaattgcctaacaagacatttctcagagcgacacatgactgtgtgtctaaagcagttttatcatacaaagtagtggctcgtaagagggttaggaaattttagttacttgtagatgttaaaatatatactgctggccgagcgcggtggctcatgcctgtaatcccagcactttgggaggccgaggcgggtggatcacaaggtcaggagatcacgaccatcctggctaacacggtgaaaccccgtctctactaaaaaaaatacaaaaaaattagccgggcgtggtggcgggcgcctgtagtcccagctactcgggaggctgaggcaggagaatggcgtgaacccaggaggcagagcttgcagtgagcggagatcgagccactgcactccagcctgggcgacagagcaagactgtctcaaaaaaaaaaaaaaattatatatatatatacacacacacacacaaacactgctttactagcccccgactatataatactgcactgatttagaaacagaaagcaagtcatagcctgcagtgagggaaagaaaagggaagcacttacccattgaggtggggtccacacctgactgtagctggcgtctccagcccagccagaggtcggtgtggaaagccccagggctcttccatcgttgccgtagagagacttggaagagctgtttagtgtgcgccctctccagggtggttgtgctgtggctgccacatcacaggcgcttaacgtaacacacagaaggtttcggtgtgggtgggcacagcacgcccagtgaggtgatgcaaagcaactgggtgacaaaggaatgctttgagcggcctttgtttggtgaccaaccacacattgcattgcctggtcatgccttagattatggtggtggcctctggtggcacctggcttgggttgtagacagcagtttctggcacagtgacacacggggctccttgaatgtctaaatagtcctgttcttccagagtggtgaaacaaacacacatgtgccagtgacacatggagagaaaagcatattttaagaagtgttggggctgggcgcagtggctgacacctgtaatcccagcactttgggaggccaaggtgggtggatcatgaggtcaggagttcgagaccagcctggccaagatgatgaaaccccatctctactaaaaatacaaaaattagccgggcacagtggaaggcggctgtaattccagctactcggaggctgaggcaggagaatagcttgaacccgggaggcagaggttgcagtgagctgagatcgcaccgctgcattccagcctgggtgacagagcaagactccatatcaaaaaaaaaaaaaagaagaagtattgggctgggtgcggtggctcacacctgtaatcccagcactttggggagccgaggcgggcagatcacctgaggtcaggagtttgagaccagcctggctaacatggtgaaaccctgtttctactaaaaatacaaaaaattagccgggcatggtggtgtgcgcctgtaatcccagctactcgggaggctgaggcaggagaatcgcttgaacctgggaggtggaggttgcagtgagccgagatcgtgccattgcactccagcttgggcaacaagagcgaaactccgtctcaaaaaaaaaaaaaaaaaaaagtgtttttgcttcctttcacagtgtggtgtgtgtgctgattgttgggtattttctatttatattggccataagctgattaggggcctgcttacttgattgttttagaagagagctttggtggggcagggggcggtaagtgcagaaggatggatggttggcaagcactggggaagaggttgtaaaattgcattttcttctttggaagcagcagtatcttagtttgctttggtatgtcttagtttggtttggtatgtcttgttttccgggaaagacaaaggaagaggaaaatgacagctttgcaggtaaagaaactgagaggcttctctccctctataccaagagtaggctgaagacccatgtccagaaggctgacagaaaggtgcctgggtgaagagccactgagcttgatgctcaggaatctgagggcagagctccatgccagagaagtgggataccacattggtcctgggagccaagaggaccaggatagggagatgttaaagtggcctagactgtgtctttatgggcagacgccagttccatggacagactgcatatctgtcgtccatgaagcattgtctgttaacaccattttccattaaaaaagaaaaaaaattcagcacctacttagaaaataaaaaaaaatagccgggtgcagtggctcacgcctgtaatcccagcactttgggaggccaaggcgggcggatcacaaggtcaggagatcgagaccgtcctggctaacacggtgaaaccccatctctactaaaaatacaaaaaattagccaggcgtggtggcgggcgcccgtagacccagctactcgggaggctgaggcaggagaatggcgtgaacctgggaggtggagcttgcagtgagccgagatcgcgccactgcactccagcctgggcgacagagcgagactccgtctcaaataaataaataaataaataaataaaaaagaaaataaaaaaaataaaaatcccatcagtcacacttcccccatgcagtcagtctttcctaagtaattgctccctcctctaacctaccagaatatgagtctgcgtctcacaaatgtaatgcttcattttcttgttatttttttcttctttaatgaggtaagattaatatataacgtagaagtaaccatttaaaagtgtaccattttgtggcatgtagtacagtcacagcgttgcacagccaccacctctacctagttccactacatgtatcaccccaaaaggaaaacccttaaagcagtcgctgtctagacccccttgccccagcccctggcaaccacaaatctgctgtctctcttttcctatttttggatttacctattcacctctccgggatatttcatataaacggacttatacagtgtgtaaccttctatgtctggcttccttcacttagcatcatgtttcaaggttcatttgtgttgtagaatgtatcagtatttcattcctttttaaggctgaataatatttcattgtatggatataccaccatttgtttatcctcatccattgatagacatttgggttgtctccagcctttggctcttgcaaatagtgctgctatgaacatttgtgtaaaagtatttaaacacctgttttcagttactttgggtctacacttgggagtgggattgttggtcatgtggtaattccatgtttaactttttgagggatgccagaatgttttctacagctgccgcccatttgacattcccactggcaatgtataaggtttaagtttccattctttttcattttttttctttggtttagtttatattctttccatcatgaagtttaaaaattaaacatgttaatttgtttttgtttcttaaatactcatcctagtgggagtgacgtggtatttcattgcggttttgatttgtatttccctaatgtcaaataccattggacaccttttcatgtgcttgctggccatttttatattttcttgggagcaatgtctattcatgttctttgcccattttttaattgggttgtttgtgtttttgttgttgagttggaagagttctttttttctttttctttttttttttttttttttgagatggagtctccctctgttgcccaggctggagtgcagtggtgcgatctcagcctactgcaacctccacctcccagattcaagcaattctcttgcctcagcctcccaaatagctgggactacaggcgtgcaccatcacgcctggctaattttttttgtatttttagtagagacggggtttcaccatgttagccaggatggtctcgatctcctgacctcatgatctgcctgccttggcctcccaaagtgctgggattacaggcgtgagccaccgcgcccaaccagaagagttctttatgtattctggatgctaggtcatatcagatgatacatgtatcattggatatatgatttgcagatattcttgtgttagtccattgcatcactatacagaaatacccaaggctaggtactttatgaagaaaagaggtttaggccgagcacagtggctcacgcctgtaatcccaccactttgggaggccaaggtgggcagatcacttgaggtcaggagatcgagaccagcctggccaacatggcaaaaccctgtctctactaaaaatacaaaaaaattagccagccgtggtggcgcacacctgaaatcccagctactcaggaggtggaggcttcagtgagccgagagcgtgcctctgcactccagcctgggtgacaaagcgagactccgtctcaaaaattaaaattaaaattaactgggcatagtggcatgcacctgtagtcccagctacttgggtggctaaggtgagaggattgcttgagcccaggagtttgaggctgcagtgagccatgattgcaccactgcactccagcctgagtgacagaatgagactctgtctcaaaatatatatatatatttatagtaaaacatatatggcaaaaacactggccacttgttttgcgatggtgatacaaatacaaatatatatcatcactaagcaagtggccagtgtttttgccatatatgttttactataaatacaaactacagcatactttactgtttggcatggcagtgatttttatgaattaggcacctgtgaggtagatgttactctgcccattttacactcaaagaacctgggcttaggagggttcagatttgcctacgactgcacagctggtaggtggtagagccagaattcaagttcagatttgtctgggtccacggtgggcgcctgacctccactccacaacttcccttcctggggacataaatcgtgtctgttcccaggcctattcatcagttcaccagggtggtctaacgtccatggagcccctgacatgtgctagtgctgaactaaatgagcttgaagaagcttgaaagtgaacaggagaaggctcctctagagtatgaacaatagtggattgtttttaccatgcttacctttgtggaagagagctgaaattttcacctcttctttcttataggctgccagggcacagtgccccccaaggactgaaatagactagatttccttctctttttaatgtttaaactttaaaagaaatgcgtgctagctgtaaaaattcaaaaaaaaagcccgtctgcctcagtcctgcagccctctccagagggagtgacctcgtacagtttggcacatattattccagtctttatccatttgtaagcataaaaagtgcatacttttatgaggctataaatgcataaagacggatatataaaatatataagtgtatatataattttagggcttttttagtgggggaaaatccacaaatggataatactttggatattttctgcagctcgcttttttccacctgacgtacatttacgtctcacattgccattcctcctttgcagagatcctacagtaaggaattgtttgaagaagttatttcaaagatgcggaaggcagggatcaaatccacaatagcaatagaaaaatttaagctgctcgccgagaaagtggaggagatagtggccaagaacgcacgcgcagaaatcgactacagcgacgctcctgatgagttcagaggcaagtggactcgtcgttttcatgctgatttcttttgagttaactggaaatcgataacattacaagaggacgtcctgtgcaattaattttttaatggtgtgctagagctgctttttgagacaatctgtcttaaattacatttgcctatttttagctcatattgtaaattgagaggaagaaacatccttagcttagcctgacttaaagccagataacaaccctgaagattctaagggcagggctgcctttgcaagtggggattcacattttcaaagaattcccagaagtcctaagacaaagaattccagcctgccgtcctcgccacggagcctgtggggcctgctgctgggtctgtcccaggctttcttctctgttccctccccccagcagtagctgacaaagaagcgccttccccttacaaaaggcaatgtatatgcctttattgaaggctgatttccttctaaacctgggggcctcacaggggccctttgattgctgttcctttggatagatttttcgctggtagaacgggctttgttttctttttcagtcgtgggctctcagtagattagagtttgctttgctttgtccccgcagaccctctgatggacaccctcatgacagaccccgtgcggctgccctctggcaccatcatggaccgctccatcatcctgcggcacctgctcaactcccccacggaccccttcaaccggcagacgctgacagagagcatgctggaaccaggtagaggagggtgcagtttgaggtgcagcgctggcgtcagtaccaagagataaagcccaagtcacatattggagatgaagcagaagggaaatttatcaaatgcagaaactacctactttatgacactctgtagcaaagacccaaaacactcttggccctttttccctgcagacatccagtccctccctctcatgtcccagtccttctggagtcttcggctcaatgagggaaagaatggccttttcttcccatttatacagagcgacaagcatcctctctcaggaagagccctcccatctggggcattaatcctcctttttttcttttctcagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcatgtccttcgtatgtcacagtttggggcaacggaagtcttttagtgatggctaatgggtctgggcagcatcccttcatgaatttttttttaatccaatatccgttgatttgattgtgattagagaaccttggacattttgctgctaaagaatcttttttcccctctcccccttcctgaccctacttgcactgctgtggatttttttaagagaagcaaaaacaaaagtaaactcctttccctggccctccaaacatatattctgtgagataactgtgcctgctaccaagtgttaatcctgggatcgtatttttatatcatattcacatatttgtttttttaattggtgttagatgacatgattaataaaaaaggcaagatattttcagaatttgaatttcagttttttttttcttttgaaatgtccctttaagatttttttattctaaacaaaataaagaaaatcctgctgctctggtccttgtgataagcctctcttcggcatctgaggagcagctgcagcaaaatctaggggtgtaagtgtatcaggacttatgtgacttatattttggggagatgagggttgggttttttttttaatgctacgtgacagtttgaaaccttcacagttatcctctgggggtaaatcaattcttcaacccttgggtgtgtgagtttgaggcagggtcatttgtgtgatgtgtttggccttaccaaagcaaaagagggtgcaagaatgtgggagtatgtctgccggtttcaacacacacagacaaacacagccacacgcgcacacaagtataagactttttgtattactgctccctacttaacatacttgaattctcaaatttcctttggggtaaaaaaaaaaaaaggatttgaaaccataaagtgttctgaagaaattaagtctataaaaagcatactttcttttttcttttccttttttccctccacagacaatgtcctctgttcaattcctaacgcaaactacaataaatggtgacacacgttcagaagaa

SEQ ID NO: 2561 - DNA, 148257 bp, Homo sapiens; identical to SEQ ID NO: 2560

SEQ ID NO: 2562 - DNA, 843317 bp, Homo sapiens; identical to SEQ ID NO: 1774

SEQ ID NO: 2563 - DNA, 20592 bp, Homo sapiens
ccacctcagcgggaagcggagacgcaagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacaggtgagctgcttactcacgacccgcgaccccaagtctctgtcagcgcgctttgccctcagcatcggattccttcctaggaccgggagacctttgtgacttcccgggcactcccgacctctctgaagtgcgcttttatcttttggtgtaggagagactaccggcgaagaggaaatctttcctgaaggaggagttaagttttttgtgttagctgtttctctttagaaaaacgctctggagaagtggtagctttggttgattgtgatcacccagtgttctttgactctttagggactttgttaaaattcaggatttctaattttctgctgctaataggactgctgatggataaatcctgggaaaaaatcagccaagttcttcaagtctataacgtggcacctgatccttgacctagcttgctgacatcttttgaaagtgggtgaggtaatattgccacataaaagcacctgttaaatttcagtacatcacattctttcaggattatccccagttcccaccttctccaatacgccgtaccacattcctgcaatacattgtaacttatttttttctttgtctttcaataacttgagtttcctagcgggcaaacgacgggtcttaatcatctctttgttatccataccttttacaatagctgctttatgctagtaggtgctcaaaagtatactgaattgattaaaaacagcactaactccagatgtcttaaaagaaagatgttttgtgttttagaaacacagtggaaatttctgaagtaagacaagtttctggagcaagcttgggaggttctgaagacaaagctgagaatggaatttatataatttgtttaaagtgatcaattttattttacttttccatacagtctaagtaaaaccttgagccttaaaaaaagatgagatattgaaaaaatagtttgcacatttcttctgttggacttttcattcatatattaatgcaaaaaatttttactgagcacatcaaatgtgccaggcatagtgttaatgcagggagttagagtacacagtctctacctttgtggagcttacagtctagtggaaaaatcagataaccaacaaactattaaaatgtagtttaactgctaaggagaaggaagagggttttgtgcttgaacatggaaaatatatctaagttggttttaggaaatcaggaaagtcttcccagaaggtatgacactaaggtaacagtaggatccagtagtaaggaactattattctatttggttatatgcctttttaggtttgatttggaaatatagttactttcacttttaggagagtggtgatacagataataaagttgcaggtcatgctaagtgaaatatattctattcattacataaaaacaaagtctaatctttgaaataaaccgtgaacaatttaacataccccgatttgctaatgtgaaatgtttttcaggaatactctaggaccatcctgcagaaggagtgtaattgttcaaatgaacctaggaatatgatttgaacaaagtagatagtgcaggggaatatccttgaaggatgtgtagtttgactaaaaaatagttttcctacagtgggtggctgtgtgttgggggtaggggggatggaatctggtcaatttttaaattattgcattgaattccagtgttagcaaagaatacaaagtgaacttgaaagtctacttaatattagtggcccctactctctgccatgatactttattgaaaaattaattgatttattgttttttaattataaatttggtattggtttcatattggtttatcaagatgggatgctttgtttaattgacaaggaaagaaattttacacacaaatatttttgtgattgtagtgccatagtattttcctttaggaattttgactttgaataataaagtttgcctaaacttttaatgtctgtaaagatctgaatcttaggcttacttttactattttaatagtatacagaacatttataaaagcgcctactacataccaaacactgtgctaagcctattaagttcatttttttatttaatcctcatactaccatattagaacaggtactattaaaatctccaataatagataaggaagctctgaggcttagagaggatagatcacttgcctaaattcacagctaatgagtggcataatgaaatttttcatcagggtttttccccttggcactgttgacatttggggatggataattatttgttcttggggactgttctgtatattgtgtaggaggtccagcaatattcctggcctctaccctctagatgccagtagtaccactacccttccccactttgtttgtttgtatgacgacaaaaatatttctagacattgctaaatgtctcatgggggcaaaatcaccccaattgagacccagtggtttttattaagtttttgtcgactcagacaaaaacttaataaccactgtactttagtgcctaaccactgtactttactgccttgttctaaggccttttaatgatgtcttacctcttaggagtccaggaataactttttaataaacagatatctcaaccaaacagttttatatttaatcaccttaattgtccaggccagataattcaatgtattttcatttttgtatgtttttgttttcttatcagtgtactttcagtatttacactgataatagatatcatattttaggtatttactaggtgcctgtacaagctgccatattaccgaagatggacagttattcagataatacaatagagagtaaaatttacaaaataatgtagacagagtattttatacagggtgtttcctctgtgtttaactgaaaatttagacttagggcaggaagagagatgagcgtttcttctcaaatgtggactccctaactgataccctgtttatcttttttcctcattccttttatggcatgtttctccttttaggatttttgcaatttctttatctacctttctgttctgcctcaaaattattgtattttctttcattttcctctggcatcgtgaagggcagtccagacttgaagaaagtgttagatctcaccaaataggcagcaggaagctccaagaaagcagatagataacatgttatacagttaaattgtctcacgctcccaatcactgagggttgattaatccacttactgtaactgcttttagaggaaagtggttggttcttggtgctgctggtctttgaccagctgagttcagtgggtattgatacccactgaactcagctatgaaaatgataagagctatgaaggcaaaagttgttattgatacaactagttgttcagcagtcttaggtgacagcaacgaaaagtattgcggttgtgtgtcaagttactaccttctatcttttgtaatatatagatccaaatcctacatttgctgttggataacctcaaatttgtttcacagtttttccagttattctgatccactgcattattggattactaatagatatctcataatcatatcatatacaaatttcattaatcttttctagatgaagtagaaaacacaatgaggatatctaaatatttttaggtggactggctaactgtgggccctttgtgactttgatcttgaaagcaaactaaaggtcagtatgtaaaacagtggttaggttgttttgtgagatctagatcagagctgccccatggtttcttgagcatttccaatgagttagaattacatagtaagacttcacctaaaaggtggatctactattgaaacaatttcaattatagagttagggtagcataatgcttaggagtaggggctccagggccagattgcctgcattcagatcctagttcctccctttttagcttagaggctaaaaagtttgacttctcaagtaaaaaattgacataataattctaatcacctcatgaagaataaacgagttaaataatgtaaagtgttcagaacagtggctggcagaaagtgaacacttaataatttcatttgatcatttctgaagaatcttttctaattccatcttgcctttcttttttttttttttttgagatggagtctcactctgttgcccaggctagagtgcagtggtgtgatctcagcttactgcaacctccggtccccaggttcaaacgattctcctgcttcagcctcccgagtagctgggattacaggcacctgcaaccctacccggctaatttttgtatttttagttgagatggggtttcagcatcttggccagtctgatcttgaactcctgacctcatgatccacctgccttggcctcgcaaagtactgggattacaggcgtgaacccccatacccagcctcatcttgcctttcttaaaggttcacagatcagaactgcacataatcgatacactggatgcaaatatgtaatgaatgaatgatttttcacattacaaaattaatttgtgcgtattatagaaagttcagtaaatacataaaagcaaaatgaccaaaatgttaacagtgtttattaactataatctgtactcaaattatatccattttggtggatgaccttaaacatatgtatgtgtgtataacattaaataataggtaataccgtaagactgtttcacctaattttttccacttaacagtgtttaatgaatattttctcatatcattaaactctatacagcattgttttaatggctgcatagtattccattgtatgaatatgccagaaagattattatttaaccatgaagattgtgctagcattgtgttctcaaggatggtaatgctaactgaaccagcatggtaaggtgttggttggcataccataatccctataaatacatccccagtgttgtatattggcagtctttacattgctgtttgcaaattcctgaaattgcagaatgcttttggccagtttcttatagttgatacagttgttagtctttttctcaggttacagtaatgtttacagtgcctcttgtaaagtcaaaggatttgtaccaatctgagtggcaattttttccatgtttcttcaactagtccttttaagattctcacctgcctttagcaaagaacatatatttaacacctgtggttgcagttatgtaaaaaataccgatgtcacagccccacctccaagatgctgacttaattggtttggtggtggagactgggcataagtagttttgtttttgagatttccccaaatgattctattgtgaagccaaggttgaaaatcaccgatctatgttgatattctttcttggcacttgagtagcattcccaacattatttgcatgctttttatctactcttgtgggttcagatctcttcagaatggcactggggaaacaaaaagattggtaagtaccattcaaatttaggaaaatagaatattgggcactagttcttattggctaaaagcatatgacagtattcactcttactggctggccatatattagtagtactgtttaatatgataattttgatataattattataaagtactgtttaatatataaaactgtacatacatacagacatacatatgttaatatagaactatttctcaaatatataacaaatatatgtcaataaaacaaataattgccataacagtggtattaaacaagataaatctacaaactaatacctcgactggactctgcctatctcccctggttcacctcatgcttattcaccttcttattcatactgaaatttccagttcaccatttttacatatagcttagaatcttattatcctgtaattgtacatttgctgatctgccactttatcattttattgttgcttccttgtttttattatcagcttagcagtacactatctacaattttaagatatcactttgtactttatcaaagttagacctcagatcctgggagaccctagcataaatacttttctacttaaatatttagttattaaacatctgccaaagggaggctattctttctatgtaaaataaataattccaaaataggattatttctttgcatcacatggcagtgtcctagtctgggttactatacaaaataccataaattgggtggcttataaatgacagaaattgatttttctagttctgcaaggtgaagatcaagcaccagcagatttggtgactattgagggcctattcctggttcatagatgtcaccttctggctgtttcctcacatggtggatggagcaagctagccctctggggtctcttttataaaggtactagtcgcattcatgagggctctaccctcatgacttaatcacctcccaaaggtcccacttcttaataccatcactttggggggttaggatttcaacatgaattttgtgggggataccagcaaacattcagactatagctgggtagctggcagaaagctcccctaccccacatgtggatggaaaaacaatgtctatttgcttcccattcttcaggcacttcctttccctgttggatctagtagattggagatgcatggttttcttcttttgaaatgacactgctggtttttccagtagatttgccccctctttttaacaaaaataattgtaaaagcagttagaaattgttcaggaaaatattacctgtaattataacatgtgaatgctattattttcatttttgtctgcatatatccctcgatattcaaacttttgctgtccaaacttgggaaccaaatagatttcttcagtaaagggtatctgacatgctaatctttgtctctacccttggtcatttttatgtaattgcagtcaaagtgttcataataatttgcagtcactagtacacacatttagttttgtttaaatgctaaaaactgtaacacttgtggaaggttctgctggatattccaacataaaaatgaaattcaccaatcttgttcctaggatattcccctgagtatagcacatgctgtgtagttctgtgccaataactgcaaatgaaatgggttaggaggagagtactgtcctaatagtggaaagaagactggattgaaagttaagagtgcttaagtgtatttgaggtatatgcttttgcttcttagcaaataactaatgcgatcatcttgaagaagtaggggttaggtcttcctctgtactctgaaagtaggttgtctttcctccgttaaaatgaatcttacttacctgtaaatgaaggacctcattcagagtgtcctcataatatggtgcttctcactaattgatacagcattttgtggaaaattcttaaatgaagatgtcttctttcagtctggccgggaccttcaacagtatcagagtcaggctaagtaactctttcgaaagttgaatgaacagtcccctaccagatgtaccttggaagcaggagccatgacttttcagtgagtgtaatcttgatttctttatgatcatttaagtgtgaaatacagtaacagaatgcctgataaaaaataataatttttaaaaagtaaagattacttaaaaatgttgtcttttgggaggagcaacttctctggctctaattctacaaaatggacatcttgttggttttttcagcatgcttacagtaatttaacctgttaacatgtgtctatgctgtgcccatcatgcaataatagataacttcttgctttaggactgtcttggagccagatatgtgtaggttagtacccttgctcaaacatttcctaacagtgtaactttgagcagctcacataacttctctaagcctcagtttcctctataaagtagtgaaaataaacataggaggtttgagaggattgtgagggaatccgtgtgtattacttagcatcttgtctgacacacatgggaagggtcaataattattagttattattattttgaaaaaagaaaattataaaagataagagcatcttaatcagtggttataaacgatacagctgatagaggactcaaaggaacattattggattttaaattatctacaaataattggtatttaatgtttaatacatgccaagtttgaagctgacaaaatgggaaggattaaaaaggaaaagagtacaagagcatcagaggaaaataaaaacggattagttaaataatctttgctattttagggacttagatagtaagataacttaggccagggaggaagctgctatgtttacttttaaaaaacaaaacaaaaattctctacctataaaagacaagtaaaaagtacatcaaaacaaaaataaaaccctaggcaattggctaagaaaatgttggacattatgttttatgatgtattaatttttataatatctgaaatattttctagaactctaattttcaacaccaaaaatagtcactcacttaatatctagtatcctcattttcaccatggtttagagaaccaagacctaggaaagttctcatggaattgagaagagattttcttctgcctgattcctttaggacattcataatctcatatcatcctttatttccatccaagagctattaagggtttattctttgccggaccttatattgagtcctgcatttaatgtccataccttttaacactgttctcttagtacagagagagacatatactcaaacaagtatactataatatcttcattgaaaagatgttgtaaattagatttaaatgaaatgttttgggaacagagagaaggaaggaacaaattcccatttgtagggggtaagtttgaagaaacgggacagaggaggggagtatatttaaagaagtttcacagaaaaaattatggtagaattgaacatatggaaatgaacaggatttctccaggtatttaaaagagcattaatggttagaaaaaacaatataagcagaagtccacaaatatgtaaagaacctagcatgttggaaaacagtccgccatttggtttattaaaatatatgatagaatgttgcttacacttgttttgaaaggctgtaaatataataccatggagtatgattttattttgtaggtattagggaacccttagagtttgtaagcagggtaatatggtcatctgtagtctctgggaataaaactgatggtatagaagatggtgtagactaaaagcaaagagaccagttaactcaggtgcccaagcaaggaataagacagctgtattattaatattattttaagggacctgagagatcatataatagtctttatcctttatggagccctaggatgcctcaggagccacatagaaagggcaaggatgggagtatatataatgctttgggcccctaaactcctccttatgttttaaattttttccttttattttcagttgacatgtaataattatacatatttatgggatacagagtgatatttcaatacatgtatacaatgtgtaatcaaatcagagtaattagcatattcatcacctcaaacatttatcatttctttgtgttgtgaacattcaaaatcttgtagctttttgaaaatacgtggtaagttatagctagccatatttaccctacagttctgcagaacaccagaactcattcttcctatccagttgtaattttttatccattaacttgcctctgcccatcctccccttctctctacctttccctacttctaatacccacaattctactctctacttccatgagctcaaaaattttttttggctcctacatatgaatgagaacatgccatatttatctttctgtgcatgactgattttatttaacgtaatgtcctccagatttatccatgttgctgctaatgatagaaattcattcttttttatggctgaatagtattccatggtgtgtgtgtatgtgtgtgtgtgtgtgtgtgtgtgtgtgtgtaaaaaacacttttaaaatccattattctcttgatggacatttctcttgattatctatccatagatattatgaatggtgctgccgtaaacatgggggtacagataagtttttaacataatgagtttttttcctttggagaaatacccagcagtgggattgctagattgtatggtagttctgtttttagttttttgagaaacctccatactgttttccatagtgtataaaagttctcttttctcttcatcctcaacagcatttattgacttttgtctttttaatagacattttaactggggtgaaataatatgtcgttgtggtttttatttgcatttacctgaagattagtgatgttgagcattttttcatatacttggccattcgcatgtcttttgagaaatgtcaattctgttccttgcctactttttaattgaattatttttggttttgctgttgagttgtttgagttcctcgtatgttctggatattagttcctcatcagatgaatgaaactagatccctatctcatcatatacaaaaatcaacttaaagtagattaaagacttaagcataagaccctaaactataaaactactagaagaaaacataggggaaatgcttcaggacatgaacctgggcgaagactttatggcaaagacttcaaagcataggcaacagaaaagaaagtagacaaatgggactgtattaaactaaaagcttctgcacagcaaaggaaacaacacagtgaagagacaacttgcacaatgggagaaaatatttgcaaactcctacttaaactaaagaacctctgattttatctgatatatacattggccttctgaatataagttttgcttgttatatatacatattccatatataaatatatatatttgcatgtgtgtgtgtgtatactatggctaaaaagaagttggaaaaccacttagtagcctaacatttttctaagaatttctcagatgtgtaatcatatagccccttccagagtgcatgggcgctcatcatcacaaaagaaagtcagttccattgttgaaaagtttccagttgattacagagtcctcctggactgtaaattaaggagtcttattagtcttgtacccagtaaacattatgtcattaaccttacatttctatccacagaaatttccagttacagtgttttcctttgtggctggaaagagtttaaatatgtgtatgctagtttaccatatagaatcaaagggtggatggagtcacaactctgaatttttcaggaaaaagtcttaagtattaagcaaaaaacaaataaccccatttaaaaaatggacaaaagacatgagcagatatttctcaaaacatactagaggctagcaaactaatgaaaaaatgcacatcactaattattggagaaatgcaaatcaaaaccacaataagataccatctcacaacagtcacagggctattattaaaaagtcagaaaacaacagatgctgatgaggctgtggagaaaaaggaattgcttatacactgttcgtgggaatgtaaattcagccactgtggaaagcagtttagagatttttcaaagaacttaaaacagaactaccattagacccagcaaacccattaatgggtttatatccaaaaggaaacaaatctttctaccaaaaatcatgcacttgcatattcattgcagcactattcacaatagcaaagatatcaacctaggtacatgttagtggtggattggataaagaaaatatagtatatattcagtatggaatactatgcagtcataaaaagaaatgaaatcatgtcctttgcagcaacatggatggagctggaagtcattacctaagtgaattaatgcaggaacagaaaactaaatactctatattctcatttataagtttataagctaaacattgggcactcatggacataaatatactgaggacttactagaagaggagggaaggagggggcaggggttgaaaaactattaggtagtatgcttagtacttgggtgacgggattgtttgtaccccaaacctcggcattatgcaatatacccaggtaacaaacccgcacatatacatcctcaagctaaaataaaagtttaaaatgttagttgaagaattgtgtaatgggctgggtccagtggcttacacctgtaatctcagcactttgggagactgaattgggtggatcgattgaggtcacgagtttcagaccagcctggccaaaatggtgaaaccccatctctactaaaaatacaaaaattagctgggtgtggtggtgggtgtctgtaatcccagctatttgtgaagctgaggcgtgagaatcacctgaacctgggaggcggagattgctgtaactgagatcatgccactgcattccagcccgggtaatctgggtgatcgaaagagccctgtctcaaaaaaaaaaaaaaaaaaaaaaaaaaaaaagagaatctaatggatgaaaaattataataaatatgtctaaatactccttttagaatatacggctaataggctgggtgcagtggctcacgcctgtaatcccagcactttgggaggctgaggcgggcggatcacgaggtcaagatatcaagaccatcctggccaactaacgtggtgaaaccccgtctctactaaaaatacaaaaattagctgggcatagtggcgcacgcctgtagtcccagctgctcgggaggctgaggcaggagaatggcttgaacccgggaggcggaggttgcagtgagccgagataatgccactgcactccagcccgggggcagagcgagactccgtctcaaaaaaaaagaaaaaaaaaaaccaaaaacaaaaaaaaaagaatatacatctaataatgggaagatgtttgctttctgattccaaggatttgcggttttaaattgactctcgtttagccagcctcaaagtatttaggctagatttttaaaaaagtttgcatggtacagagattctgctttaaactattgtcagtgctattactttacagacaactttgtcttgctttttatgtctcaccagctacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttggtaagtttttgcccctcacttctctctatcaagggagcaaacaatatggagaagctatttgttacactgatataatatttatacattttttctgatgtttacttgctgaagttttagcttctgcttccttttccattccacttctttttgtctttttgagtgactaaggctttgttctgaaaagtaattttctctagtcttttgatctttcccccatagaaattgttgccttttgccctttctgttatttggtttgattcttctttagagtcacatgtgacaggaactttgctaaagatctacttgattggcatataatggctgagttcttctttaccccagtccacagactcacactcacaataaggctcattttatggagatcagaattgggaaatcagaaagaatgatgttttgtttcttttagtagaataagatcctctaattaaaaaaacaaaacagaacaaagaaatagaagatacctggtactcatggtattggggtataatatttactacattcaggaatggtgagcataggtgtctgtatttgtacaagaattatagaaagactaattactaatcagacctggtaaagtatctgatggtaagggatcaaaggaaatgtcctaagtacagtaagtacagggagtgagaacaagtaggatcaggctatatcgctgcaatttttagttaaaagagaaattggttttactggcttagaatttttgaagtgtttcaagtttgctagataaatgggtcatcttgctttggaaaaacactctagtgtttcataactatatactctccaagtgctgctttatataatgtccagtttttcaaattttatttttatagacagtaatactcccataaacctccctcaaaaagaagacaaatgtatcagggtcatacaggaaacagatggcacacccaaattagcttaagggattatatacaaagatatgactaggctgtaggagaattacaaggtacagtaacctctgaccagtagcatactggttgttaccatccctaggcctgaatgtataagggggaggagcagtttctgaaactgaaaaggagaaaatttctagagaaggccaacttgagaggagcgtaacttttggtagagggatacttccagaagaaggttatttccttctctgaaagaagccaggggaataaatacccggacatcactcactgtctgttctccttcttccctactgttggggcttcttcattgcctgaacctaactggcacagagcaaggagtctattgaggcgcttcatccaagtcagcttcccagtgcagaaagcaaggtgcaggagggcagagaggagatctaaagaggcaaatgaaaggggtacagcacacttaaattaagatttttgccaaaagttgaaaatatctttaataataagtcgttcttcctatagttttgagaaatactgatatgagcaaaagatggatgagacttcagtttttatttatttatttatttatttatttacttagagacagagtctcgctctattgcccaggctggggtgcagtggcatgattttggctaactgcaacctctgcctcctaggttcaagtgattcttgtgcctcagcctcctgaatagctgggactagaggtgcacgctgccatgaccagctagctaatttcggtatttttggtagagatgggagttttgccttgttggccaggctggtctcgaattcctggcctcaagtgatccacccatcttggcctcccaaaatgctgggatttatacgtgtgagacacagtacctggccgagacttcagttcagttttatattggtattttggaaaactccctattacatacttgctttacctgaggtttaagaatggaatgaaactgggaatgtatattagagaaaataaggtaaagtttctcagctttttaatgatcatgagcccttttgccatgttaggctgtaataatgctagagtgttaccagcatccttttaaggaatgtgtagaggtaagtaacacttagcctaagggtcctcagaatactgtttgaaaatttctgttttcaggaaaggcttactatagtgggtcttaattcctctaaggattctgatagcagccttagatagcaaatacttctaatttaaaggtattcaaaggacatttctcctgaatggtcgtctaattatacctttacatcttacaaatgaaataatcaaagcctagattttgatattcaaccaagagtttggttaaccatggacagtggcaaatccaggaataaagtcagaactgttttggtttttttgtttttgtttttgagacagagtcttgctctgtcacccaggctaaagtgtggtggtgtgatctcagctcagtgcaacctctgcctcccaagttcaagtgattctcctggctcagcctcctgagtagctgggattataggcgtgtgccgccacgcctggctaactttttatatttttagtagagacggggtttcactgtgttagccaggatggtctcgatttcctgacctcatgattcacctgccttggcctcccaaagtgctgggattacaggtgtgagccaccgtgcctggccaactcagaacttttaatttcctacctcagtactttgatggccatgaaagaaatggtcagttttcttcatcattctagatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcaggtatctaaaagcaatgagtcttatgaagaaatggttctcattccatagacaaggatagcttattttgcagtgccttttatgctattagattctacctagaactgttaagaatttatctcccagaagtacattacattacaatgcttccaatatattttttttcctagcatgattagtttttgttgagttggaacagtgtaaaggactcatccatattagaagcaatgattatttctaacatattcacaaaattaattaaattatataacttgtataaattaagggaaatgaatgagagaaaactcaacaatgtattgcagtggttttttgagtagcctctttgggagactttactgctgccagatcaatctttataaaatgccattttcatcaaagcattcctctctgaaaaacttttaaatctgggactacaagataagatccagtctgacttatttttccgtcagtcagccattgttattgagagcttgttatttgtaaggcgttgtgctctacatatggaaaataaggaagatgcaaatgtctgtcattctctagttcacaaacattcttctgtagccacaccagcttctttactatccttagtggtccttagaacagaatactgccttatgctggacctgttctgtatgtaagacctccataagaactgtctctttaaagaacctttctctgatccttatagcctgtatcacattaatctcttctgtcctttaaactcctaaagcacttagtaacataatggttttagcacatattacatgtatgtgtgtttacctaatttaccttaaatatatttattaaatacctcttaccatattaaatatatatttaatatatattaaatatatttccatataacataagtatatgtttcatatatttatattaaagtaggcaaacatatttggataattaaatatttttatataatttcatatatttttttgagacagagtcttgttctgttgcccaggctggagtgcaatggcacgatcttggctcactgcaacctccatctcctgggttcaagcgatcttcccaccttatcctcctgagtagctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagccctttatataattttaaaagtgtaggtaattaggtaaaattaggttaaaagtatatgtatatttacctgatatttaaatattacctaagtgtttaatgtggacatgtaagctctttaaagatagtgcttatgtattttatatctgtttcacatactccttatatatcccccacagaaatggtcacaaataggttccttaataagtatttttgaattcagccatgctatatattcattagtaagtgagttttcttttattatgaactacaaactttaacctttttttgagtagtgagcagttattcatttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacataaatatttgttaaatgacttctccaagcaatagctttgtctttatgttatcctgtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttatttctcagtccctgactcttcttccgtcactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacagccggattgcaaaatagttttttctgaaatttcaagaagtgaaaagtttgatcagaatttattatgtcaaatggagagtttgtgtttattattaaaatatgccctatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatggattatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacataatctgatcagcatcatcagttaattagtatatgcaatgttagcctcaaaataaaaatgatgatttaagattcatggttgttgcagtgctgctcattttggttatttttaatgccttaatactttcggtaaaatacttccagggactaattaatgttttccttttttcctctttgacagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatctatgtagttaattaaagttaaagtttctgcagatcaactactcaaactactaaatacatttacctgagaaaaagtc

SEQ ID NO: 2564 - DNA, 76803 bp, Homo sapiens
ggctgcttcgctgcacacccgagaaagtttcagccaaacttcgggcggcggctgaggcggcggccgaggagcggcggactcggggcgcggggagtcgaggcatttgcgctgggcttcggagcgtagcgccagggcctgagcctttgaagcaggaggaggggaggagagagtggggctcctctatcgggaccccctccccatgtggatctgcccaggcggcggcggcggcggcggcggaggaggcgaccgagaagatacccgccctgcgccccgctctgctgtgggcgctgctggcgctctggctgtgctgcgcgacccccgcgcatggtgagtatcgggctgaggggcgctgtccgcggcgcccggggctgccacctggggcgacccttctccccctcggtccttctctgtgtgggaaggccaggctcggccgccggcgcggagcgaggccactcgctgggttcccgagagtttggacatcgccgggggcccctcccgtggtgccccgccaaccgccggggttccccgccaaccgccggggttccccgccaaccgccggggttccccgccgcctctgctccccgcggcccgggacccctcacacgcctcctcggcaggagggaggccggcagcaagtctcagaaactcctttttcgtagtgccagggtgcagggaggtgggcagttttgcccttcaggttccgcgtttcctggggtcgagcgagagccgacggcgggcctcggaggggctgagcgaaggaatgccagattctggcgtggagagcgggggcagggccgccaagccaaacggcctgcaccttcgcagccagcctcgcctttgccagggggcggcacatgggccgggtgtgtgggcttggtttggatggggacggggttttgcggcgcgcctgagttttgacactccaaccccaccgaaagtccggaggagccgggtgtgctgctcgcgtctttgaaaggtggaggcaggagaagtagggcaactggtgtggctgcatgctgaggcacatgatttaaaaatctcaactgctgttattctttctgaggcgcggagctctgctgctgtttcaggctgtgtccagacccaggaatgtggtgtgacgatcaccaattcctccaacctggcagcagcatttgctgctcctttggcatggctgggggtggggcacgggcgggtgagaaaaagtggatacgtcaattcaaagggcttccttagaaagcttctttgtggttggatgtttctaacacggttggaccaaggaaagggaatcaaatcatatcttccccatcccacccacacttttagattctacatttcttcagaccctttagtggaaataacttgggctttggagccctgctctgtaatcctggattcaaatccagctctgctatatgaactcaccaataaaatgggaatgaaattatccagctaataggattaattaaaataatgtatattaaacggatgacactccaaaggtgttcagaaagtcctttgagggccgaggctgtgttttactgcttctgagattgatgctcccagtgggatggtgtcttgtgcatatttgttgaacggaaagcagccccttctttttctgagcctaatctgaataaagatttttaccttcaccaaaaaactagtacatgaactacatctgttttcaaagaaaaggttaggaagatgatgagcttcagaaaaatatggtctttgttcattgttaacagtcagtcgacatgtcaatcgcagatgtttaaaaagagaacaaggttatttatcacccgaaaatagtactgggttgttcagcaccaactagatacttcttggaaagttcaaatttcgtacacgtctaggtcactaagaatttcagaagtggaccaggaggctttgtagtgatgaagcagagctgttgtttctgaagcatttaataaagagcatatatgatggtgtttttgcttttcctttttctttgagtgaaagctttaagtgtagctttaggatagagaggagtataatcaatgagacagtctgagggtaataatccttggtctatcattaacttgttttggtaaataacttaatcttcatgatatgtagtctcctcacctatgaagcaggactaaaggaataacctgctttagagaattgtagggaataataaatatgattgtaaagtgatttgaaaaattaagtattaaataatatgtcagaaatgggattactctgacacatagggcttcttttattataggatctcagtgcgtaaaactatgccctccacctctgctctgctgaggtgctgcgattattagctagcttttaggtagtcaagttgagtgttagtcaagttgactcaaaggataggatttagatattttgatttttagacaggtgttctttagatgctaaactaatgcagtagaagagatttagaagcctgtttcttggtacaaatcttaaatcttcttagagtctacagtgaaggcttcttgaatcctcctaatttattattgtgttttgctaaggtaccaattacagcacacccttctaaacttttgagtgttcctgtgtttggcttgtggccaattgttaatttaaacatcacggagtttctaaggcaaggagatgttagcagtatgtctgattgtctaaacagctatccaggaccatactcttgctccttgttttcttttgctttgcaatgggaagtgactccctgattttgctgcctgctagataatttctcagctgaattcttctcttgcttaaacaaaatcggagtaattttctttcagatggtgatgaaatttaacctaaaactatttttcctttcactttcttattattcctttttttttggtgtggtggagaggaggaggagagtgattcctagtctctcttatttttctgaatgtttagatttaaaaaatatttacccataacttcttgggatctctctgctccattcccaccctactgcctctcctgtaggcttctatgacatagagaagcaacttttggttcacctggattgtagttgctgacttcaggacctttagagaatgtttaaattcagtgggatatgcttggatggttcagagcagccttacaatacattttaaaaatatcacacccacagaaattctattttgcccacaaaatttgcattgatctagttcccactctgtgttgccattcctagtgatcctcctccctacctctcccattatggtagaaaaaaactctgtgtcctggctacatcaaaatctgttggggtggatcttggactcagcacccagggattctgataaggtaagtttgagaatccatattttttcaaggtttacaggtgattctgacaagtaacttggttgcaacccactgattaagtacattttttttttaccttcaggtgtgtgtatgaggtctttctaaatttaagaaatttccataacaaatgtaaccttagtcattccagtgtttaacacttctgactcaagaattttaaaattgctaacgtaagagatatagaatataatgtcatttcttctgtttatctgggtgcagtatgtctgcattgaccctttagaagggcttcatatatttagatgatataataaattctctacctctccttttcccttttcttctgttatctctttttccttaaatgtcattcatacatgttgttttttgaccctttatctatatacgtctgcaatgattttagagtaaaaaactgcaaggcgtgatttgaataaggatataagaaattttacatcattttctttatattgtgttcacagtccatagttacatgcttcctttcttgatgtctcagttcgaatgcctaaatttgaactattaattttccttccaccctttcctgattttcctgtttttgtttccccccctttctctgcaaatgacttgaaaccaaaaggtcttcttttctttctttgtcagtctaccatatgtgtagtattttggacagatcactgaactaggagccagaagaccagaattcttctccaggtctgttattaattggtttggtgaccttgtaggagagccactgttttggtcctccattttctgatgttcattgttcatggtcacagagccaattagagttgagactagaattcctttcttctggtgtccagtgcctcattcactgtccacattgcttccatctcgtgtacaaatgcgcttatgtgcacaaaaactcttataacatcctcaagtgcttattgttaatgcgtacatgaggaaggaatcgtgtattttcatttatgtgtttattctaatgcccataccctacccctgtacctggcatgatgccttggtatctaataggcacacaataaatacttgttcagtcgaacaattatttttagccactttcttattttggacaactgtggtactcctagacattttaaaaatagtatttgcaggagtcatgcttaccttacatttggggaaaaaccaaatttttcccttccccagatgtttcatttaaacttgtaattttgaatttctttgtgtgtggggtttctttctttctttttctgatcacttctgcaatttataaaggtcactttgactttggaatctcacttcaaaggcactgccatccaccccctgcctctcattcaagtttgcttccactgcttcctgtattactgtattactaggccagcaatttctgttattttgtccagaatagccacaccttattgtaatttcatcattttggggactagtcatttttggaatactatttttaaaattagagttaactaagtttatatttattttgataattttttttgagatttttttcattgagttggatattgcaaacttgtactggattgagagaatatgtacatttagtaaagtatatttgctttttttttttttgaaccaagagagtcccctgaacaccctactgacaaaaactaagggtgaaatatgatgaataaatatttgagagaatcacatggtgttgagttgtctctgccacatgattttgatccttgagggccaggtctgtgctacacacatttcttctctgtactacagaacttgtctggcatgtgccccaaattcagagtcaactgagcggcaggtcttagtcacagcatctgtgactcctgctttcccacctttagaacattctataggagaggctgatggtgagttggagtgtgtttctatgttcttttttcctttgaagagataggatcagttgaaagctgaccccacccacagactttttttgctatctcttttaattaattaaggagtggctgaaattttcctctttgttgacttatgcattggtgggaactttaaaattcatctagtctttctgtccatcccatgctggatctgatgtttacaacattctagtcaagaggtaccatattttctctcttcttgaacatctcttgtggtagacagctctccacagcagtttattccatctttggccagctctaattcttagaaagatcttcttatattcagctgtaatccatctcctcatgacttgtcctcattgacatctactcagaaatttgtctcagagtcctgagacctgtgcaggtgatagggacccaaagagatgcttgtctgtagactttactgagctgacacccagctctccataaaaggagtcaaacccagtgaggagcatgtctggggtgattgctcaggtaaagcatcttagccctacttgtttcatacctccctgcacaggtgggcactggtgggagaataacatttatcaagcagtgtttccctaacctctcttatgataagaatagctcaggtgttctcatggagattctgattcagtgcatctggaatgtcatctgggaatttgtgtgttcaagaaatagccaggtgattcttacattaggaaagttttagaatcactgcagagtgaatctgggaaatcaaagtgtttgtttttgtttgtttgttttttgagagtattagagacaggttgctttggctagatcctgtggtcatttttcccccttggaaatgcctcctacttgctggcctcacttagtacagagaagaaagctgctatggtataaggttagtaaagttgtttgttttgtcttaaaagaaatttgcgaaatccagcattttcggacttctgtttgtgttgtatgactttgttgtaagcctccttattcctccattagaatgttacctgagatgttagaatgcataggagttccacagcctttttggtgtccactaaagaattctgtcctcagccgttgcaaatggtgcttcctttgaggatttctgcttcgttagctcatgaacacatatttggtgtcggcagtttccctcagatgtgttagtgtggagagatataaaggtcactcatttctggtggtcctgcttttggggtttctgggctgctgcagcaaatgaaataaggaaaggaaaataaaggaggaatctagggcttcttgagcagaacaaaacaatctgcaagaaggggcacaggattgctcctctcacaaagacacttgataatactgtccttgataggaagaaggaagtggcttcagatctgaaaggatatgctcataggcttgagacgggacaaactgcatcactggtagtggtaggaggtttgccgtagatctgttttttctcctgtctctcttttttgaggagaatattatctgtatggcagaacatacattgtggtcttaaaaaggagagtaaagccaagaaagggggatgataaagccatagcttggaataagaaaagcaaaggaattattgtattaatttgtgtatgtaaatacataggtttccatgtaattcactggtaggatcactagcccttggcactaacatttgctatctttgtagctctgctgtcttagtggtgtattgggggagcattgtggtgtgttgtcacacttaatttgtgtgcttcccttggcatcatgtggtagcaagtacagggtattctactcttctagatgtgtgggaatcattgaccaagtagaaaatatggtcctgctcccaaggagctgacatcatcatggagacaagacagataagcacacaattaggaatatgaaatacagttattttatcatttatctatgctctctgaaagcagtttcctgcagtcagggtgactcagagctatagggtcttgggagtaaacttcaggtcttaataccaccagggaaaggcgacctccagctcacccttgctgggcttgtctgctgtcgtgagctgtctgccattttcctctttctgtgttgtaatttagaagtattagaacttggcttggggaaaagacaaaaacccctttgtctggtgagggtgtaaatataaatttggcacatgttgtggtgtctattatgtctgttagtgggtttgcggcaagagagagtgctgtgttcttagtcccgaatgccaagcctgaactaggacaagttatggtggaaatatcttccttggaagatgcagttctcagtggcagtggctgaaggaacttctcgtcacagccaggcagtgactgaagtgtggtgtggacacacccagagttgctgcctcaggtggcattgattaatcatactaatatctccctcacccttttgtacttgtcttggcaaaaccctgttctactagctccccaatagtttggcctttactaggtatgattgaacaagctcttgggggttcaccttagtgtcccttgcccctctcgcatttccagccagctacgtcgctccagccatggtaccccgggtcctctggccaggcagtgaggggctgggtttttcttcccattggactgaagcacctttccctggaggcttgcctagggcagtttctggtctctgagtcagttccttctgcaggatactggcagctggcagaactctgggttatttgaatacatcagccaaacatcttgccaagatggactcattgttgcataacgacaggttggatctatgggtgttgcagaacctgtttctgggttaagagtaactctctcacctttattatatatgtttattcatatgatgaatgtatgtgtgtattttgtgaagtaaggaaaacatgatgataatattgtggttggagttagataccttatcctaaatatgttgtctttttaacaaatagcattcctttaaaatacagttgtgcttgatgaataaggtgttgtacaagaagctgtggttacattctaaaataaactgccttgttctgaggcaggcacgttttaaaattgttgtttgcttctttttcatctctttttattttcatctttttttgtgtgagaagattctggaagtttttaagcctcaaatattttcaataatctattttaacgggtacctagcagggagaggttgttctattggtatacctaaccaacattcaaataagaataattgaatactgtttactcactaatctattctgttgagtttctaagtatgaataatcacaaaactagatagtgctgatatattaacttctctaaatggtaaatgtggtaagtagcaaagacatttttgtttaattctctccttacacatgctttggttcagacgctgtcaagacacattgaagtttgaggacatgtgtatttcgattattttattatatttttatttgctgtgaatatgggtttatttatttgctagatcttctttagttagaaacattaagggcatttactttattacaacatttaaagtgcattctaatcttcatgaggaattttaggtaaaagaccgtatcctgagattcatgcaagtctttggcattatgttactatttaaagtaagtaatatgtagtggcttctctgacatattctttctaagagagttaaggaaaatagttgtaactaaaagcaaacattgaaacagtttaaggtaggtttacgtagcaacagaattattcgttatgtttacagataattaactcatatttatactttgctgattttctctggcacctttacaagatttttttatttttgtaatataaaaagtaattatgtttgaaaaagtagttaaggatgtttgaagaatctagaaaagcataaataaaatgtccacaatcatgctgccattaattttttggtatacgtctttggtttttttacccttagatttagaaaagctgttgatttatttatatatatatatatatatatattttttttttagtttatgaacagatctacatatatatatatgcacacacacataatatactattgtcaacactaggttttatttttaaaaatctttaccatttgataagtggtaaatattacttaatcttaatatgcctctctcattacagtgatattgaatgttttttcatatcatcagtggcgtttgtattgccttttttcctacttcttttgtaaattgtgtcttttactcatttaattattttcttactggtttgaaaaagctctttaaatattaagggtgttagtcttttgtcttaaatatgtcacaatatgtatggaaataattagcagtatataacataacatcaaattgctaccaatgttgatataaaaattgttcatttcataggttaattttttttaatcctttggtttctaatgatattggttaattcatttgttaactgctattttctgtagctacttgaaagttcttatctgactgtatcgtaaatcagcatgctttcagctgtatatgtctaggaaattgacatttactttaatacttaataaaaaaatatgttggagaaaagcagtgtattctggagtcaaatacatgattttgggtgggtgacgtaatcggctactgtcctccttttctagatagccaagatttttgaagcatttaacatccctgaaaggcaggactaatgctatgtctaccatgcactgctaattctgacactttgacctaatggataaatgccagtacagtgggtctagccagttagcttggtcagagaacaagatgactaagattctctccccctttcctcaccaaattgattagttgtaggacagaactgactgaagcaacctgttgttttggcaacccatggacaccacctgtttcttccattcctccgtccagcctctcactgccctagtgcagtgctgtgtgcatagtgggtaggagatcaatgttgttgctaaagaaagtagcaataaagaagagtagattgctttttttccaagcttttgtgtttttaaggcaccccgctggttttgacattcgttgctccagctgaactgctctatgctgaagccctgcaggtctcaagtgtttggttcagagtaatttcaggccatatgaatgctttcttaagtatcattggaatttactgggctggctgtctgccagctattaccatatttagcatgaagagacctggggaatgaggacatttctgatcaaccaaggaaggaaacctatttgaaggattacaatattttctttttttttttttaatggtgtagttcagaaaacgccagttagactgagactcagatttatgtccactggtctttgtttctgtgccccatcccaaaattaatttatgaataggaaaagagatttgatagtgaagttctttctcactctgaagtctaatactgtttctgggaggaagtaagagaattattatgcccacactgtgcactgagaggcttaaccagcaggtgaagctgttgattaaaaacataggttgatgagtattctcatttttctcctttgaagctttcagaaattttctgctttgtcctggtctaaatttattttggcccagcccttgtctccaccctacatttcaaaccagtagccttccctctatggctcaacatttctctgcctcagttttttccattttaaagatgaagatattgtttggaaggaccagtaaatacaattaatataaaaattgcttctgtagaatcaaacaacctccaacatttctgttggaaatttatagtttatagagtattcttacacaatgatctcctttaatcctcacaaacttggtggaaatggagcctcacaggggctaggtgacttgtatacattgtttacccctacataataagtgacagagctggtacttaaacttgtggcttgatttttctttttttttttgagttggagttttgctcttgttgcccaggctggagtgcaatggcgcaatctcggctcaccgcaacctccacctcccgggttcaagtgattctcctgcctcagcctcccgagtagctggaattacaggcatgcaccacaacgcctggctaattttttgtagttttagtagagacggggtttctctatgttgggcaggctggtctcgtactcctgacctcaggtgatccgcccgcctcagcctcccaaagtgctgggattacaggtgagccaccgtgcctggtccttgcagcttgattttttaaacatcagatttttttttcttttttgatttttattattatgtgtctgtcattctgctaggggctttgcaaatattgctttatttaattcatatggctatcctttggagtagacaatatttttctacattataggtaaggaatttggaacttaggttcacagctttggatgttggcctatggttagtgaggggtgtagccagcattcaaacccctgtctggctctagggccgctgcaataaatcatggtgttttatgtacattcatacacttaacactttgcaacaaccctaagagacaggggtaggtatttagggaaactggggcttctaacttgcacaggataatgcaattagtaagtggcttagtcgagattcagagctagatctgtctccataaccctcactcattccaggatactgcagatgcctatttttatgatatgtataagtaaaaattaatttaaaaaactaccttctttgaagggtcagccagttagaactcttttgtatcttctgaataagtaagaagtggatggacattagctgaccgatacattgatggcttttaaccttctatcagttgatttccattaccaggacaagcaaatataatttggagggaaaagaggggagtttccattaaggatgaatctttaagccgaaaagggccacagtgatgaactcttcagaggactgctctcaggagcaatggcccttctcctctgggctctgcttggggcattcctgtttgtatttatggagacatctttttgaaaggcagatgccagctttggtggggagaaggttggaaaacatacaagccttgctctaaatttactagccccgtgtctttgggctagtttctgaagcatggtgtgcctcaattttattattttaaaaataaagatagtagcagtatattttggagttgttatgaagataatatcagttaataaatgttagattcattggacagtaccaggcacatagttaaagtgcagtaaatagtagttattgttggtattggtgttattttatgttgcagtacagactggcttcttggtgcattcacttttctttaatcaaaagtggatgagtgattgggaaccttcatgaggaaataggaacatcatctttgcagcctgtggattgttcactggtttcctgtgatctaataattatttaagggtttcatatttgagtcttttcccttaatgaggtacactttcagtttggggagattttatctataggcataccttattttattttgtgttcccttttattgtgcttcacagattttgttttattttttacaaattgaaagtttgtggcaaccctatgtcgagcaaatgtatcagcaccattttttccaatagcatatactcactatatgtccctgtgtcagtattttttagcaataaagtatttttaaactcaggtatatgcattatgctttagacataatgctgttgcatgcttaatggactagagtatactgtaaacataacttttgtatgcactggggaaccaaaaaatttctgacttgcttcattgtactgtttgctttattgaggtgagctggagctgaagccacaatatcacaaaggtatgcttgtattatgcaagttgcattgataggtgttaaatcattttcccaatttttattaaccacacatttgtgattggatgttatgtttagtaaagatattgtgattttctgaggtacagctttgagaacagtatcaggtctaacactcttgtttccaaatttcctatgatatgacaaacataatcacatgccatccagtgtcaccatgcagagtactaatgtgaagccaaaatacttggtgttttaattagccttaaagcagttaatgaactatctctgttagacattttgaaataataaaaatatcccattgtcttttattacaacctcaggggctcctggagattttgggatcttgtgtggggaaccacccatctaatccatccttgttttaaagagagaaaaccaaagaagcaaagtgactggcccaagtacctagagctgggtcagggttggggccagaatccaatctcttgacttttagtcaagtgatttttccactatgctcagtactcaaattatgtatcaatatgtcggcccttgttttttgaggtctgaaaagggttagtgccagtcaacaacagtagaggagtagaaagggtgttgggatgggagaggtgtggctatatttaaaatttcaatgacagcagtgaaaataatttgcctgtgaacctctgcctgtccctttggacttctttgtagtagttgagacagcccggcaggtctggtgtcattagtgattcagaattggattaacctggactggtggagttactttctcagaaaagggctttatattttaacatttgtttcccttgacagtttgcttcttctcaagttttggcagccttgaacaagtggttgtcaggtttttattttgttttgttttaagaaaaaattccaaattttattttgccgatttagtaagttatcctctacctgccactcccttctgctccctctataattatttctaagactttatttttccattgtgggaacattatggaaggttttcttttacagtctgagatatttataattatgtgtaagcacacagtttatagaatatgtaaatggtccatatgttaacttaaatacccttaaaatattttccaataatttaaatctttccataaaagtagctgaagctgcttataataaaagagaagtatacacgaaggatagcagaatttggatgtagttaatatagataaatatgaatgtcactttggaggaactggaagtatttgcatgaatactgatcaagtcatgcctccttgttaatagagtgaacaaaacagatgaatgtttctgttttcatgaagtttatgtgactatcagtagcttccatattctgagggtttattatgtgacagatgcttggggacaaaatactttacttgtttcctttagtccttaaaatagatgttaggattcttgtttacagaaaagttaaggaatgttcatccagatcacctagccagtcagtggtaaagaacagtcactggaacccctctttcctgatccaaagccaacatacttaaccataataaataatgccattgtctggtggaatcctgtagtcccttagatagtgtaattttgtatttaatgtaaacattttgtgcactaaactgacttacattttactttttaaaacaatattttaattctgaatgaacatttgcataataggagaatgatctaaattgcaaacttccattttgaagagttgtagttcttttaaatctttttgtaactgggaagaagaatggaattatgtttgttgtaatccaaggaaagttggttagcattctttcctgttactttttgatcccaaaagaaattctttagtagattaagaccaggaatgaatgtgtggatttttttaaataaaaaattgagagagattgcaactagcaattcagagccagatttatgttcagaaatgtttgatgccagccgttttagttacaaatagctttttcttgactgtacagttgtgttcttatggtaccattctgaaagtgatgtaagagaccatgtaaaatgattggaatgcctcagcatctgaacaatgcacatagccaattattaaaattacccagtactaacctgtcttggcttaggaactatgaaattaactgtgggtagcatttctacacatatcattacagaacaagcataaagacaagcttgtttttttccttttctttggatttgttttttcttattaccatatcttttgttactgaaaactggtggtcatctgtactaatagataagagaagtgtgtttgacaccaatacctaatcttagattatccctgctattttaaaacacagtccttcgcctgcatgctcagacatgtgggttctttcaaacatactggacttcctccttaggttttagttgtgttagtcaatagttgaatgttgaaggagaggatgccaagggatattaaagaaggtaaaagagataagtgacagcaaacattatttatttttaattatctctcagaatgacttttagatacccttccctactaccttttgatttttgctttagcatagctggtgagttttggaatcagagagactgggctctgatttgtactagctaagaatattagacaagccacttaacttctttaagtctcagtacccgtatttatataatgggaataatagtaatatctaacttgcaggattgtttgtaaagattgaaagcaacatatttaattgtgcttgcgtggttctgggcacagaataggcacccgagtgtaggggcccctgaactttaaagttcattactttcatggtaattcctcctttggaatatatagcctgggaacatttgtctctagaccttgtttcagtttcttttaatgactccctttaggctctgcttcatggccaatgcaagattatggatcacctaaagagtagactaaaagtactattgtctagtaacttcaagtttgtaggttaactcactgtgaatcaaaagcttttaaaaatcttttgtgtggtcatagtttgtagtgtcttgtacctctcatctcagaagcaattgattcatagaaaaaattatttaggatttcagattaaagatgaagaactctttcaataagaaggaactgatttggttggattatttgtttctttcacccctgagttttcatggaaatcaggtttaaaaggttagaagcagttggttttcagcattgggaaagcttatctgatcaggcatgcgaagtggcctatgtcggatttctgagctaggaaaggctaggggaggttgaggagattattgtacttgtaattcctgagcatggttgagacacaaggagaggattgtggaaattgtttttaaaaaattgttgaagttaatgcattcttgggtggatttgcaaaacagaacaaaacaaaaagttgttgaagttagttacactggtctaacaacgtatacttaccacccccatttgggctggaggaatggatctaataataatataggtgtttgtgatctaatttgaatcatgtaatcatttatcatttctgggttagatggtaaggattttctgtttcacagatttttagactgggaattgtgctattataaaataatattttacattaaataatgctatctaggttgtaatcaccttaatagacatgatttatttgggccacaaatgaactctggtaagaatggagggctggttacattattttagttttacagatgaaaataatcagtctcaaatagcttaagggaattcctttagaccatatggttagtatatggaaaagccagagctagaacccaggttctgatttccagagcagttcttatttcatgataccgcataattttataatgtccctaaatccgaatttcatttctcatgatgtgaaaggattctctttatttctgtttggttagctgcatcagagcatgacagaaatggagcagaatttgagtattctttccccagatgggtcagttagcttttcttaaagctattctgtgcttacattgttaatcagttgtccctggttcctagacaggatgttgatacatgtgaaataggcaggaatatgtgtctgactcagcttaactcatcacaactttcatatgtcctgctagtgggtctataacgtcaccctcgtttacaggcgtttttaattttctgatgtctatttcttagtatttttcctcagccatttttaatgtctcaagccatagttcttcctgagtggcctgaagtgattttgctgctctttaaagcttccttaaggtttttcaagagcgtacaacataggctgcttctaagtgtatttttatttcctagctcttagcatttctcaccttatcattataactttaaatttaaacagaatacaaattgtgtacacagatggtgtgtcactattgcactgtcacttatgtaagtgcagtttagcatttcttctttccttttaatcaaaatgaggaaatagaaaatgttttgttatggtagttttacacatacacccacaaggaaatgtgtatctagagtctgtgggaactgtgactgatacatttcagggaataaaatgtatgatggctaaaattttaactctgccaaatgttcacggggaaagaaaaattaacaaactcacattttacactttattttagcctagtctctgccttgtttacatctatatgataatgaagctatacttgtctttccacaacagtgtattttataagttgtaccttttgtttaagggagccttcttaacaaactttctttcagttgtccagtgtacagaagcttactggaaggagtggccaactagttaaaggtttgacacctcaatatcaacaaaatgccaagtggatcattttgactctcacagcaatccaactggacatttgaccatgccccgtggtcagtggagagcttcttctctgaaggccacttttatctagcacatcaaggctatacacctctttcactaagaagaatttgacacttttatgttgtgagagctgagattcaccattctccaccatcctgagaagagctttgatagaagggctactcgtgaggtacatagattatctaaaatacatacaattttttcatagaaaattatatatgtattataatttttattcacgacaggttgaaattaatagatttcttacattcactgcattaaaggaatatttatggctttggtaatattttaaatttcaaattaaaaaatttgaatatctgaattaagtatctctgatttaactctgtgtgtgtgtgcgtgtgtgtgtgtgtgtgtgtgttgggaggaggaatagaccttggaattgttttttcaaaactttttttataatagtgcctaatctcagttggcaaggaatagctgtccagaatgctgcatagatctagtgaaaagatttagggaagttgtaactagtttaataaccatctgtggagtgacatagattgacacacccaattacacaagacctgagtctgagaactgttgatgtgcaatcatcccatcagcatctgctcgtcattatcaacaacaataatggctcaactatttctttgaggccacatgaaaagacagtgtacccatagcaaaggataagtcagacctgaaaaaaacatagccctctgcatccccttgttcccaaacttctttttaaacataaccttttgtgaagttctgaaagaattcattttatgttttctttttattaatttttcttcttaaataccatgtctttctggctgaaatccttgccaaaaccaggaagggccagtgtactgtgggtgatttttctaattcatttctttgtcatttgaagccttctgtggcttcatgctgctttatgtgtgtgtaaatattcagtatcttttctagtttacacttttgtcacaactgctattaagccacctatggacacattctaatataaattattttggccactgtgagtgggagggaaagaatcagttcacagggataaatttgcatgttgagaagataatatataatagtttgcaaaacacttctatgtacattgtatcttttatagagacaaggccatgtttttatttgtggagactgagacagagaccccatgagatctaatgcagagtcacatgactccaaagccaggtcttctatctgctctttggtatataactggatcattattctattgacagaaataaggaatcttcttatttttcaaaggcacccttttgcccttggaaggtatatttagaaatcctttaccagactagaaagaagacagttatattttcctgccttttgataaaaaacagtgtgttttttctaaatcttgttgtgtttgactagagtctgattaaggtaccttttgggaaattaaggttctatagaaattactgggctcaatctagtgatacaaatatgtgttgtttgatttatcaacacattacaaaccttaactttggagttttaatatctggttatctttaatatctggttatcttctttctgaagtgtatgtacacaaaattgatgctaaataaggtcttgttgttttggcaaatagtgaaatgcaaggtattggtagatcagtactgttataactttggtgcaaagttgctgcatgcagattggctgtgggaccttgttcattttttgagaactaatgtagagtttgaaaaaacaccgtaagcctgcattccagaagttctggtatggatagtgtgagcccagggaatgtgcttagataaaagatcatttaacaaataggttttgcatttttttagcaatcaggctttgtgctgaatattagagtggttgtttcagagagtttgcagcaattaggctttattggtgcactaaggagaagcagagaggagaagcaattcttggtaacttccttggaagttgcagctaactctgaaaagtctgggttgaactaggtaagtaactaattcctagaatcaataaactttgcaggagtccgtttgattgtacatgtagctccctggaattgctattggtccctaaatcatcagtttgtaatgctggttttcaaacttgagtgcacatcaagttttggaggacttgttagaatacagattgctgggctcacccccagagtttctgatctggtaggtctggagcgggacctggtagattgcatttctaaaaagcatccaggtaatactgctgctgtttgggaaagtacactttgagagtcactggcttacagcaatctcaaggtgtttggatttttgggcaggggtgctgtgcaggcgttgctgggatctcttcacagcacctccactgcatagaggtgagcctccagatgttttcattcattcaacaaatatatgtacctattgtgtgctgggcactgcttaagttgcgaggggatattgtgaagaaagtaagcaaaacccctttgtttgtagaatttcagtgagcatagtcctgggttaacctgacaacagtcctactgtttattgatgcttataggtgagcctatttctctttctagctttcttccacttaatttactttcttttggaattcttgaatttaataataataatattgatgttattagtcatcactataactttttattgagtatgtattttatgtcagacacagtgtggctaagtgctttacatacattatctcatctaatccttagaaaaaaccctggtgtattagtcttaatttaaaagatgtactttggaaaggttagtagtttacccaagattatgcagctagttaaaagtggtgctggggctgggcttggtggctcacacctgtaatcgcagtgctttgggagtctgaggcaggaggatcgcttgacaccaggagtttgagactaacctgggaaacatagcaagaccccatctttacaaaaaataaaaaaattagccaggagtgggggtgcacacctgtggtcccagctacttgggaggctgaggcaggaggattgcttgagccccagaggttgaggctgcagtgagccatgattatgccactgcacatctgtctgggtgacagagcaagatcctgtctccaaaaaaaaaaaaaaaaaaaaaaaaaaaaaaaaaaaaaaaaaaaagtggtattgggcctgtctaattgcaaagccacattctttactgcatgctttagtccattgttttttaaactgcagatcatgaccacgaatgggtcatgaaaccaatttggtaggtctccaacagcactttgggggaaaaaggggtagaatagagagtatcacatagtatggacaagcattgtttcttgaaatttttgtttttgctatgcacgtatatatgtgaatattgaggtctggtacaagatatatttctcactgtaggtcacagtaaaacatgttggtaagctactattttcttggctatgggactatatgtcatctaatcactttttaaaaacagattacaaactgtaggccttagaaaggtaagtaatttttcagctgggcatggtggctcatgcctgtaatcccagaactttgggaggccaaggcaggcggatcacgagatcaggagttcaagaccatcctggccaatgtggcaaaaccccgtctctactgaaaaaaatgcaaaaattagctggacatggtggcgtgcacctgtaatcccagctactcaggaggctgaggcaggagaatcgcttgaacctgggaggaggaggctgccatgagctgagatcacgccattgcactccaacctgggcaatagagagagactgcatctcaaaaaaaaaaaaaaaacaccaaggtaaagtaatttttcaagagcacaaaaatagtcagtggcagtacaaagacaagatgactgacttttttttttttttttgagacagggcctcactctgtcacccagactggagggcagtggtgcgatgttggcttaccacaacctccacctcccaggctcaagcgattctcctgccttagcctcccgagtagccgggattactggggtgtgccactaccacccggctaatttttttgtatttttagtagagacgtggtttcaccatgttggccaggctggttttgaactgctgacctcaaatgatccacctgcctcagcctcccagagtgctgggattacaggtgttagccactgtgccaggccagatgtctgactttttagcccttggtccattgctttattcttcacaccataccacttccttagaagtgcacctgggaatgcctgggaattgaattttatctttccacatgatggcagatatgctatggaaccttcagggatgtcggtgaaacctgaaaagggaagttgaatctcagcctgctctgagtaggtgaaaattctgccttggatcccccaaagtctgcagataaagatgtgacatttctcgtgttctgctgtgcttgaaggaaagagggtaataatcttaacagtgccaagctgtaagcatgttgcatatattaacttgtttaattactaattattttgatacagcggccatgcctgggatatgaactcagctgttttgagtgagaaggggcatcctaccagtgtgagttaacacttctctgtactctccccggttcctcattttgttcctgctgagttcagagctatgttcctcatagcctggcttacctgtggatgttctcagcctcattttcttttgctagatcatatatcttcattaggtgggtgattttggtttctgttactttttccttaatattagtatattgctgatttggatcaggggccaggctgtagattttcagcatggtgaggtgataatacatgttggtcccccatgcagaatgctgcctctagcactttagccaaaggagctctacagtctgtccagaagtactgggggacactggtaataacctgagaacacttacagagccttccagaaagtgccctttcacatcatataaacagatcatgggaagctgagggaatgcaaagtcaaggcctcattggagagcggaaaggaggctgagattggtggagaggagtggctgttacattctaattagaagaatgacatgtgcagggccatgaagcaactaaagatgggatgaaaaacttaacttgtgaatcgcaaaatttgagtaggaaggagctggaaaggcctggaagtgcgaagtgattggcccttggtcagatggctagaagatagagagccaggcatagaacccagaatccaggccatcattttgtggcctcttttatcctaatgacgttagccagaggtgtcttccaaagcacctgattatagggaagaatgaatgtcacttaccctagagtgagtgaaatagagatgccaggaagatataccaggtttatccagtttctttgcatttttctggcatactgtatactcttgagcgcatatgtatcctactttgtgaaatctgggggtaaagcaggacccttcaaacccttaaaaaatgtataccccaagaaaaacatttttaaagcatgaacgcttcctcaagtaaatacatatttatacattatataaatgtctggctattaaaccatgtatgcatatgttaactctaagtaaagcttattatatgttttttagcccataaatatggagatgttttaaaatttcttccagtgccccagtggatgatcttacacctcccgtgcttctgggatacacacatctaattttgcagaccactggtccagaatgtaaattgaagagtttaatgtctaagatatttgttcttttgtttgtagcttatcttttactccccacgtttcaaatatccgtttgcaaaataatttttgagttaaaattttcaattaaaaaactgtatccttgaggtagaaaagataaagatagaagatatatgtgaattaggttgtatctctccttaagagggaatactgttttttatctaaggagaactaacaaccctccctttcattgtctgggttggtataagtaaaaatccttgtttgaagttattaagccttcccacccatatgatgattagtttggttcataagctagagttagggcttggtaaaggctcctttttttttttttttttttttttaaagtctttccaccttaactagcaagtaagctagaaatgacagagcagtagaagggggaatctaccagagtgtcctacaggaccttgttgaatgctactgctgcatgcaagggttgtggatttggtgtgggccttctgcagtatcacccaaatttgagcagtacatgtaactaaaagtaagaaaaataaattagacagtttatttcatttcagactttggaagcccaggactgtggggattagctattagctaagacaatgattcactgagcaaatgcagtgaaagattcttttgttacactgatcatcatttgtggagagactctgaagaaggataaagctctggctgcatagtcaaaccagacctactactcaaggacatgcatactagatatgtaggtgtttccaaatatttttttcagttgtgggggtgcaaatcatttcaatagtagagtaactcagttcattactgttactggaaaaacaagtttaaccaagcacatatcctactgagggtgagtcaacagtgtcattttaacataagaaggacagtacatgaagtgagttattccaagtcctgtggttttcctacagctgagcaaagacagctgttctttcggaagtggggctctaaaaagaagttgcccatctcctttctttcttgattatagccttttagttttcttttggcctgagacatttcaaaaattcacttcctccttagatttctatcaccaaataccctgaattttgataatttatttatagagtatattatttattatagacttattatagtttaaaactttattttaatttatctcccatttcaagatccacgtttgctatatgtgtcagataataaaaatgccataaggaaaacagaggagtgatcttttttaatatgtcattattttctatagttctttagtggtatggacatggaataaggtggcattttgtgggacagtataccaaacttagtgataaaatttatacttttaattttggaggacaaaagtcttgtattctcagccttgtggataagacagtgctctgagctgtctgaggtttcctaaattgggattcaacatcatgaagggtatgtgtctggatagtttatttgttggtttgggaaggtgagtttttgtcttttttccccctctgagttgatttctttagttggagagaagcagaccagatgaagaaaatactttatctcttatggcatttttggtttaccacattagtgatgacccgtcttctctgagcagcaggccatgcttctctgttcagtagttcagttttcactaacttaactgcagatgtgttcttggagggatttatttctaagcaattgaattatgggtacttggataaaatgatgatgggttacctacttttaatagggccatcatttttaagagtaaaatcttgtcaagatagggtatatcatacttatgatctggttccatctctaactccataatttccttgtgctcctgtgttgctactctattattgagaagagatggtatcttgtcagtgtcaattttacaaagaaaaaattctaaacaatttcagtcatagggtagtttttttttttttcctggagaaataatgcatagtgtagtatgttgaatcctagagttggcaggttttcaaaagtggggttcttttgttgtgtaggtaggggtgatgctagtcaatgggtgttagtcattagggcatgtgtatgagtggtagttctgagatacagcattggcagcccctcttgtccctggttttgtttttgataagcaagtcctggttttgttttaataagcaggtcattagctgatctttcgtgtaaatgtttttgatgtgcatagctggtatgtgggtggttacctacctgagaatgttgtagtcacaaatgtatattatggaagtttgcagattatggtggatatcaggtttttctaactgcgtatttacagatgtagtgagtgaaaggaatgttgggtcagtaggtaaaagacttgtgctctggtcctggttcagacatcttgatttgtgtgactttgggcaagccccttatttctttgagttgcagtttcttgtgtaaaatggtgctaataccaatttacatgcctcatagtgttgttgtggggatcaaatgagatcactgtttatgagcagccttctcaggagtgagaaatagagggttgtgagctgactttctgatttgtttggctgaggtgttcacacaagccatagaatgctttgtaggcttgggtggaggaatgtagatggaaatcagctgaaaatccctgcctattagaagctgagatgttaatcctaaatatattctatggagtactatcagatgccttgcttttcttcatgatgccctattagcttcatcttcaggtagcataggtgcctgttactctcattttacttgaagaaactgaccagccaactgatttaggatatggctggctatcttctggaactcacattagagttactccttgagagtaaagtcttgtattttctgaaggttgctgcttttggggtattttccgtggaggtgggtgggcacacacaaaaactcactgtgctcaaatttataaacttgttcttcttaacaattttaaagccagattacattggattgggggaggggaggatactagatttagtgttttttaatataaaactttgtatttgaaactttatgtggtaacatatatttaggctcatagccaaagtgattacaatgcattggttttaatattttcagtgaggtaatgtgtgctttagtggggaggaggagaaatattatttaatcaccagcactacactaataaccacatttactaaatcctttgtccctttgcttgaactgagggttccttgcttttatactggttttccaaaggacttaatcttgttaatgtgatgaggtgatgatgggaaggacattcccactgggcccgaagtggtgaaactggtaaaactccctttgtaagtccctcttgttcaacatgagtgtcactcccatgtccctaaagtagaatggagttttattgaagagagaattttaagagtgataaacaaaagagatggaaatatctcctgtgccaggtcattgttaccattaaagactagaataaactgtaattttgcagattttctttttgtcttatgggaaattaaagacttggttatcctctctcggaggaagatagaaaactactgggcctgctcattaacagtttagcttggctgacatttttcaagcacttaccatggtattatagctgggctgaagctaggtggagcagacctcacttaggtgttgcctagctccagaatctgtcttctggtggaattcccttaggcttccagacaggagtggcaacaaagcagatgaaatggaaggtaggccagggcatctgctcgttcgctcgctcgcttgctctttctctctttcccttttctttcctttcctttcctttctctctctcctttctttcttttgcttccttcctctctctttccctttcccttcctctctctcttttctttttttctttcttttttttcttttcttttctttcttttctctctctctctttctttagcagtttattactcatttgtgagaatcagggaagcactgggctcaagaaagccaataccccttctagggcttaccccccattttaaaatttaatatattggaatttatattgtttcttttgatccgagatcttcaggctgaagctggagagaaatcttttgacctctctagaacaaagaaagcctttatcaaagacaatgtaactttttgagtttgccaaattaggtgttgctgcaaatggagaaacctagagttctcttctgtgcttaaagacacaaacatggaaagttttaagttccaatatggtcacttaatatatacaaaattttctgtctttgctgtctttgtcattccagcaacaactggatgagcaaatagaatgattgtgagcacttgcaaaccaaattgtgactgttagtgtgttgagctgcttttttattaaaatgactgctacaactctgcagaaatctgagtagtcttgaagataaattcttgcttgcatttacaataaagaaagaatatgagtaatcaaaaggctgatggagttggaggactggcgtttttaagaggaactgatttggacattgagattatcagctcctcatcaaatatcattaagtacacattattatttttttctgttgaccaggagacccaagttgtgttgatgtgggacatagttgtatgtctgaagaaacaaagcaagggagaataaaataaataaaaattgaagttcaggaatatatatatatatatatatatttttttttttttttttctcaggcagagtcttgctgtgtcgcccaggctggagtgcagtggcacaatctcggctcattgcaagctccgcctcccgggttcatgccattctcctgcctcagactccctagtagctgggactacaggcacccgccaccatgcccagctaattttttttttgtacttttagtagagatggggtttcaccgtgttagccaggatggtctcgatctcctgacctcgtgatccgcccacctcggcctcccaaagtgctgggattaaagacatgagccaccgcgcctggccgtttagggctatattttatgttttcttctccctttggtatttaataaagatttgatatttttctattatctgctttcctctgttccaaggtttttggcctcaggtgtgttctctggaaatggcaatgataggcatttataatctccatatttagatatttccctcacagtgctagtttctgagcttattagaacctaatgttaaatgacgagttaatgggtgcagcacaccaacatggcacatgtatacatatgtaacaaacctgcacgttgtgcacatgtaccctaaaacttaaagtataataataaaaaaaaagaaatatcctggctatgagtcaagggtttaggaccttttgaggcacttgggtttagacaattctcagtgatgtgtacaggaatttgggtacaggaatactattcacaggtgaacagagtttgattttggctgaaggcatattatttgatccagataataatataaaaataatccaaatgttaggaccttagcttctgcgaaccctgacttgagaatagttagccatacatgtagttggactttatgtaggactaaccaatctcctctgcactatttttgcacagtacattgattatggtatccctgatgacctctgtccccatccttgtgagtagccttcattgctaccacccaaggatgttttaaaaaggctatgaggaaggatgcatgtagggaaatctgaggttgttctttggattttccctgttttgttttaggaagtatccatgattttatataataatatgtagcaatcttaggtttttccattttcatttttaacataattttgttattcattctgtttgggtgtctacctctaaattaacaaacatgagaaattgtgtactccatttaaaaagtgtcctgagcaatttaagctaaaagaatatgttgtttcttttgtgtgtatagcaagaagattatatatatttataaatttttttccagcaagtgtacttaaaagcatgtacttaaaattaaggacttaaaaaaactaagctgtacttaacaaaataatctttagaaagctttaaggccgggcgcggtggctcacgcctgtaatcccagcatcacgaggtcaggagatccagaccatcctggctaacacggtgaaaccctgtctctactaaaaatacaaaaaaaattagccggttgtggtggcgggcacctatagtcccagctactcgggaggctgaggcaggagaatggcgtgaacccaggaggaggagcttgcagtgagctgagattgcgccactgcactccagcctgggtgacagagcgagactccatctcaaaaaaaaaaaaaaaaaagctttaaaaagggagtttactaaaagcacaggaaattggtgacaggcaaaatttgtcttgataatagtacaaatacagatagtggaacagaacagataatacaagatataagacaagacatggaataacacttcatattcactttctttgaccactaagcagcacacaaatatatagcactttttgtagagaataattaaatttctagatatgatacagcttcttcctctctgttgggttttattacactgagatcctgaaccttttggacatgtaaactgtgatcatgttggtcagtgtcatttggatctcgttggtgcttattgttctgccgatgtgtattagtgaacctactcatggggaagataatactatacaatgaattttcccattcagttggaatttttttattactctgttttctatgtttttcatttagatgtaaattattttggcttccattcaacctatttcagctagtttttaccataatacacatggcttaagatttataggaggctaagagtggagagtgtatcttcattcaaacaaatggtaagaaaggaactttcaaaactgttttagttttgcaaagattagaaaagtacaattctactttctcaacttttcatccttgttaaaggcctggaaatttgcagcatttttttctttcttattttacttttctaatttgttacacaaagtgaaattccacacataaacatgcaagctgaaggttgggtttattcataggttttgtcttaattatagatatttagtttattgaatatcttattgagtattgagtacctgctgtggtccaggcatcttcttaggtcccaggtgtacaaagaggagccaattgtggttactgcctctatggaatttgcctagaagtgggagagagagagatgagtgagccagcacttataatacatctacctaggataaaatgggagcacagaagaggaacatctgtatcagtgggtctctgagagcttcttcaggaaaataatgctttatctgtgatttgaaatatagtaggaatttagcaagatagagaaaaaggaaaaggaggtaaaatatttttcaggtaaaagaatgtacatgggtatagaggtgatcattattagcaaattggctacatcctaatttgtaagtatttgtggatttttcaaaccttatatttcatgtagaagagctgaatgcattagtctcatctccaagatccaggtattgaaatttaacccatgcataaattgaatttttttctgaagtctttaataagagaaaaataaaaggaaaaactacacagtgtatagtagatttcaatatagcacagcaaacactgatgaattttttttgcaatgagttcaatattataaaatagaacaaaattggaatttttaaaaccaaaaattattctagatttatcagctaactggaatgatttttttatagtatgaaaagtctgttagtaatacaaaaaatattcatttataagttgttatcgttgattatattttcttaaggtatattttcagtttttgaaaagcagtaataatttgctatgaccctatagcccagttcttaatatctggatctgatactagcatctcttaggtagaaaacacactttctatatgataatatctgtaaagagcacataaatccttggaacactattaggaaaacaaaatcgatttatctcttattgcttttttttggtttttttttttccttttaatcaagacaaatttcaaggaggaagacatgtttctccgcttcgtttttatttaaatgtaccacttgggatttgaagcttccgcacttcttctgtttgtttggatttttttttcatggcttggtcccaaaaaatggaatacaaaatttagagaaagttttgtttgaaattgcagggcgctatgagaattattgcaaatccctgatgtctctttgtctgccctcaattctcctatttttggtaataatgcaggcagtcattttagaaaactttgctttgttcattttactgagcctcttccagaggccatgtgccagaatcaacagcagccaaccacagccaagatcctagggcgtaaactcagacttcatctctcaaatattgctacttgaaatttgcataaacattgaagaaaaagttaaaagagcctgtataactcctcttcatgtattttaggagcctcagacagtcaagacattaaaataccttccgattgagcagtgggtctaagcacagataccacactgcagatagggagaaggatatgaaaaaaatcatgtgagatagacgacagaggcttatttgaagaagctacaaagcaacaagtaatgccagtttaaaacgattacatgttaatgcaacaagtaaaacacattgaaggctgctcagattacactggctgaagtacagacttaattactcatgttagagattcctaaaacaaagggaggcttttaagccagtgatatgtagctggtatgatattgaaaagcattggaaaacctaggtaaatgcctagaggaaattttaaggaagagtccatcaagtctggataccttagccttatccttaaatgaataaatttctgaggcgctggaactggttaaaatcaatggcagcttgttctgttgttggcagttttgatgtataattggggctgataaacctgaataaataaaagagccttgtctggattgagttacagttagtgctaaacatcaagggttcctattgtatttcttaaaagttctttttggagtgattccaagattggtattaagagggtatgccaagggtatatattggcaatttttattttgtttgtatttatcttagagtcatttgggtaggtcacattctctctgcccctactcccaacttctcattagattgtaaggaccatgaggacagagattgtttgttttatttgtgcttagttttcatgcagtgcctagtaggggacaatgctgacagtagtttctcgacaaatattagtggaactgtattaaaattgagtttttgctcacatatattgtttattttacctttagtggatcacttctccttatgccttcagtgctatagttttttaaaagaagtatgttagtctgttttgcattgctctaaaggaatacctgaggctgaataatttataaagaaaaaaggtttatttggctaatagctttgcagattgtacaagaagtttagagccaacatctgcttctggtgagggcccaaaaaactttcgtggctgaaggtgaagagggagcaggtatgtaacatggcaagagaggagggagcaagagagatgtcagtctctttcaaacaaccagctcacatggtagcgagaactcactcattactgtgggtgggcaccaagctattcatgagagatctgcccccataacctgaacacctcccagtaggccccaccttcaacattggggattatgtttcaacgtgagatttggaagggacaaaatagccaaactgtatcaagcacaaagaagatacagagatagtcaatggtggagctagtattcaaacccagatttgtctgatttctgcatccatgctttcaactgcttaactgcattgcttccaatactcagaaaagacgaaatgttttccatatcccaggaacttaaaagtgaaaaagcagagagctagaagaccctgtagtgctgaattgagagtcatgagtgttacaaggatgggtgggggggtggccctgtgaggaccagaaccctccaggggaagctttctgggtgaggcaagaggtgaactgggccttgaaggaatgggtagaatttagatagtaatgaggaaggcagaaatcagtggaagcacagacatgcatggaggaatggaactgagttcaatgacgatctgttcaggaaagagggcataaactgggcagagaatgcagtggaagtggtggggagtaatactgggcacgtaaggtaagctctgatctggaaggccagcatgggagcctagactggttaaagtaagaaatggcttgtccttggaagaaaaagtgtcaaacttggtactgtgtgaaggtactgcacagacctcccaactggttcttaggagagccaaactgaggctaagttctgagaactaagtaagaactgacagccattgtaggttagaaagtagtggggcaacatgttacaagtagtgcttctggaaggttagatgcggttagaataaaatcattgccattttggggagctgggaaaatggatgtcttcagtctagtctaaaaagggatgacttgaataagcttatataagaaagaaaagaaaaacctttttactcactggaccatttcataatcttgacttttttcaaacataaatctgtgtcatttttcttatttaaaacagctgagcagtttactctcctacttagagctgtgatccttatcatgggctcttgtgatctaaccccagcctgcctccctggcctctgtccttgcttaataacctctagccatatgaacctggaataccagtctaattcccacttcaaggcttttacacttgttgtttcctctgcctggggtgctattccctcatatcttcatgacacttgttcatttacattgtagctcaaagcatacctcctcagggaggcctttcctagacactatctgaggtacactcctgcacccccagccttcatgattgctttttatacattactgggttttgtttccaatggaacttatcgcttattactgtcctaaattattttatttattaattttttagccacctttctcttatagaaataaggttcctgaggacagggagtttattctgtatactacggtatccctgacatcagggcttgtgcctgccgatagtagatgctttctaaatatgttctgaatattagatagctagttcccaaatgcactgcactgaaagtgtatgaaaattggaaattggcttctagatttttgtattatattgccaaatgatggagtgatgagattgaaatctactacttctttttgccttttttttttttttttttttggtggagtagaggagggcctgcacaaacagcagatacacacacagtaaataagatttatttcagccagcaagtatttattgacatgaaaattggggttaaatgtgactctttgtgagtgactagtttcttggagtctattaaagcatcagtttaaacatcaattctctatggtatgattaatgtttctttttttactttataagcatgaagctgccttcaattttattgttaaatttaagtgttttacattggaaaaaagtaaattgaattttgaaatgaggtctgtcccggtctcactttcatggcttcaggttatcaaagttttaatttctctttgtatggaagataattatagtattcatttttgctcctgagtaaagccacgagtctcaagattatttttcttttttaaaaattagaattgtcagtttatagttgtatacatttatagggtacaaagtgatgttataatttgctaatacaatgtagaacaattaaaaggtagttagtatatcctttatctcaaatatttaacattttttgaaatttactctcttagcaattttgaaatgtataataccctattattaactatattcaccacactatgcaatatatctcaaacatatacaaaaaaattcttcttgtgtaactgtagctttttgtacccattgatcatcaggcccacagcttccgtaaccaccattttcctctctgcttctatgattttgatggttttcaattctacatataagtgagaacatgctgtatttgtcttcctgtgccttatttcacttagcataatgttctccaattctatccatgttgtctcaaatgacagaatttatatctaaaggtggaatagtattccattttatgtatctaccacagctttttttttttttttttttttttttttgagatggagtctctctctgtcactcaggctggagtgcagtggagcaatctcggctcactgcaacctccgccccccaggttcaagtgattctcctgcctcagcctcctgagtagctgcgattactggcgtgctgtaatttttgtacttttagtagagatggggtttcatcatcttggccaggctggtcttgaactcctgacctcgtgatccacccacctcagccgcccaaagtgctgggattataggcgtgagccactgtgcccggcctatctaccaccttttatttatccattcatctgttgatggacacttccataacttggtatgggtgtacagacatcttttcaataaactgatttaaaatatctggggtaaatacgcagcagtgggattaccagatcatgtggtgattctattttcagttttttgaggaacgtctgcactgtttttcacaatggttgtactaatttacattcccattaacagagtagaagggttccatttctccacatcctgtttattcagacgatatgttatcatctaaatcatctaagacctctatattatatagcttttgagtatttttaaaagtggacactcaagcgttcatatagtcatagtcagtgtgtggttcctcagacctgtggtatcaacatcacctgggaatttgttaggaatgcagattcccaggctccctgcagacttagtcagaaattgtgggggtcgagtctaacactcttttttaaaaagccctccaagtgattccagtgcttactaaagtttgagaaccgtggctcagtaaatgctaaaggttcaaggtagcatgatcccacacatcagccaagtggcattaattattagcctggtaagcccaccttcttttcagtcactgagtttgattggttcactagggctaggctgtaaagttatttgctagattgattgctacatattgactttgggttgtttgtatttctctgaacctgtcactgtaatgatttgtcaggacacttaataggaacaggccgtgatttttgcacccatggcattctgagtcatgggtggctgggtcattatgtactccaggtttcttcaggcactgggcatgccattcatgtacttataaggagggagctgtcgctggtggatcacagggaacctttagggacatttagttcgctctcagcttggtacaggtagggaaattgagcccccatgaagttgtgctttgcttgcagttaggggtacagacaggatttcaggtctcctgagtccctccactgcaccaggattcctgcagggggacagagctacagctttttctgtgcctacaggacattcctttcctactgtgagggttttatttatttattattttatttaaagaaaaaaagtaaatagaaaaaaccccggaagttctcactgaaactaataaaagtgtctaaagagaatgaaaaaatcagtttgagaactttggtatggaggaaataacctgacattaactgttttaattatagttgttgcattgggcttatcagtgtgggaagagggagcatttgagccttacagggaagtgggatatggacaacaagatgaccctcttcctgaatttgcctgtttgggcctgcagcctggtgactctttgtgtgatcccaacagctgtcatagagatgggttggacttttactgagacctgggtcctaggcccagcactgccaccagctagtggcgcgatgccccataaagaggccacttattctctctggcctctactattggtaaatgggtataataatatccaccctgccaatcctgagaaatttcaggtagtgggaagcagtgtatcttggtggttaagggcagagtctctggattcaaattctagctttctaactcactggcatggcagtaggcaggccacttatcctccctgttttctcacctgagaatgggtataatgaaatttacttctaagggttgttgtgaagattgaattagttagctaatttatgtaaagtacttaggatagtgccggtatttagtaagttctatgtgttagcctattattattactattaccatttaaaaatactatttcaaggatgggatgcattttctgtaaacatgttctcaaatgattctactactggatacaatactgggcttttatgcagtaattgttgttggaggagttgttctgacatccagcttgcacctgggctactggtttcgtggccagggatggccaggcctagcgtctctgatcttgcacaatttatgcatagagtggtgtggttagaggaaacttggaggggggaacttctcagttttgctttcaggtatttatacattaactatcataagagatggacatcttaataacttccaagaaagagttcatgagcttcaatttgatatttattgtttgactaggtttctttctgtcttacctttccagttgttagggttcttgatatgtattttggtgatgaaaatttcaactctaaaagctaaacaatcaagatattgtaattatccagcaagtgattagcagatttcgagtagacttcttccattcttggctgaaatcaatgaaaatgtctactattgctgttgtttttgttcttttctctgaaaagtctgtttttgggagggcctgagatggtaaagtgcctttttattgtctcttaaagggaatgggggaatcaacagtttgagaatttttgttttatctgtatgtataaaattgccttctccttttatttcttttgatactctctctgcagtctctattcatgatctactccccatctttttatgggccccttaaagctagagattatgtttattcgtttatttatgtattccatttctccttttttctggatcctaattttgtgcctggtgcatactaggctctcaattttagtttgtcgaattactgttattgctgtttctgattacttcttgaagcggtctgttttaaaacttcacctgaaggctaagtaattcatcagtataatggtgatctattatttatctagcattttcctaaacactcattgatgaatccttataatactcatctgaagtatctaaatcccaagatgatgtgtcatgtcatagatggtatggctttaatttttaattgggagatggagatgtaacagctggagatactgaaacacagagaaataagagcatgattcaagaccacaaacgtggttattgttggaagatagttttgggatgggcttctgtgctagaagccaaaacataaaaaactgattaaaactctaaaaagaaacccagattaggtgggaatgaatgctgatctggattggattacacttctttggtgtctgagggttatgattagtgacttacttctaatgtgcatttgtttttatttttagcattgcagtgtcgagatggctatgaaccctgtgtaaatgaaggaatgtgtgttacctaccacaatggcacaggatactgcaagtaagtttttctcttcatatattttctttttgcgatagaacactggacaagatttgattctactcctctatttttaatgcttctgtggaatgttactggttcttgagctttcctggtacagattttggttgggggtgaggatggaaggatgtggatgccagataattggctaataagaacttcttactatcttactgttatctttctcactatgaaaaagacttttcagtgagtggctagttaatgtatatggggtagaccaggcatggtggctcatgctggtaatcccagcacttcaggaggctgagttgggcgaatcacgaggtcaggagttcaagaccagcctggccaacatagtgaaaccctatctctactaaaaatacaaaaattagccgggtgtggtggcgcatgcctggagtcccagctactcgggaggctgaggcaggagaatgacttgaacccaggaggcggaggttgcagtgagctgagaccacatcattgcactctagcctgggtgacagagcaagactccgtctcaaaaagaaataaaaaaaaataaaaaaatgtatattagattcccttgtgtttttcagattaaggaatactcttagagtctccccttaacatgttacctattatcttgtttttaagtaaaaccaaatagatatcaactttaatattcggcccagtatatgtgaatattatattcatatttttttctagtgtaaaaaatctaattctgaaagtgagacagtgagagaggaagatgtgtgcatatgtgtagattgagggggagcaggggctttgggtgtgtattattatatggggataaaagagtaaggatgaaggaaaatgtaggctagttcttggcttaagagcatttttttttcctttttctccaaccatctactctagccaagacgttttgtttgtttgaggaaggctgtgagataatttcataatagcttttctatgtttcctgcaaataattttttttcttctgcctcaattgaaaatttttaagaggaatatgtatccattctgtttatttcagggaagatgctggagaaataaaatttggtaatatgaaatttctcttcttttccttcatttttgtgaggagtagttcttctttgctttggtggaggtacttgcttagtaagcattttaagtgagtttatccaacacatttttatttcttaccaggaatgtaattacaacttttttccagtgagatctgttctgacaccaggatttagttttttaatgttataaacaagatttttttttcaagtcagaaataattttcttcactaaagtgaaaattaagctgtgatgacagtaaagcttaacaataggttgtttggattggaataaagataacattggaaataaaggttttatgtagcttattatgggctgctcatttagtttttctagctgggggaaaaaaaaatgtggtgcattctcctctaagaatggagatacaactggagataataagggagggaacttaataccttagagtaggccactgaaatcttgtttagtctttttgtggcatttggtgcgttagttgcttgctttattctgttatgcaactcttgtggtagttaaccccattgcattatggtcatttgttgatgtgtttcttttgctagaatgtgaggtcttagtcttatgcattttttgcatagttaatgcctagtacagtgcctggtgtagttattgttcagcaatgtgtttcttaaactaaaaggtgctaagtagataccgtcatgcacatgtttcttatctatttatgttaaataagaagacactggttctctcctttaaaaatttcagtgtggcgattcctcaaggatctagaaccagaaataccatttggcccagcaatcctattactgagtatatacccaaaggattataaatcattctactataaggacacatgcacatgtgtgtttacttcagcactatttacagtaggaaagacttggaaccaacccaaatgcccaacggtgatagactggataaagaaaatgtggcatgtatacacgatggaatagtatgcagccataaaaaagaatgagttaatgtcctttgcagggacatggatgaagctggaagccatcattctcagcaaactaacacaggaacagaaaaccaaacacggcatgttctcactcataagtgggagttgaacaatgagaacacatggacacagggaggggaacatcacacactggagcctgtcagggggtggggggaaaggggagggagagcattaggatgaatacctaatgcacgtggggcttaaaacctggatgacgggttgataggtgcagcaaaccaccatggcacatgtatgcctatgaaacaaacctgcacattctgcacatgtatcccaaaacttaaaagcaaaattaaaaaaaaatttatttatttcacatagcattcagggtggtaataccatacagagaggcaaattggttctatttgaagatcattcaacttggtgacttatatatggagaatttcaaatatgttctaagtgttcgcctatatatttttggtctgacatggggagagaaggtttctaggggagactaatctctgagcacttaccaggagaggacacctaagggtcactgttgggaagaagtccaatagttctttgttggactgttgggctgctagtctcatactctccaaccaaggttggagaccatcctggctaacacggtgaaatcccatctctactaaaaatgcaaaaaattagctgggcgtggtggcacgcacctgtaatcccagttactcgggaggctgaggcaggagaatggcctgaacccaggaggcggagcttgcagtgagccaagattgcaccactgcactccagcctgagcgacagagcgagactgtgtctccaaaaaaaaaaaaaaagaaaatggagctgcctaaattctgtccctggctacttgttaattgttgataggatggaatgcttatggatacagttctgggtatgtccctcagatgtctttcctgttttgagggaaacaaactccttgagagaaagaaaaaatttggtgaggccatccttttgggagaccaagatgaacaacaaaacttgtataaagagagtgattccctacctcagcaaaagtaatattagcatatttaggagtggcagggtcaacataagtggacaaagaaaaagcaagaacaatatcaaggcagccacgtcaatcattctacagtgctttgccagcctccacagaattttaagcaaaattttatgcaaaaataatgtgtacctagcagagctttcagtgtattttcaccaaccttacctttttttctgtggagaaagaagatgatctagcttgttcagtaaatattattttcacaaaatagaaaatagatattaaaacagaagatttataaaaattctatcaggcatgcagggcatgtgattatctttttattcatgcgattgcttagtggattaagaaaagaaagttgaagccaaattccttttacagggccagcgtgggggtgagtggtgagtggtgggatgggaactggtagaaagtgttttaaaatagaaggaatctgactatctgtttagacagcataatgctactgattcagctaaaatataatgattgtttatagaaattataaaaatccttgataagatcacattgacagatgaagataactacttttgaagattagttttgtactcagctcaactgttttttctcagtgttaggagcctaagtaccctatcagtctgtgattagattttgatgccagattaggagaacttgtataatcttgcataaaactcaattattgctgttaaataactactgtcaaatcttaataaagccctctcactacagggagataagatattttattctttcccttgtcctactgggaggtgtaaatatgtaattaaatttgatgtcattaatcactttcaagttgtttgcttcagattttcaaatataaaccattctaaatcccaatttgattaaagatcatggacaactcaagttcactaggattctgggggtaggttaggttatgatttgtataattgacaaaatatgtattttaaggacatttattgtagttatttaaaatctttgtctgctggttcttaacatctgggttgtctatggatgtgtttctgtttctatcacctgctccttctttggaccatgggtatgacttccctttactttacacatgtatggtagttttacattacttactggacattgtgggtgatagattttaaagtttatctcccactaaagaatgttgaattttgtcaagattggcagatcatcttgatcctatggatgctaggttttaggacacgttagggtgggcctacttctgttctgcccttagtccgatgacacaaatcttagtcatgggatagggctcttattcccaagatgtgacccttctaggggttcagtggaaagtgtgaggggcctaccaagccctgaggtgttcattaagcccctctaaggcagaacttgtcctcccagccccaggagccttctgctcagtcttttcagccgtccagctcttactttctcttgggtttctgaatcttatcttgctcatgcatagtcaggaattatttaaggatttgagcagagttgtatgcatactttgaagctacccactctgtggttctgtcttttccaggaatttttctcctcatattctagctgctgtgacagctccagatacctctgactcctcagtatcgcaggacttccgttttctgcttgcacactcttcctcttctgctgcatgaactggggtgtaccttcacgataaaaaaaaaaacaaaaacaaaactgtaaatgtgggtttcatatagtttgcttcgctttttctgaggcttatatcccttctagtttatgcctgctttcagtgattctccagtgcctttgatattttgtccagagcaagagggctagtctgatatgttactctgcaattatttttaatgatgaaaattggaaatataaaggggcctttcagaatttcatacataccacttggtaaatatctaacatagtgtttgtaaaacagcagaaagtcaccgtgagttgtatacgttcctgtagatgggtgcttgcatttgagaatgtccactttttgctaaagtgctgatctaaaaactacactttaaggtaaattattataaatataaagtgttataaaatataactttgtgtcacattttgtctaaaacttgtctgctagctgtaataaacattaaacattaacagctaacaattctccttgccaggattaggcagtcatgttggtggtccagatttcctgaatccatccaagaaaaactagagccattgccttctttgtcttcttggtaaatgtctgtatagtaagtagagagtagagacactcataatcccttagaacttagctttttatggaggatgcattcgcaatgtttctgttgtggtgcttctcccccaaaaaggcgttttcagaagtcatggctgactcagcatttccccctttccttcaccttcttgtgagtgcattcagggaggcacaggggcattgtcagatcaaagaaatagacagggaaaaatatcaactgttaaattactttctctttcttctcagctgaaactggttctgccagcctagttccttcaagtacggtgcctatttagctgaacattgtgtgtatagtttttctggaaaatgatagcagaagcttggccagttttccatagttcatttatctttttaacataaaacaaagaatgctgtttttttggctcattaaatacctctcatagagtaatcttttcttaaaatgtaatatgttcaggttttattaattcaagagttatttattgcatgctatttatgcgtaccacatataatagataactcaagtctgtggtagtagttgcagttaatcaatattgttatcatattatttcacacttctttgggaagtcataaaataattaccagttcattaacttgggcttcttagagaggttcagagtaaagccaagtatgaaaaaaactgactataatgtggccttctgtacaggggccaccagtgaatggcagggctgggaccatggtgaggcaagtaaggcacaggcctctcttgtgaaatttaagagagtgccaaaaaactcactaatcaaaataatgtttgtatgtagttgttcaaaaaatcaaaattaatgcaaaataagttgaaaattatcaaaattttaaataaggagatcagtagtactgattttttcttttgccttatgacctagtatggttcagcctgcactggtgagtggagtaagggtcctggaagatccttgactggtgacatgaagaggacatagttttttgttgttgtttttttttgagacagagtctcgctctgtggcccaggctggagtgcagtggcgctttcttggctcactgcaagctccgcctcccgggttcatgccattctcctgcctcagcctctcaagtagccgggactacaagcgcccgccaccacacccggctaattttttgtatttttagtagagacggggtttcactgtgttagccaggatggtctctatctcctgacctcatgatctgcccgcctcggcctcccaaagtgctgggattacaggcgtgagccaccacgcccagctgaggacataggtttttttatgccagatagacttaagtttgagtcctgattcctattaacaattggatctttggcaagttaaagtctataatgctagctaacattattgcgtattagggtctgttctcaagtagtttacatgtatttactttagtcctcatgtgagagagagactatatggaagctaagagaagttaaataattcactcaagatcccatcactctgtagctaacctgagatatactcgtggaaaatgtactgtcacgttgagtctcagtttgcctgtcaataaaatgggacagaattacctgttttaagttggtagttcaaatggaaccttctgaaaaggaagtgtggaacatttgaaagtatacaaaaaggggacttttcagatcaggaatatgattaaaacactgctttatgtaatttctaaatttaaagacagtagcattaggtaggcctgagtacctcatatcattctagaacactaaatctgcatatagttacatgagtgtacatgggccaggtttggtgaatactgcatttctgagaaatggcctttaacatgaaagctcaatgtaataactgtggatgaaatagaagaagagggcagtgaaggtggggatagaggatattgtctattaaagtgtgcttcagtagagagaactaatttgaaacttctcctttctttttactaatggaacaggagcaagtccagacagatttatgcagttgtgaaattgagacaggttaaattcagtgatttttgataaatgttgttgccagcacaaaagtcacaagttgttgaatatggcaccttacatttgcatagtgagttacagatgcataggagtatgtcctgtgaggcttttccttgtattaggacttgagatctggaccctttaacagtacctttcctaagtgattcttattaatacttatgtcctattaaaatcctttatcaaatatgatgtttccctaaggggtcttttgtaaaggaagtcttggttactagcatctccatctgtggcccaggcttgagtgcagtagagcaatcatggatcactgcagcctccacctcctaggctcaagccatccatcctcctgcctcagtctcccatttttaaaactttttatagagacacggtctcacatgttgctcaggctggtctcgaattcctgggctcaagtgatcctcccacttctgcctcccaaagggctggaattacaggcctgaaccactgtgcctggccagttagtagcttcttaacacatagcaacataatttccatactattttcaactaatttttattctttcagttgggacctttatatatttcagtgttcagtgaagaagtaggagaatctggttcttaggctctgcctatatccttttacctgtcttgggtaactgccaagaaattaaatcaacaaattttggcctgcagtctggcattaatagatgtgaatttagctaggtttctttcaacacagtctccaggtcaatcgtaatcttatgtgaagtttcttattcaggcatgtctcgttagcaccattaatttcacacaggaattctttttttctccctttttttgtgactaagcaaaatgagaaatatttctctttcaggatatggagaggcttaattaaattctttaattttgtctacatctgcccttatgaatgatagcaaaggaatgggggatatcagaatatgagaaaaagtaatcatctaaaaatttccaagcactttaaaatttattaagctagcataaatatgtgggtgtgatagaggttttcattaagcctcctctcaacatacagtagttaggaatgaagtttagtgtctctccgtcctcctgtcatatgtgtgtatgcacacgtgtgcacatgcgactgtgttatgcattttgttttcatatttcttttagttgggttttaccttacaacccaacgtaaggtaaattaaaatttctattggatttccgcacattttctagatcctatttattcactgtcagtgaccttcactagcacttagtcctctgagtccaaaaatgtattgccaattcttagactccatcagccttctcctatgaaaaagtaatgcagttaatttctgctcaaaatgctcttctcctaaacagtcttctacttgatctttatgaaaagagttttatgaaagaaaagtgaaaataaagactaagaaagacattatttaagtgatgggtgatattattcagtgaacacattcaactatagcattctatccagttttttgccttcacgtaaatatgaggagaaaggtaggtgttaataagaaaataatctgattaggatttatgtagaatggtagcatttagggtattaaatctgtatagattcaggtcattttcctgcagtcactgtctataatcctgtgtgctgaacactgaaagttagatggactctgaagcgctatagaatcctcacttttcaaacaaaagtttaatttttatcacactagtatttattgagcaggctactataactgatcactgtactgggtattgtgaatagacagaaaagcccaagaggcctgtgttacctgacttctttattcacaagtatacgtacccagagactgtctgacagtgaatgcagtttctcctgcataagacatggtggcagtcttctgaagtcttgctggggagatgaagcatacagagatgtgtaaaataaaacagtttgtaatatcccagtgtaggggcacagataataactatggacactcagacaaaggaacaagtactgtgggacaaaagagtaaaatcagaggacttttggtgcactgcttagatcctaaatctttgaatattagtggtgccttagaagatggataggtaggagaagggtgagaggaagggagctgaggagactagaagggactgttatttcctggaataatcattaccaatttcttcatcacgttttcttaatgacacggtttcaaacgttttcttcatcttgattgctgtcttctgtgtatatgctggtttgtgtgaggttttactaaaccagtatgtggattaatctagtttcacagtgacaggtaagtgatttagaaaatcattcctttagcacatgttaacttgaacgtttggaggtagaatgcctagagtgagggtgaaggagaggacctggggacaggaagagagggcagctgggagcaattatgctccttccctcagacctttttggccttgactcttgattcttgtacttctaccagacagagaggcggtaggcttgtggccatgttttgcgaggaaaatcagaatctaagaatctctaaggcaagagcaagaatggattgggataggggaagtgataggaaaacagaggcactaagaagagggttggttttcatgtactgcatagttcattcccttagttgagaaatcaggtatctcaacctcagatatcttctgtccagcatatcgctggccagatctgattcatatgagggatccagagtaaggaagcatctgttagccaagtctttggttaccccaaattagctcaggtcctttactgcttgtttcctctgattatatagtacatatccaaaccctcaattttccagaataaactaggtctgcctattctgtgtggaaaacatttgatggtggttaagattctcttgcctagacgatggtagtgccttagtcgtttaactgcctgtcactttaagattttgaaatactgattcttgttgtgtaagccagacacatcttgagaatattttacggggcaacttgccctttctgaaacctcagtcatcctgaaaagtaactctgtacctccttgactttaatttttctgtcttaattctatttgtatacaatgtttgtggtgtctgattctctgtctcgtattgctgaaactcatggccttgaatttctgggtcactcttaaaaaatagacataacttgattactaatgaaaaagtgactcattttcttccaggcaaaggctgacactgactgtcacagtttgtgacagaagcagactctctaattaggagacatcacctattcttttctaaattttataagaattgatgatagcatcatgagatgggaagtgagtaagataagcgtttatgcttgtagagaggatgcataaaaatgaaatctggataaagttctatctgaatttacctttttaagtggttgattccctgtgagcttaaatttagtgcttctcttcccagaccgttgtcttacatacacacttcagtcagttttagccttgtataactaatcagcaggtcagattccatcgaggctgaaatacctaccaccattctatgctcaagaaaacaggctctcatgttggccagttgtttgggatagaagatggttagacctttctatcctttttaaacacaagattctttttcattccccttatcttgtttaaatatattgttccttctctttggttgttctttgctttcttatgcatctgtgaggggctagctgaaagtgtgagttgtggaacaattcatttacataagtgtatattgaattatctgtgcacctagagggtgatgggcactgtgagggatattaaaaaagagacacagtacagttcttaccctaggatcccctgcttggagtgggacagtggtcaagacatatacaaccacaaacacccaaacattaacatcaacaagcatcattacatccttgggtggtattgccaagggacttcaaaggccaagattatagagtcatcacacttaggaggtcaaagggactttggaaagcacctttgtcactcattttgttttataagtgaggaggctgaggtgtaatacagctaagcgaattagcctttattacataactcattaggatgtagactgggactaagagctgtttctccagatcccattaggcaatctaaagattctgcactatttctttttcatttttggtatccaaataggtacagttgtttttgatctaggaaaatccttttagactaaacagtaagctttttaaattactctgcttttagatattttttggacttcagaactttgaaggtggtcatccaccaacattggggaatggaaagaaggctccaacacttttctttctagagatcttctttaattttcaatggcagtcactacagaatctagcagttcatgctattgaggccactttgtaggattttttttttttttttagtcagggctccaggtccctggtggtttatgtagtcagtcttatcaacaaccgatgaaagaccaataaaagtgcaagagggaatgaggactgtgtgtgtgtatgtctgcacatgcacacatgcctctctgtgtgtgttggttaacttcatatttggtaggtgggagggaaggtgattaaaaaataatctactttgcatggagttggcccaatttgactgatataggggtgagtgggggttaagaagtagtctatatatcaggaatcttaattagttttgaaaatcctttaggtaaatagctcaacccagttgttcccaaacttcaagtgtatttatagggtctttttaaggggtaaagattccacagagcccttcattttgaccttttgcttctgcactgaatagtcgaatgccttctatatgccagtcattgtgttaggcactgggagtatgagaattaataattttagtctgttgacagataatcataataagggctaatgagtaacacaggctcagggttataagaacagagggggtgtcaaggctgtttttcacaggaaataacatttaagttgatacaatgaaattttagggcttagccatgagaaggtggggaaaagcattttgggctgactgaacagcgtgtacagaggtctggaagtgagaagtagtgtactatagcattttctaggagctgaaaggcatttagcaagagtatagcgcataaaggagagagcttgagatgaaacaatttctcagtgtgttgtttgaatacaatgtatactgtcaaaatctaagaattcaagaatcatttaatatatctttatgttttactagtcataaaagcatatacatatatttaaatatggacaagatactgtttagtagtttagaaagtgatttatgaggattgcaatcccttgcaataactccacagcccataccttgggaacaactgagctaactcattcagttttgtccattacatcgaagggtgttttttgtaaactcatatgtctagaatgtgtttgccatgttttaatcacaagtagatattttctcagagtccagtgcagtgaagtatggtaagatcctgattgtgttctggaacacagaggaaagaccaccttctgttatagcaacaacacaagtcttttaacactgtgtgccccttcccaatctttcaagtgatgattgaagagactaggtgctcagctcagcctttgagttctgataaatgagcccagactgtaaactggaagataaggatgtttgtaaagttcttgtataaataaagcatggtttctcattgcagtggttactgatttcatagtctgagtgaagatgaatgatgctgtgaatcaacagctttaaagtccgtaccacttcagcttctttttggtttaggtttcttaaaatcagtgtgtatttaatgctttattcagatgagggggtgaaaaacctaacacatgtaaactaagtgaggtggggtttcagagataattcccagcctcacaattcctcatgaagttcttttcctgtgggaaacttttaatttggaagcatgcaacctaatgtgggaaccaagattaacattttctgaaatacttctacaagaaaagcagaaatggtctgtccaggaagctgaatttacatagtagaaaaatgagctgccctgcagtatttggtagtctttgtgtattggttgtgataaaagtgtgtatgtgtgtgtgtacgtgtgtgagagtgagagattgtatacttgtctttgtttccttcacatacaactagtaaggccctagaaaaactacactagaaagtgtgttttaccacaagcgtcccagttctggacaccaatctatacacaaatacttttttttaaagttctttttgtttttccttcttgctgagtaagctatagtatttccttttttttctttctttttatttgagagaagggggggttgagagtagagtgggaatggcaagaagtagtatgacagagcttcttctctttttttcccctctttaccaggaagttaactagaagtcttcatgcatgtttttaaaacaaagttggtaattagcataacctagttagttacctttacacagagtgacagaattaaaaagttgacaagcccatcagacctcagccaggaggtactgaaaggagggagaccagtgagtctagaccaataggtgggttaggcctcctgaatgccagcctagaagtttagacttgattctataggctctagggtacctacaagtttgtagtcgcagccttgggaattgaatgttacataggaactttcactggttccagctagccttggctgttagcaattatttttatctactttaacaggggggacagagtaggggggcaggaaactaagctggcattatggtcacaggaaagaacagactgatttggagcctttcaaactgcagacctttgttactgaccgatgcttaatttggtttctgggttttgttagttttttcccctgcccttacctcatttaccttaacgacagctcccccctctagagctcagctagggcaggctgccactgtggattggggggccaagaggcccagtgcaagaagaaagtgggttgaaagcagagttctgtttaaagaattttctgctggaaactagcccagagggagtaaagaggagctttaatgaggagcagctgcagtgccgacgcaacccacatgagacttttttttccccttcgttccacattctgtatagtttttttaaaaatcatgactttgaaatagctgttttgtaaagcatgcctctctttttcttcttgtatgtggtgggattttgctttgttgttgttgttgttgtttcttgaatggccaaatcctcgttttaaaaaaaaaaaaaaaaaaaaaaaaagctaaagacagagctgcagcaaagccctggatgcaatttggcctcaccctgctgatacagaacattcggtggagaaaacaaggggagagaacactggcttttatttggaaaaggggcttatttcctgctcagacttcagtcatcttggagctgacacaagctgctacactgttttaagcttttctgtagacgagtggctattcacttaggaaacgtgaaagaacaaatttttctgtcctgtattactagagagactgatcctgaactgcagccattgccagatagattggaattgctattcagatcccagcttcgttgaaatctgtaaagtggctacatgtaaactaatccaggctgctagtgagatgtgagggttggggtctggttttcatctgcttaagtgagaggaaactgtaggggtatccttcaaatggaatgttttctagttccattaggaggaatcccttgtttttctctgttttcttccttcctttgcttttctacatccaaccccatgcgtatgtttgaacagtaacaatggaaatgtggacctctcaatgtcagaaatgacacttttttttttttgagatggggttctcaccatgttgcccgtattgcctaggcaggtctcgaacttctgctctagcaatctgctcgccttggcctcccacagtgctgggattacaggtgtgagccactgtgcccagctgagacttttaaagaaaaagtcataaatatatctttatggacctggtaagtattcagattagtttatagagtttaaaatggaaaaatgctccccaaacctttctctgtattcacaacctcatctgcgaagtatgttctttcagagttccaatgctagagaagagagagtaagtagaagtcactgagagacattgaagagacagttatgaaaataattaataaactccctacaggagggaaacattcatatagttttgcggatgaaaggcatctgttagatttttgtggttattttttagaatatacacctttagttcaagtggtagactattttccaaaatgtgtgctgggtagcttaatggaattatagatacgtaagggatgttgggtgtttagccatgttttcactctctaaccaaattcaactttagccatctcaagaagacagctatttaagcccttgttttcaagcagagaaccttactttccaccaagactaacagagtatattttctccttataccacagttgaacagggatttgcaagttgaaagatctcctgccttaggaaacaagggtctgttatttctgactgtcttagctattactcccctttcttcccatgtccataatgctgcttagcttcctggggtgtgaaggataattctatacctcaggatgactattaggttgatttggcctgttattctaccagacagatcacagagtagagatggattttgtggaacatttggattgagagactgactttatccatcacatgaaatttagcctgctttggaaccagctgcttagtggggtttatgtactcaggtattcagggaacctacaccaagggttcaagacagggtcttccccacaaaaactatctagatgggagtttgagaaaggtacagcaaagacataacagtggcttaaataaagaagaaccataccagcggagacaatgtagtgcatgacatggcactacatctgctgttggaaggatcagagacaggtgggatgatttgtagaaggcttactataggacaggtttacagcagatttttgaaaaaagggtggaagaaaggaacctaagttggagatataccagaagggaagcatgatgtttctcactggaaattaaaaagatttcaatataggggacagtaaacaagattgtggaaataatatggagtgttcgagttatggattactaaagagtaagatggttagatgattggaatgggacagacaagcagatcagagattgtaaagaacttggatttgaaaggcttggtattaatactgttgctagtttctgagcagaagaatgacatgaaaattatgcttaggaaagattattcttttagtcatatgcttaggttcagcaaggaatttccagactgtccttagggagaggagaggtatggataggatgctggtccatttaggatgttagagctgattgaataagtgctagtcttggggcaagacttagtcatacactttcagttaagtactgtttcattgcaaggtctaggtgaagatagggatatatttgtaaaactggggaaattgctagattcacagataaccaactttgggtagatcagttagctttggtgtccttctcagtgctataggggttcagaccatttggtttctgagatcactgctgaaattctgtgattgtatgagtataatgtaaaagttgtctcaatcaaggaaacttggagtaaagactcaatatgatggatttaaaaggaatgaatgatagttccaattattgggttcaaaaaacatgtgctacaagtataagatgagaaaaatagggtacactagtagttcatgtgaaataaggctctgaatattttagctgagtgtgtattccatagcacatagtagtattttgtggcttctaaaaaagtacacatatccattgggtatgagtcggagcgttattctttcttgaactgcgctctcacgatgcctcctcagtttaagaacttactctgaaatagtaaaagcatagtgtccagatcaggaggtcatggttcagctctgtgctgcactggtaagaacatgtgttaagcctttttccattttgagcctcactttttaaagaggtttttgatgaactggagtcatccagtgatggggaggcaggatagcctagtgttgaagcacacgcactctagagtctacttgggtttgaatcctgcctcttccatctactagctgtgaattttttttttttttgagagggagtctcgctctgttgcccaggctggagtgcagtggcgcgatcttggctcactgcaacctccaacttctgggttcatgccattctcctgcctcagcctcctgagtagctgggactacaggcgcccgccaccacgcctggctaattttttatatttttagtagagacagggtttcactgtgttagccaggatggtctcgatctcctgacctggtgatctgcctgcctcggcctcccaaagtgctgagattactggtgtgagccaccgcgcctggcctagctgtaaaatcttaatctttctaagcttcgagttcctcatatataaaatggagattataatatagcactggagcgagtaatacaagagacaatagctatcaaatgcttagcaaatatacaatacatagttaagtacttagaaaatatgttttcagttacttcgggtatatacctgggaagggaggcagaaaattttggtcattctgattattattactactgttaagcatagaagcaccactaaaaaggtgaagaagcctggaaataaccctatactgaggaatatgccaaaccattgaatcctggaaaaaagaaaacaaaaggcccacataactatcttcagattcttgaagggctacgtgtaagagaagcagaaggcttgttcttttttgttctagagggtagagataacctggaaattgtagagagacaaagtttgttcttttcaaagttaagacataatttatgtatcataaaatttacccttttaaagtgtttaatttagtagacttcagtatttccagagttatgagaccaccaccattatctaatttcgaaacatttttatcaccctgaaagaaattctctactgcttagtagtcactgtctatttccctttctttacagctcctggcaacactaatctactttctatctctacggatttgcatattctggacatttcatataaatggaattatataatatgtggccttttgtgtgtggcttctttcacttagcatgttttcaaggttcatccatgttgtagcatgtatcagaatgtcattccttttcatggccacatatttcatttatggatataccacattttatttatctgttcatccgcttataggcatttgggttgtttctactttttagctattatgaataatgctgctatgaacatttttattatctgggcatatgttttcagttatctcgggtatatacctaggaagggaggcagaatttgaagaattaagaaagagctttctcacagtggaatccacccacattgaagactgttcttttgttgaagtagtcagccagtaatttcacttaacaaatgcatagtgtttactatgtgctggatagtgttctaagtgctttacccttatttaaaaatcctatgaagtaggcactgttattacatctcttttacgacagggaagtttagtaccttgcccaagattacacattgagtaaatggtggagttgggattgaaatccaggtggtctggttccagagtctgtactcttaagagcagaacaataataactccaagcatttattaaattctcaagatttatccggcaccatgctacatgcttgtattcaagcagaggctggtgatcatcttttagaaatattttagaaatgattacttaattggatagaaattaaatttcttgaatctgaaggttctgttattccaaggatggctggaaatgggggaaaagccagcaacaagatgatgtctggcctgaggcttttaagatgatcagaatttgtatcaaaaaggaaactgtgaacacgaatgataagtattataggaattcagttaacaagtcttgtcagaatgtggtaataaattatatacaacttaaagagatgaagttactttaaattgtgtgtggaagccttagaaaaattgaataattaaagtttcttgggaagatgatctccttttacaaatgtttagtttcaaatagtggcagcacatattaggatagagagatgacttctagaaaactgaacatatgggactggaacagtgtattttggagtcagttacaggaaggaagttgtttaaaaccaagtgaacaacaacagtaacaaatgcatttgagagaaagagcagtgcagtccagacttaaacattagggtggccataatagatggggaagaaggagaaatcagcaatccagactaagacttcactgggttttgagttagacagagggaggcatagaagccaaggtaaaatgattaaaacggtacatggagtggttagcaattctccctataggagagagaatttccttatgaagtttcagatgagaccactgaacttgactagaggaaagtcattgtttttagaaaacagtttctaaacaataattagaattaaagttttgttgcagagggataagtaagaagtagatggaaaagaaagaggaatatctgaaattaggctacagtcatagaaggttagctgtgaaacaataatttggaaagggaaatgggacctcatgaaagtgtgggttaaaagagacttgtatatcttctaaggtaaaagtaaagaactaagctgatgtccagccctctaaaacattttaaatagaaatcaaactttattaatacagtaggtctagtttcacgtaaagcaaatatatggttctgtacacgggctttaggagagtaagtctgttgtacctcatatgtaagtattatcccatttagaggaaaaccctaagtctttctttacagtggcttaaaggccccaattgatccacatcccagttacagctctcatctattttctgctgctccagatattcttgctgtttctcaaacacgctagggctgctctctgtgttatggcctttgcatttgctgttccctttctcatgaatgtgttttcctaagatacctgcatgattactctcaccttatttaggtctcaactcaagtattgtcagtgaaggtcttctctgattttcctattctaaactgagatacttctctttgctcaccccacaccctcatccccagctccattccttcctgtttaattttttttcacagcacttaactccatctattgtgcatcttttacttagtaattttgttttcgtcttccgctattagaatgtaaactccaagagtgtaagaatttttctagcactggaaaaatgcctggcacataataggcatttactaattgttgtgtgaatgaacgattataagtttaatattctttgtggaaactaataaggttgatttcctatcagaaaccgatcattattaataagcatattggatggtatttatagaattagccttcatatgttctctactcagaagttggcaaactttttctgtaaagtgccagagagtaattatttttgcaggctttgtggtctcattacagctacttgactctgttgttgtagtggaaaatcagccatagacaatctataaatgaatgagcatggctgtgttccagtaagactatttatggacactgaaatttgaattgtatataattttgaaatgtcagaaaatatccttcttttgttctttttttctaatcatttaaaaatgtaaaaaactattcacaggccaaacaaaaacaggcagtggtccaaattagacttgcaaactgtactttgtcaatctctggttttactgatttcttaaatatatcttaggttaaaacttatttttccatacttgatagggagcaacaatgtgaattaaactgtagaaacaaataattcagaaatacatctgtttagctttagaaacttccattttgcttcatttttgttttcctgggaaccttatatttccattatatgtttatgatgctaccatttaaatgactttgcattctcttagcatatgccacatgatagtgttagggtggtgtaatagttcaggagcaaagctgagcaaagcccacccacgtttaaaaatttgccattatttagaaggtgcataattcccatatgggagaatgaagagtcatctaataatgcccagagggctgcactgtgagtgagaattgtgttgcagtttttaacattcataacacatttcttgaataagctgcaaatgcttttaataatatatctcagagttaattttagctatgctacattggcactttttgctcctccacttcaaaaaaccaacacaagaaactattctcaaatcaagctgtgatttggatggggcattgtattttcctcaataagcacaaagaagagagaaaagatgttttcacttggcaaaacttttttttttgagatggaatctcactctgttgcccaggctggagtgtagtggcacaatctcgtcggctcactgcaacctccgcctcccgggttcaagcaattctcatgcctcagcctcccgagtagctgggattacaagcgtgcaccaccaccctggctaatttttgtatttttagtagagccagggtttcaccttgttggccgggctattctcaaactcctgacctcagatggtcctcacacctcagcctcccaaagtgctggaattacaggtgtgagccactgtgcccagcccacttgcaaaactttttaacatttataaggttttttacatacttgattttgttcagttcttagaataatctcatgatgtaggtgaccttattaactatttacaatgtgagaaaatggatagtcaatgaagataagtaacttgtccaaggtcacagcaccagaactccaaaccagaccttctgaccttcttgatacagactcctcacagtcacctgcatgccatctttggtttcagtgctatgaactttcttcactgcctgttggtctgtagctacacctactcatgaagatgcccagagccttagccgctccttgctctgccatgcttatcttatgcagctctgggaggggtgaagaggctgtggccagttacctcactaccactatagctattcaccaccctgttttctcctttagccattttagctactacacaattcttctgggcattttctgtcttagttccctagtatctggccttccctcttttctcagtaactgtgacccctgctagctagccttgccaaccaatggttaatgaaaggtcttggatatgactgtcaaagacaaaagcactcatgaccccaatgtttcaggtcacaatgattaggaaaatcaggacaacaaggcttgggcacagaaaagctggtttttgagagggggatttagagtttggtttaaatgtgtaatctttgaggtaatggtggaacagcctactagattcagttttctagtccctgaaaactaaaacgaggaataagttgaatcacatatttggggcaccagccaaatatatagcagcatttatagttagaatcaaagtgtttgtgtttcttaatttaaatgcttctcagagattccatttaaacaacttcattatgaaaatggagacttaccatgcctttttgatattgttcagagaaaattgtcataaataatacacacagtttgaaatggttgtacatcttatgaatcaaggggtggcatgtaaaaaggttcctcagtgcctcaatgtggaaaatatcatagaatgttattcttcaattgattccttccttgactttggtgtttatatggtatcttagatattttatgttattttaattatattttgtgtctttttatttggttaaaaatgcctacttaaatattaacagatttttaaatatccctttgaactcttccccattcctgtacctcctttccctttttccgttgtaatgtcagccacctgaacataacccagaaaactaggtatcatccaattgatgtttcagtggaaataagagaaagaagcacttactatttctcaatgcttaattgaggaaaagcacatgatatcttacatattttaaattggaggggataatagggtcaagttcatgcattatattgtggacatcttaatcctatcaaatggcttagtcaaaatgagaaagttaatgaatttaagcagacaagtacgaacagtgctctaaaaaaggtgctgttacaccatcccaacctgtacacacatgaaaaaaagctggggtgcattttgcgtttgaataagggtcatgttgactggccatggcagaccctgctagaccatacagctgatactctgtcacctgccaggactcaaaaggacatgggagtatgtggttaagttctctaaggactctttcttctaaagggaagcagttttataggtggtccttgtaggtctgttgattcacaatctcgtgctttcttgattggactgtattgttttactgtaattttttggacttacaagaagtcaggtgttttcatggactcttctcttttccatacagatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcgacatctcatccatgctttgtgtctcgaccttgcctgaatggcggcacatgccatatgctcagccgggatacctatgagtgcacctgtcaagtcgggtttacaggtaactaatgagaccaaagccagtgctttcctaccttcagcagatacctttatttagcatcttttagatcatggtgtctggctcttaaatgtcccccagctctggtgcacatttaacattatgataaggaactgggatgttccagacaactatccctaacttccttttaagagtttcagggggcagagaaagagaaagaaaaaggaccaaatactttgactgcttaaagtatatatgtcagggccaggtgcggtggcgcacgcttgcaatcccagcattttggcaggccaaggcaggaggatcacttgaggctagaggtttgagaccagcctgggaaacatagcaagaccccatctctacaaaaaaacaagaataaaaataaaacaaaattagtcatgtgtggtggtgtgcacctgtagtcctaactacttgggaggctgaagtggaagaattgcttgagcccaggagtttgaggctgcagtgagctatgatcgcaccactgcactctagcctgggtgacagagtgagaccctgtctcaaaaaaaaaaatatgtacaccaggatggggaatcagagtttacttcactaaaagaaataagtacactgtcaccagaggaaaagttgctgatgttattgactatttgcttttagaaatctccctccctagacattcagggcactggcttttctggttttctgaaccctgttccttttgcttcttcattaccttgttcttatccattaaatgtttgtgctccctggagcactgttttgcgccctcttttgagccacatcacagctctccctagggaatttcactgtctgtattcgcctccactgccactgtcttcattagcttgctgatgaatctcaccatcattcccttagctccacccaaccctgacattcaggctcatgtttctagttatcctttgtatgttctccttggagatattctacaggtactttcagctcaccttgttgacagaaatacgtagcaaccatgtacatcccaaatacccacgctagaaactccctgtcccttgttctgacctcatttcaactcagtcacccaagccaacctctgagttgcctttcacctgtctattcctcccatttcctctgctaccctgtagttgaaggccatgttatctctcacctgggcttctgaagtagtttctgaatacgttttcttgcctttattctctccccatctcattcacccatgatattactacatctttgattataaatgcaaatattctaacaatctcacctgcttacaatgtctaatattttttcatcatccgcagaataaactgcaaactcttttacatgacttccatagctctctacagcctagactttacatctttttatagcctggcctccccacaagcatctaggcctagtcacaccaaattctccttatttcctgaaaatgttgtacttattattgcttccatacagttacacacccttttgcctggaatgcccttttctacaactggtgattgtccaatgttatttaaaactgtgtctcagtgaccctttcatgattcctttaggcaaatggtctctaagttttattagttttatgtatcacattttattgtaattttttttacacatatctcacctgaatagattgtgggtttttctaggtgggtctgagctttattcaaaagtgtttattaaattagatgagaaaaggaggaacattcttcattttttctcctgctttaagcactaaaccaagagttctataaatgcaataagcaaaaaagtgaaaaatgtactcagaagactatactggatcagttagtgtagaatactgttatattaatttttcattgtattagggttctctagagggatggaactaatggaatatatatgtatgtatatatattccaacccaaagtgtcttggtggcaatcttaatatatatatattggcaatctttatatatatataaaggagagtttgttaagtattaattcacatgatcacaaggtcccacaataggctgtctgcaggctgaggagcaaggagagccagtctgagttccaaaaccgaagaacttggggttcgatatttgagggcaggaaacatccagcacgggaaaaagatgtaggctgggaggctaggccagtctcgctttttcatgtttttctgcctgctttatatttgctgacagatgatcaaatggtgtccatccagattaagggtggatctgccttccccagcccactgactcaaatgttaatctcctttggcaacaccttcacagacacacccaagatcaatattttgtatccttcaattcaatcaagttgacacactcagttttaaccaccacaaatctaccccttgtcaacttgaacccgtacacatctcctgagatcacacataatcttcaaataaagacaataattaggtcataattacacctgatgtagtacaactattcttcatacatccggaaacacactagtccccaactgaaacactcttacataaagttaacgatacttaaatgctgatgtgaagtcaataaatcttatgtcacatgataaaggagaaaggaaataaaatgaagatattttcttagtacaagtgtgtgcaagcacagacatgtttttaataaaagaaggaggaaatactgaggacaattacagtcctcatttctgcagctggtcacatggtagtagctggtattgatgactaccttcttctacccattttgtattccttttgccttcagcaaacacctcagcaggttgtgtttttttttttcctgatggagaggcccaaaccatttgtagtcccgcctggattgggctgttgtagttgcccattgaccttaatcacagggcatggtaatactaagagacgccctaatggatctcctgtattccatgaatactctttcttacctccgttctggagtagtagactgatttcatcttgatagcctgggtcttgatagccttgatgtcccagccaacactgtaacgcctttcttagcctgtttacttaaaggtaggaacccaaagtgtcctggtggcaatcttaactaccagtttaatggaattgttgttgtgtcttctgatggcagcgttcctccctctggaactaagacctctaggccagcagaacttaatgttgcgggaacaggaagcaaacattttgctagtggatcactaggggtgatggtgagtggtaccacttccatttccaccccttgattcctggacctgtgaatcctggctatgggagaaacagtaccacatattggacgctgattcagagcatacacagccttcttgagaactttgccccaaccctgcaaagtattctcacctagttggcattgtaattgtgactgcaaaaggccattccaccgttctgcttcaggatgttggggaacatggtaagaccagtgaattccatgagcatgagcccactgctgcacttctttagccataaagtgaatgccttggtcagaggcaatgctgtgtggaataccatgacagtggataaggcattccatgagtccgcggatggtagtcttggcagaaccattgcatgcaggataggcaaacccatatccagagtaagtgtttattccagtaaggacaaacatctgcccttttcacaatggaagaagtccaacataatcaacctgccaccaagtagctggctgatcaccctgaggaatagtgccatatcaaaggcgcagtgttggtttctgctgctggcaaattgggcactctgcggtggcagtagccaggtcagctttccaccggcccatcttgttttctgcactgggaaggtggggcatgagcacaaatgttaggacctgaaaggtggtgaactctgcctgggcagggcaaagccagaggaaactctggtggaggtccgtagcagtcctgatgtgcaaatcggtcatccaacctgggtgtaggggcgaaagactaattgaaccatctagtagctggttccctccaaagtttccctcgggatagctggcactctcgcaaaaaccccactcttggtaccaatttactgtattagtccattttcacgctgctgataaagatatccccgagaccgggaagaaaagaggtttaattggacttacagttccatatggctggggaggcctcagaattatggtgggaggcaaaaggcacttctttcatggtggtggcaagagaaaattaggaagaagcaaaagcagaacccctgagaaacccatcagatctcatgagacttattcactctcatgagaatagcacaggaaagactggcccccatgatacagttaccccactgggtccctcccacaacacatgggaattctgggagatacaattcaagttgagatttgggtggggacactaccaaaccatatcattcatcaaaaggtgttggtggggtagagggtagttaggatgatccatgatctccatcatgatgatgatggtattgatgatgtaagtcactgaaaatatttggtgttataagaataatttcttcctgattgtcagttttgagttgttttgctattaggaggcaaagtaggggggcatatacccacttaaaatattttaattctggctagtggaaatgacagtaatgccttcttcataattaaaatgtcactctgaaatggtcccaaattaaaacttcttcctttgttgttaagaaggatctcttcttggtgtgttctgcaagattctgatcaccttttttttttttttttttttttttttttttgagatggagtattgctttgtcatccaggctggagtgcagggtgcaatctcggttcactgcaagctccacctcccgggttcacgccattcttctgcctcagcctcctgagtagctgggactacaggcacctaccgccatgcccggctaatttttgtatttttagtagagatgggctttcaccttgttagccagaatggtctggatcgcctgacctcatgatccacccgcctcggcctcccaaagtgctgggattacaggtgtgagccaccacacccggccgattctgatcatcttttatacatatgctatttttgtctatcactttaggaatcatcacagatcaaggtcatccttttggtttttgtgatagcgctatacctcagtcagcttactagctcatctccactcagagatgaagaagcataggcagcaagttagtgcctatacataatatatatggaaaccaaattcagggttgattctttctttctttctcccttcctttctttctttctttctctttctttctttctttctttctttctttctttctttctttctttctctctctttctctcttcctctctctttccctctctctttctgtctttcttctcactctgttgcttagtacagtggcgcagtctcggctcactgcaacctccacctcttgggttcgagtgattcttgtgcctcagcctcccaggtagctgggattacaggcatgcgctatgaagcccggctaatttttgtatttttagaaaagatggcgtttcaccgtgttggccaggctggtctcaaactcctaaccacaagtgatctgcccacctcagcctcccaaagtgctgggattacaggcatcagccaccacttccggcccggggatctttctgtttcagttgtgggcatcactctgaaaatcacacttgctagaagtgagcatttatatctcttctccactgtaaataagtgcctcttagtgacatgagtggaaagacaagaagaattgcagttccttcattttctgtcttagctccctgagatgtatatgctgtgcctaaatttgtgttatagttttctcctttgatttgacattccttgataggcagagagcacttttctgtgctcatatgtcacatctcgcatctttttcccttatagaaaaactcttgtgtctcccatttacctttctatgaggtcagagatttagatactttcctagacaatcaactggagtattaacaaattcaaggagttctcgccatcccattactgggtatatacccaaagaattataaatcgtgctgctataaagacacatgcacacgtatgtttattgcggcactattcacaatagcaaagacttggaaccaacccaaatgtccatcaatgatagactggattaagaaaatgtggcacatatacaccatggaatactattcagccataaaaaaggatgagttcatgtcctttgtagggacatggatgaagctggaaaccatcattctcagcaaactattgcaaggacaaaaaactaaacaccgcatgttctcactcataggtgggaattgaacaatgagaacacttggacacaggaaggggaacatcacaaaccggggcctgtcgtggggtggtgggacgggggagggatagcattaggagatgtacctaatgtaaatgacgagttaatgggtgcagcacaccaacatggcacatatatacatatgtaacaaacctgcatgttgtgcacgtgtaccctagaacttaaagtataataataataataataaaaattcaaggagttcttatctctgtagtttaaataataagcaacttagactaatgacaacaaaaagccagccatgtgaataccaaatttactagttctgtgaggatatttttttctctttctctttctgcctcaaagaatctgctttgcttcccctggcatcatgatttagttttcaacccgtcagagtcttcctgctagtgctggtactttcctacttgagaaagtccacggaataccttcgagacctctgtcctcctgatggcttctatttcatttgttatatagggacccagaggtccttcatcattttcaaacacatcaacagatatttatagcaaggccacaattaataaaatgtttcccagaatatatgtgtgtgttacatttagaggaaacagaagtagtattgacttgtttctatcaccagaggtctatttagtaactatattttgtggaaaatatcgatatattttatccattcaacagacatgatttgagagcataccacggagacccaaccctgccagtgtggcaggtggtataatagaagaaaatagcaaacttggtgtatctgtgtttgcgcacatgtatgtatgtgaggggcactaaggatgactttacagaggttggaacttttgagtagagttgccaagatagggagagttcactaggaaaacagaagggaagttgatttttttttttttttgaaatggagtcttgctgtgtcgcccaggctggagtgcagtggtacaatctcggctcactgcaacctccgcctcctgggttcaagtgattcttctgcctcagccttccaagtagctgggattacaggtgcgcgccaccatgcccagctaatttttgtatttttagtagagacagggtttcaccatattggccgggctggtcttgaactccttacctcatgatctgcctgcctcggccttccaaagtgctggaattacaggtgtgagccactgctcctggcccggaagttgatattcaaacaggagcagcatatgcaaagacagtgagctctgagagagtagatggatccagactcctattgctgatagcgtcctgcaggattgggcttcaatgtgactaacctacaattgcctccaggtgctccacccactgagtccttgtgtctctgctgaggtccttggagagttactggagagggctctgtgtcagatgaccttgaggaggctctgatttagccttttgtaaaatgcaaagagttgaggtcttctccacgcaagagctcgctgatgtcaatgaggtattgaggatggggccatctcctatttctgtggccagtactgagttttgttatccttcctttaggtaaggagtgccaatggaccgatgcctgcctgtctcatccctgtgcaaatggaagtacctgtaccactgtggccaaccagttctcctgcaaatgcctcacaggcttcacagggcagaagtgtgagactgatgtcaatgagtgtgacattccaggacactgccagcatggtggcacctgcctcaacctgcctggttcctaccagtgccagtgccttcagggcttcacaggccagtactgtgacagcctgtatgtgccctgtgcaccctcgccttgtgtcaatggaggcacctgtcggcagactggtgacttcacttttgagtgcaactgccttccaggtaaggagctccctagtgtcccaggattaggggacaaacccctagcacaggaggtagtgggtgtggctcaattgctttttttaggaagcgcaaggaaaaagggaagtgagaattttgtgtggggtgggttgctagtgagggaggagttttatgggcccactgtggtccataaactgagcaggggataatttagcatgtcagggtttatgatgatgagtggctagaaaattgtttattgtcccttttgtagaaacagtgagaagaggaacagagctctgggaaagagacagggaagtctggaatggaaaagaacacgatgagaattagacactggaaaatatgtatgtgtggttaataaagtgctttaaactgaattgacattaacagtgggtgatcaactttactatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgtacacacaacccaaagatagaaataaaaagaggagcagtgtcggggagcttggggcctggtgttccatggagagggagaaaggaacaagcttgaccaattcattcaactccttataaaaatgatgaggaggctgaaaaccaagaattttgattgggaacagaatacaagcagctgaatcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagggattaaaggtcatagtttggtcctcagtataaaatcaactggtaatttattcatttcatttggtaaaaatgtattgactgcctgctatgttctaggcaccatgctatgtatttggaatacagctatacaaagcattgtcacataattgaaatgaaaattttatattatttaagtcacaagaacaagctatttaattatattacttttagtttctcttttaataaagaatagataatgctatcattctagatactaaataagtattttcttaacataatattactatccactttatcttgtagaagaaataactaaaatacatctgtcttcactcctgtatttgtttgcattttaaggattaaagacagaaatagaaatgtaaacaactttattttgaaaatatttcaacactgcaaatatctctgggtctgatattctagtaatctaattggctagtaattgatgttagtgtgatttattgttgaaggctaaatgtgtttttcagtttcaagaaaattgcttttaataattgcctagaacaagaggttgatttggcagcaagatgttgacgggaagttagagaagtcaataaaggaagtttttagctgagagagagtgattattcactcccatagcctctgcattgttatccattagccacgataagaaccttagggaattctgagagtgtgtccaggaaaggatctgtcaaactagaatagtatctcctccttgagaaaggaaataaccaaggattccgcagctgagaggctgccagggctagtgaaatagagtaaggaaatcttggctgtctcttattctctggttgtagtttaacgcaagacacttatttactcactgatggtgtgtgtgtgtgtgggaggggagattagcatgaggggtgggaatggggagattcgatgaagagaaaactaacatttttttggtgactcaggaactgtgccaggtacttccatgcttattagctcaattacacaaaaatcttgggaccaggtattatttttcaagtcttcccacatgaagtaactgaagtttggagatgttaagtgattcacccaaagttgtacagctaatatgtggttaggctgggtcctgaaaccgaggcagtttattttcaaagcctttgctttgtgcatcttactgcgccacattgcactgcacatctgcttcctgaaagcactttgtaggtgtgtaaaacttttcgttaaatgctttaagctgtttgggttaaaaatatatgttcatgttataagaaaaccaagacactcctaattataatcaaatagtacttgttacatatcaatatgtgtgtgtgtgtgtgtgtgtgtgtgtgtgtgtgtgtgtgtgtgtgtatggcgttgtgcagatgtttaaaagtagttacatagactagttcttgcttttcagggtcccataatctaaaccagatgacttcagctttggataaatatatagaaggaaatttaaagagaattcaaaacaatagatgatgcagtgacactgtgaataaatgttatttatacagtttgtaagatttcatgctcattgttcatatgtcccaggtggagttcagaaaatattctcttcatttccacaaaggggaatagtgcctggagatggttttcttttaaaaagtccttttcataatgcagtgcccttccttccattgcccttcattccattgcttcccatgcttgtcaagagactaaaatgttacttatagtaatagtcactatctcaatgtaaatagcacccttatttgatgagaattattatttcagttctaaaaatggggaaacaaagtcagcaggaggcaaagtagcttgttaaagtattctgcaactttcaaatggttgcttccactgcatttcacgtcttggcacttctaattgagggttactctaaccaccctatttaaaattgtaactgtcccccacccccttaattactaaccctggtctactttttgttttctttttctgtaactcttatcttcttactatataatttatactatataatttacttcattatgtctattgttcattgtctgtcttttccaaattctactgcctcttaccctctccagaatgaaaactagtatctttgtttttgtttactgatgtaacccaaacacctacaaacagtgcccagtatatactaggcccacaaatatatattggctgactgactgtatggtttagtatcatgtcatagtattgagactgtaactttggtcttctcattttcttctttgtattgtgcgtcctagacttagtttggcctctccttttgtccttgtatactctaatactggataagaattttggagtctttttcaactctgagtcagtgaatgccacataacttagtgactatatttaaatggttaatttacaattttttccctgcaaaggatactgtagtcactgtgagtattttagtattattgtaggactcaagagggaattaaaactacaaaaatgactcctcttgtatgacacagaaagaaatgtttcttcacagagggaggagaaaaatatcttcaagagagaactaatagaatcaaatcaatgaaccatgtctcatctttttggataagtaactgttagtaatccagacacttcatgagctttcattatgtaaagtctttagcagaagctaaaggaggggcaccaaccacagtaattttaacttaagaacaaaatggagcatgaaaataaattattaaatcatttactcccactatttttgggttagggccaataatggggagagaaagaggtagactagttttgtgtttgtggctattttaatagagtagcacaagtaatcaaaaaacagtaggctgttttgaatttactggctgtcccttatgagttcacagttagattggactgtcctcaatgtactttcttttttttctttctttcccacatctctttatttctctgattttgtttaaacttcataaagagctctctgatctttcctttccaaacaatgaaggtttatcctttgtaaactacctctgtactccacaggctgatgatatgtgatatccctatatcattaaagtaaagcctaagcaca

SEQ ID NO: 2565 - DNA, 49872 bp, Homo sapiens; identical to SEQ ID NO: 1242

SEQ ID NO: 2566 - DNA, 28515 bp, Homo sapiens; identical to SEQ ID NO: 1243

SEQ ID NO: 2567 - DNA, 28515 bp, Homo sapiens; identical to SEQ ID NO: 1243

SEQ ID NO: 2568 - DNA, 28515 bp, Homo sapiens; identical to SEQ ID NO: 1243

SEQ ID NO: 2569 - DNA, 28515 bp, Homo sapiens; identical to SEQ ID NO: 1243

SEQ ID NO: 2570 - DNA, 581663 bp, Homo sapiens
agattctgcatcttttaatgaaagataaaacaacaatataaacatacacaaatttacagagaagggatcaactttaatacatttggagtaaaaggtgtttcttctttaaatatggtataaaaataaatgcgagaaacattaacggagaatgtacagacaacagacgaagacatgagtttgtttctgactgtgacacattggtgaaatgaaactttctgtgcggaatttattgtttaataaatgtgaagccacatgtatacttattgatatatacttttttcttttacagttcttccagtttttgactgactgaattttcagtgaactgtgtgtctaactgaagctttgagagagagagagagagaaagaaggaaaaaaagaaaaggttttacttcacttgaacttgttaaaaaggaagagacacagatccagcatagtagaaggagaaagaaagcagacaacagtttggaatggaggcattgagacggaagagtccattggagatggaatgtacacacaaaaataacaatttaggtcctttgctcatgcaacatcttgttctaatgtcctctgctccaggtcacaacattgagctacaaagtgtgtgcagtgactccagtctgcattcatgctacaagatgatccgtttagtaagactgagcaaggcttgttaacctcttggacgtgagagatttcccctgagaaaatatataaaacaagagaaaagaaagaaaatcaagtacgatcactgaaaacctgcttagtagtagcaactatttactgtagctgatttttgtgcaaggtcaacactgaaccctttaagtccatcttagttcaaacctcatgaccaacctgccttcccccctccctccctccactgacacgtcaaacaaaactatcctccctccctccaccctcctacccctcccaaatccttcctccccactgcaaacagactgatggtttcacagcacagattagcaaatcataaaacatatccataaatgctccatcaaggcttagcaatgaagcaacacctaggttcccaactgattataaacatgttacaacaaatcttagtaagctgctctgaaagataatgtgagtgcattcttgttcaatggctgaaattaatgtcacatttataaatatctagaaatgtagaggatacgatttaattaaataaaatgcagtttttgagggtgtgattcatgaaactcaagattgagtctgttccctatcttacataataatggataaaaaggtgccaattatatatctgaagataaaagtctacttgttccctgtttctagctgttgatgtcttcctgttctttcctacctgacttcttccaaccctaatacaagaaaaaatctgttctattctgattccacaaatcatatgattacataaagcacatacttatgttttagaaatcttgtaagtcaacagtgttgctgttaatcacaagtactctagagagataagaaatttgagaccgggcgcagtggctcacgcctgtaatcccagcattttgggaggctgaggtgggcagatcacctgaggtcaggagttcgagaccagcctggccaacatggtgaaactccgtctctactaaaagtacaaaaataagccaggcgtggtggcgggcacctgtaatcccagctactcaggagaatcacttgaacccaggacgcggaggttgcagtgggctgagatcgcgccactacactccagcctgggtgacaagagcgagactctgtctcaaaaaaaaaaatagaaatttgaaacgtttgatcggaatgcaaaactgctggttttcatttcatgtcttattttatatgttctattataaaattatgtgggccagttatttaatgaatttttgtacatctcagaagataagtaaaaattaaaaaattggaaacatatattttagtaataaatcacagtcatagcaatactcttgatttgctacctaatgtggctcagttttagaaaggggtcagcggtgatgggagatacatcatcactcatggccattgccttagtctgtttgggctgctataacagaaaacgatagactaagtggcttataaacaacagaaatttatttcttataggactgggaagtccaagatctagacacttatagattctttgtctagtgagggccttctccttggttcatcaatggtgcattctcgttgtgtcctcagataatggaagaaggaaataagctccctgggacctatctgataaaggctcctgttcataagggcttcaccttcatgatctaatgaccttccaaaggccctaactcctaataccatcaccttcatgatctaatgaccttccaaaggccctgactcctaataccatcaccttcatgatctaatgaccttccaaaggccctgactcctaataccatcaccttcatgatctaatgaccttccaaaggccctgactcctaataccatcaccttcatgatctaatgaccttccaaaggccctggctcctaataccatcaccttcatgatctaatgaccttccaaaggccctgactcctaataccatcaccttcatgatctaatgaccttccaaaggccctggctcctaataccatcaccttcatgatctaatgaccttccaaaggccctggctcctaataccatcaccttcatgatctaatgaccttccaaaggccctggctcctgataccatcacccttgagattaggatttaacatgtgaacttgagcgggaagggatcacaaatattcagttcatagcagccacatttttggaaaaagacaatatgtttaagaaaagattaataattccataatcaacctgtctttacacaccatataattactgataagggcccttttgctgatatgaacagcagcaatgaaaatcatgcaccattttctcttaattttttcttaattgggaaaaagggtccacaacttagctttcagcatctgagagtagaagatattaaagtggtttttgttttgttttgtttttttgagacggagtctcactccgtcgtcaggctgaagtgcagtggcgaaatctcggctcactgcaacctgcacctcccggattcaagcaatcctcctgcctcagcctccagagtagctgtaactacaggcacctgccaccacgcctggctaatttttgttatttttagtagagatggggtttcaccatgttggccaggatggtctcgatctcttgaccttgtgatccacccgccttggcctcccaaagtgctgggattacaggcacaagccactgcgcccggctgatatcaaagtttaatgctggcatttcccactaggcttatgtttattcactttatgggagaaacaacaataaaagagaaaacagtttattaacaacagaccctgctttataaataaaatatgcactcctgcctgctctggtctgtctgtccccctcaaagctcacatgttgaaagcttactccccagtgtgatgctattaggaggtgggggctttgcgaagtgaccatgtatgagggtgaagctctcattaatgggattagtgttctttgtgtgtgtgtgtgtgtgtgtgtgtgtgtgtgtgtgtgacagtctcactctgttgcccagactggagtgcaatggcgcaatctcgggtcactgcaacctccgcctccaaaggcccctacctttggagggcctcaaattgcttgagttgctgggttcaagcgattctcctacctcagcctcctgagtagctgggattacaggcatgcaccaccacgcccggctaattttgtacttttagtagggccagcttttgccattttggccagcctggtcccaaactcctgacctcaggtgatccacctgccttggcctcccaaagtgctgggataagaggcatgaaccactgcgtcaggcctagtgctcttataaaagaggccgaaggaagcttgtttgcccctcccaccaggtgaggacacagtaggaagatggctgtctatgaaccaggaagggggccctcatcggacactgaatctgccagcatcttgatcttggacttctcagcttctagaactgtgagagataaatttattttgcttataagctacccacccagtttgtggcattttgttatagctgactataacggactgaaatgctgcctccacttctatgcctatttcctcatctgtaaaatgaggataataatagtacttattttcaaattttgttgtgaagaatgatacaagtaaattgcttaaaattatttatggatcattttgtgcactcagtttacgttggctattacctcattatactatcattataattattaacactatcattatatgctctcttcattaagatacccaaacccagagtcactattctgactctaaaaggacagaaagttataaattaaaagctaaaatcatactgcttttccaccccaatcctgggcaataagctaatcaaatgatgttgaaataaaaaagattcagttcttaaatacaatgccatttcctgtgtttactactgtagtctctgtgctatgaatagaattgtatacacatgtgcatatatacctattctgagactgaacaatttatatttaaaaagtgcttacttggctgggcatggtggctcatgcttgtaatcccagctctttgggaggccgaggcgggtggatcacttgaggccaggagttcaagaccagcctggccaacatggtgaaaccccatctcttctaaaaatacaaaaatcagctgggtgtggcggggcacacctgtagtcccagctactcgggaggtgggagaatcatttgaatctgggaggcggaggttgcagtgagccaagataggccactgtactccagcctgggctacagagtgagactctgtctcaaaaaaaaaaaaaaaaaaaaaaaaaagtgcttcctctttgtgggatgaaggaaggtacacatcagtacacgttgttgaggcacaggaatgaattcttatatagtagaagactggggaaagatgctgatataaaactgtttcttttaaaactacagattaatgtgatttggttcaaaattctgggaagaagaatgggccgggcgcggtggctgacgcctgtaatctcagcactttgggagagcaaggcaggtggatcatgaggtcaagagatcgagactatcctggccaacatgttgaaaccccatctctactaaaaatacaaaaattagctgggcgtggtggtgcgtgcctgtagtcccagctactaaggaggccgaggcaggagaatcgcttgaatccgggaggtggaggttgcagtgagtcgagatcgcaccactgcactccaacctgggtgacagagcgagactctgtctcaaaaaaaaaaaaaaaaaaagagtgaaatagttacattgaaattggaagccatttgaaactcagatacagtcatttttttatttgaacaatgacatctactgttgtctttatcaatttataaaaaaaaaaaaacatggttctctttctatggttttgtttttattttttcaaatatcctcaaatcctcaaagctactagtacttggcctgatatggacttcattaaaaattggatgatacaagttaagcccgacaaactcttgtcccaggaaataattaaaaaatactttttcatagcagcccagagagaaatacaggcccacagtaaacctggggctttgtgatattagcataacaatgggcaaaaatgagaaaacatacaggtgtattttaacaacaaaactctgtgtggaccaggcgaggtggctcaggcctgtaacccccgcactttgggaggccaaggctggcggatcacctgaggtcaggagttcgagaccagtctggccaacatggtgaaaccccatctctactaaagatacaaaaattagccaggtgtggtggcaggtgcctgcaatctcaactactcaggaggctgaggcagggagaatcgcttgaacccaggaggcggaggttgcagtgaggtgagattgcgccactgcactcatcctgggtgacagagcgagactctgtctcaacaaacaaacaaacaaaacctctgtgtgtggtatagatttatcaaatgtgcaataaggatatttgttttgtatattgagacaactaaaaggcaaacttgggtacaactaacagttaacagatcttgggctgggtgtggtggcccacgcctgtaatcccagcactttgggaggccgaggcaggtggatcacttgaggtcagaagttcaagaccagcctggttaacatagtgaaaccctgtctctactaaatatacaaaaattagctgggcatggtggcggtcacctgtaatcccagctactcgggaggctgaggcaggagaatcacctgaacctgggaggaggaggttgcagtgagctgagatcgcgccattgtactccagcctgggcaatagagtgagactccgtctcaaaaaaaaaaaaagagatcttaagtgcagcactgaggtcaaagcagacagcatggatgcccaataggccatctggattggaagatttacacttggatctatttgtaaaccatgtgcaaatcctgccttattcacatagtggaaaggaaaatgcataagccctactctagtgcacaaagaaatgattgtgtgtatacttttggttgctcactcctccactgcaatgtattaagttaaaaagaacacgatcacttccagggaagtacacgtggtacggtatttgcatgtcagccattttggaacaatcattttcagtgcagttccttggatgctgtatggaaccagctcctgccaatgatcttttcccaatttttccaaattgaagaatctgagaaatggtttttaaaaactattttttaaatttttcgagacagggtcttgctctatcacccaggtcagagtgcagtggtgtgaccatgacacactgcagcttcgacctcccaggctcaagcgatcctcctgcctcagcctcccgagtaggtgagaccacaggtgtgcaccaccacacctcgctgattttttatttttagtagagatgaggtctcattatgtcatccagtctgatctcaaactcctgggctcaagcgatcctcccagctcagtctcccaaagtgctaggattacaggtatgagacactgtgcccgaccaaatatgagacatttttatagctaagttttaaagtcttaattccagaaatgaaaagggctaacaaaccctatcaatggcacttttaaaaaacgaaattgcttacaataattctatgcgaataatacttatttttaacccaatgattacatatgtgttatgtgatttaaactcttcctgtcagattctaaaggaaacagattatagtggaaacaaatctatagagaaagacaaatatactcagaacataacaaaaactcaagatcctgtgagattttgtaatatctggttaatggaaatatgctagaaaaagcagcatataatcagtttcaggacaaaataaacctgagacttcagctggcacgtaagtgaacagagagcatcatcctagtctataatacaataattacataaacaaagagagttctctagtgtgtcacaataaaacttcccctcaaccaaaccaattcctttctgtcctaaatggtttgcagagattttgttataattagggacaacactctcaaaacaaaaataacaacctatgtatttgtccttaacttttccaagtgagctatcaaaggtataaattttaactgactttaaaaacatcattcttggcctgggcacagtggctcatgcttgtaaacatagtaccttgggagactgaggtggatggatcacttgcagtcatgagtttgagaccagcacggccaacatggcaaaaccccatctctactttaaaaaaaaaaaaaaagcagggcatggtggtgcgtgcctgtaatcccagctacccaggaggctgagacaggagaattgtttgaacccaggagacagaggttgcagtgagccgagattgcgccactgcactccagtctgggtgacggagcgagactctgtctcaaaaaaaataaaaaataaaaaataaaaaaaaatcgttcttggtcttaaagtaataacagaaagttgatggtaaggagccctgagtcagtaggaattgatgaaggccaggctcttagctatagcctgagagcctggggcattagggagatggaagcaacttcctacattcttctcctgcaatcccttcttcacaaaggaaatagagagaagctatgtttgctttagttactaagcccacttattttattgctgtcataaaaacacacagaatggccaggtgcggtgattcatgcctgtaatctcagcactttgggaggccgaggtgggcggatcacctgaggtcaggagtttaagaccagcctggccaacatggtgaaaccctgtctctactaaaaaaaaaaaaaaaaaaaaaaaaatagccgagtatcgtggcaggtgcctgtaatcccagctactcgggaggctgaggcaagataatcacttgaacccgggaggtggaggttgcagtgagccaagattgtgccattgcactgcagcctgggctacaaaagcgaaactctgtctcgaaaaaaaaacaaaaaaacaaaacaaaacaaaaaaacacagtagtcttttctagtatacaggacactgaagagattgagcagaaataaaggggcagatttttaaagggtggctatgaaacagattacagagaagagtagaaagttatcaacatcttttagattttttttgaggccgggtacgatgtctcacgcctgtaatcccagcactctgggaggtagaggcgggcagatcacgaggtcaggagattgagaccatcctggctaacacagtgaaacctcgtctctacaaaaaaaaaatacaaaaagaattagccgggcgtggtggcgggcgcctgtagtcccagctactcaggaggctgaggcaggagaatggcgtgaacccgggaggcggagcttgcagtgaaccaagattgctccactgcgctccagcctgggcaacagaataagactccgcctcaaaaaaaaaaagatttttttttttttgaaaaaaaatttaacctccattttcgctatccttttgcaattcctgcttgtttgtctccagccactgcctccgagtctctcccatatgttgctgtagactgggatggatattcttgagtgccttgtaggctgcagagactatggagaggcactggggataagaaaggtaaaatcttatcgttgcccttccactggtttatgtgatccaactgtctcaccagatgctcaaccccacagctatgttaataaaaagaactgaccatatggtggtaaaatgagatgctattggaccagagatagggaatgtttttaggagagtctgagctaaaggatgttatctgtttattattttactctcatgttgaaaaatgccttttccacttattgaaccagggataggcagtgctcttagcagagtctaaactaagggatgctagatgtttgttattttactctcatgttgaaaattcccgtttcacttataaatataaacatctttgcctggatttccaaatccttcactacctgggttccgtggcctttcagactctttactgttacccacgaagtggttctttggctggcccttgtgcctgctgctctctccgctggtcacctgtttgtgcatgtacctgttcagaccctatccactcttcaaagatgaacttcctatctatgtccttgctaaagctttctaactatccctaaactcctccggttccctctttgaattcttcttgctggtagaacctgcattagcacttttatatgccttcttacgtgattttgtaagtcatctggcctgatgaagtgataacggacagctgttaaacattaatattatagcagtctccaaataagtagttgattatttgcaagagctgagctccttggctgcaaatctcattaagggaataaacttctagaaatcagggtaatgagattccaaggtcttgggaaaattaacttttaatttgggggaggagagacatggtggagagagggatgggggtcactggtcacaccctaaatgttaacagattgactaatagaatcagaatattttcaagtaggcaggtgctaagaaggaattcaagctaggctaggtgttagggaagctcttgcacaatttaaatgaaatcagttcttccaggtaaacttacaagtgagtttgctgaaacatagtgaataatttttataaaactgtggaggtgggtgagttcctagaatgttaaagataagctcgaattcttgagaattaagatggcaaggacaagaggaagaggattctgtagttagttttgaaactgtcatatttaatgttgaatgctgaaaaatattctagtactacgtactaaaaagagatagcttatgaacacatatacatttaagtactggtcactagcttcctaagagaattgagaaagaataagtatagccaaatactttcattttcttaaaatatttttccataataaaaccagtatgtgttcactaaagaaaatgaagaaaacatagaaaaaagagaagaaataaatattacttgaaatatgatcatttacattctattatgtccttctacctttttatacacagatacatgtttaaaattttttttacaaaactgaaattatactgtgcatggtactatgtcatattctgaataacgtgtgtattaaagagattacattttgttcaattacccatgttatggatgtttcttcaaaaataatgttgttttaccaactaaatgcattagttggtaaggaaatcaatttagagagatgcaaccaacatttagaaaaaaattaagtacagaatacattttaaaaatcagattgcattgcacataagggaatgtattgttatttcagttctatgtacatataaacacacacaaatacagtttatacagtaaccatatatatgtacacacacacatatacaaatacgcacaaacacatgtatgtgtcgatcaaatgtggctactctgggcacactgcctatggattagccctgctctgcaaggaacaatagaaaaattaatattttttaaaaaatgtgtcaaatatgggtatcattaaaagaaacaaaagccaatgctttaaaatataatttttaacattcgtataacattccaacagtagatatgtcttgatacagttaagaaattcacaattgttgtactttcagattgtgttctatatttgacaattatataatgcaacaaatattttttatatgtgggaacacctgggttttttttaggattaaactactagaacttgaattactgattcaaagtgagagatttttgaccttctggcacattctgtcaaattctattcgacaaaagtgatagcaattcagacttttatgagcactgtatgagatcacctattttcttaacccctttctgatactagatgttatcatattaacaaaacacatctatttggaggaaaaagtgattgtgctgctttctgaattttacttgggtattaataacaataggttttcttttttgttttctcacatatcaatgtactgtttgtatttcttttgttaaaattgcctaagtccctccctcattcttctaatggtgtgttgctcttacgacattatatgtttgcaaggagctccctgtagaccctgtattacattttggtctgtcatagagatgctcctttattcattttaaaaaggagtttaccagatttgagcacaggaacttgctttaaacaaaagaccttcggctacgtaaggcacgcagcaggatttgcagtatctctgtgattgaaaaagagaaagatgtgcttcataactaaacaaacaatgaccttcaaagtgtgctattagggcagtggaattctgtcttcctccctgttccttatggtattttaatcagtaatttgaaagattaaactgatgaaattctgataaaatgtatgtatgatctacatatgataaccttggtttaaagactgagtaacaaagaaatacttcaaaaaattatgtaaagctttaaaaatgagctataactcacaagataaatttagtggaaagaagggtaaagagccaacatacactaaagtgaataagtaaacaatgaacgaagaaacctagcagcaaaacacaaaattagggacatgtaatctcagcacatgagaaaaaaaatccaatttttaaagtattttattttaagccccaaatgacattacatgttgctctggttgggggaagttgatgcaattttcaggttagattttaaaagttataatatatgctggctgggccatatctcaaatattgtgtttggttacgattacgaggcctattgatgaactggaacacatgtacaaagtgagcaaacagcaggatgaaagaacaggaaattattaaatgggacaacattagaagctcactttcccattttaagtgtcactcagatttaatttgctagcaacatttaagacatctttatcaagtgtttttgtgttcagcttaattttcacagaagtatctttttctttttatactcaaatttcgacaggtttattttaataaagtacttaaatgcagtatgccatatatttaattataaacagctatgggaacaaatggaacaaaacaaacaaaaatggactcttatactatacagttcaatgggtggttgcagaaatgtgaggacctaattggacagcagcatctcagctgtgacatttgtggctcttgacattcactgtggagaaagtgaagagcattggtacatctagggcagtggttttcaaagtgtggtcttaaaatcagcagcatcagcatcactgagaattggttaaacatgaaaacacttgaattggatccatcagaaaatgacttacgtagactttctgaaagatggagtccagcaatctgtgttatcatgagcactccaggtgattctgatgcgtctcaagtgagaactgcggatgtttagtaaggagagatcagctgggaatacttctatttgtgtgatgatttttaaactgtatggttttgggatgcttgtaaccaatgcggagcagagacaaagacagaataattctaatgtaatcagagatgaggttacaaatctgcatttgccaagcccctggtgatttttgaggtatggatagttggactacacttagaaaaataatgaagtaggcagggtgtggtggttcacgcctgtaatcccagcactttgggaggccaaggtgggtggatcacttgaggtcaggcatttgagaccagccttgccaacatggtgaaacctcctctctactaaaaatacaaaaattagccaagtgtggtggcgcattgttgtgggaaatcagggaccctgaatggagggaccggctgaagccatggcagaagaacataaattgtgaagatttcatggacatttattagttccccaaattaatacttttataatttcttatgcctgtctttactgcaatctctgaacataaattgtgaagatttcatggacacttaccacttccccaatcaatacccttgtgatttcctatgcctgtctttactttaatctcttaatcccgtcatcttcataagctgaggaggatgtatgtcgcctcaggaccatgtgatgattgcgttaactgtacaaattgttgtagagcatgtgtgtttgaacaatatgaaatctgggcaccttgagaaaagaacaggataacagcaatgttcagggaacaagagagatcaccttaaactctgactgctggtgagccaggcagaacagagccatatttctcttctttcaaaagcaaatgggagaaatatcgctgaattctttttctcagcaaggaacatccctgagaaacagaatgtgtccctgaggggaggcctctgaaatggccgctttggggatggctatcttttacggtcgtagctgtgggatgaaataagccctggtctcctgtagcgctcccaggcttattaggatgaggaaattactgcctaataaattttggtcagaccagttgtctgctctcaaaccctgtttcctgataagatgttatcagtgacaatgcctgcccaaaacttcattagcaattttaatttcaccccggtcctgtggtcctgtgatctcgccctgcctccatttaccttgtgatatcttattaccttgtgaagcatgtgatctctgtgacccacaccctattcatacactccctccccttttgaaaatcactaataaaaacttgctggttttgcggcttgtggggcatcacggaacctgccgacatgtgatatctcccccagtcacccagctttaaaatttctctcttttgtactctgtccctttatttctcagaccagctgacacttagggaaaatagaaaagaacctatgtgaaatatcgggggtgaatttcgcccaatagcgcatgcctgtaatccaagctatttgggaggctgaagcaggagaatcacttcagctggggaggtggaagttgcagggagccgaaatcacgccactgcactccatcctgggtaacagactgagactctgtctcaaaaaacaaaaacaaaacaaaacaaaacaaaaacaaaaaggaaagaaataaaaaaataaaatgaagtagagttttctttttttaatttataaatttgttttttatagagaccagatctattttgttgcccaggctgatcttgaactcctggccttaagtgatccccacaaccccttgcctcagcctcccaaagtgctgggattacaggcacaagccactgtgcccagccaatgtagagattttaactaagggaaagaaaaagaaaacttgagggaggtgatgtaaatcacaccttcaagcaattcactagttgtcatctagaggaagtgcttgtattactctgcagtggcttcaggaaatagaactaggattaatagctggaagttacagaaaagtggattagggaagggatttctaagagatggaatggtctgctgtctacgggtaccacatctcagatactcaggagctgccaaatgctgaatacccatttgtcactgagcctacagaaaagattcttgcaatgggctggggattggacccagggaaatagggacctctaagttcctttcaattctgaaactgcaaaaattttatcattccccagatctcctgaaagtaccttgaagatttacattttataatcagaaaagagaaagctctcccaataatcttttctatctcatgttaggaatatattcttgttagatattaatatgcctatttcaggtgaacagtgttgataatagggacttgtttttctcctttgtagtaactgagcccatgtctattgggtaatttggctgatgaaatagatgaaaaacttctttaataccaaaataaaatctgcatgactcaaagaggcaaaaaactgatgatgaactttttttcccccaggaataatagagcattctagagaatgtgctttaaatttccaacaactgccacagcctattttagtaatggcttctgctggttgaaattacaggaataagtggtgtatttaggattgtccaatgtgtgttcctattattattaggtactggccattgacaaaaacaatgacaacagccatcaaaatatggtgcacaatgaagagggcaggagattttgcccaatctgggcttgtgtacagtatcagccaaaaacatacgaaaaatttaccaaggtgtctgtagatatacacataatatatccatgcttatagatggatgcaatttagataaagatgtctaatgtattgctattttaaattgtctattttagtgtcattgctttctgggtactagcaaaaattatggaaaagaaaaaattacaaccacagcttgtcatcagtataaaaatggctttcttttctgaaagaggtttcataaaagaatgctaatgagtatatatgaagctacatgtgtctttagactaagcaagagaaaaggattttgaaagagatgacttgttgatgacccagggctgtctagtaagtggcctcacaactagaaataattaacatatgactccacttttggtggaaattaaatttggacaccataataaacccaaactttacatcaacaacttccattcatctttttcctagatacttaaaacaaatttataaaaataatgtgcaaatattaccctttagaccgttgatggaattctgcttaactctttttcattctatttgatgctgtttaattcaatgacataaattgagattgagagttgaccatctgcaaggtactgtgccaaatgttgaaatgctaagattacattacatagaagatataagtcctatatctccttgctttactgagctacaattttgtaccataatatgagattcagatcattttgaataataattcaagttcaaatatcaccaaataaaataaaagtgataatgcaacataatgagctaatggtcatatataacatgattttaaagtgagacagtgtgacatttatttttctgctgtcaagtcttccagtaaacttggttcaaaaatgttctaaaaagtttattggtgctacaagtcttcttcttccttcatttcttctattttgccacccaagtttttgttatcatctaatgtgcagatgactacagtagctgctgatgctgcaaacacatcctcctatctctagattctcctagcttgccctcatctgctgtgtagatgatgatggcccacgtgtagatccagagcacaggatatgttcttgattaccttcttctgtactctgcttctctcactggaaacctccacagtagtccctgcccgaatttgccttcttcagaccctctttcttgtgccacctttgctctgtctctctctctcctgcagggccccactgtttagcaggcaggtctcttgctaggccttaactcttcctctccctgcctactctgcactgttttaagagaagctatcatgatttatattaaggaagttcgtggaaagccaaatctgttcactgaacagttaacttgcatgagcagaatgaaccaactcaggtgcaactgttagtagtatctccaaagtagtaatttgtgttcatatctgtccttttgcaaagtataagcttcctatgagcagaggctttgtcttatctatccattctcagaacaaattgcctggcccacagtaggttcccaataactgttttgttgttgttgttggatataagaatctagtagtgcttgaatacatgggtgctcttggtttgtaaacttatcatacagagcccccaggatggtctctggctgaagcctcatagctactggcataaacccaagacttcatattcattggaacacaatactttgggaaatgctgtagaaacttctgcccctggcatatgtagcagcaggggtgacatttcccactgtggggagtgtctactcagcagccccacagcattccttaggaacccccagggctgtatcggacactctgacaaaaacccatgatacaattcagagctcacagaacttgagcagcaacttaagaactaacgatgctgccaggggaaaatgaagatatattgtctgaactcaattaggctacaaggtctgatacattgcacaccaatcgatttacatcatgctgcagggaaactaaaattgttttctcaggcaagttatcatcaccgccagtttcaataaaataagatggatagccatatctgccaactacaaaatgacaaatgagatggtttcaggtccacagcagaagaaagacgagaaaatagttcatctttgagcagacacatttcatatgcttgctggtaatatctatggtggggaaactcaatggtcagtttataaattattttcactgaaggtgtagtaggaatatatatatatatatatatatatattttttttttttttttgagacagagtcttgcactgtcgcccaggctggagggcagtggcatgatcttggctcactgcaagctccaccttcccggttcacgccattctcctgcctcagcctcccgagtagctgggactacaggtgtccgccaccatggccagttaatttttttttgtattgttagtagagacggggtttcaccgtgttagccaggatggtctcgatctcctgaccttgtgatcagtccgcctcagcctcccaaagtgctgggattacaggcgtgagccaccgtgcccagccatagtaggaatttttaagcgtagtttacctatattagtgtatctataatcccaagcaacagaatccatagcactcaaccctaaaataatatgcacaaaggctttctttaaggtaaattcacagggcagagatgtaaaatcaaaaccttccttctcgtaggttccaagtctgcttgtgtcctatgatgagtgttttgtgaagcagataatctgcctcattatgatgggtgtttgtgtcagttgaggatctgactcactctgtggagctcttaccatgcctacaacttcattaatatatatataatctagaaaaagaactttctgaatactctaaggcttgtctctactttattgtggtagagattgatatcaagggaagtgaaagtaaggacagccaagctgtcttttttaaccacaaagagtatcacataacctgacacttagtcaaaacttactacctgttgatgaatgaatgatttagaaactagaataatggtatataaaaacaatgatatcaatgtagcagatgcgtggatcccaggccaccaggtcaattttctctgttgggattatttatggggaacaaatccaatggcaagtttatatgttttctttttatttgtcctaggaccctttccaaaatagcctatttacactaatgtgcatgtaggtccaatcagtaaagtccagagtgttcagccaggagggacatgactcaatcccgaacagaaccaaggtccatcccaaacgtgccaggaatgggcagctgagggactgcccaagtagatttgacactgtactgcactgctcctaccctggctccatagctgggctggggctgtgattcccagacgtggcacctgtattattcacaggtttacactgtatgcagaggggagttcccagattatagttttatacgttttataggttattagaatatggagggaaatctcacactagattttacatttaataaaatccaggtaaggctgggcgtggtggctcatgcttgtaatcccagcactttgggaggccgaggcaggcggatcacctgaggtcgggagttcgagaccagcctgaccaccatggagaaaccccgtctctactaaaaatacaaaaaaattagctgggcctggtggcacatgcctgtaatcccagttatttggaggctgaggcaggagaatcgcttgaacctgggaggcggaggttgcagtgagccgagatcacaccattgccctccagcctggacaacaagagcaaaactctgtctcaaacaaacaaataaacaaaaaaacccaccaccaccaacaaaaatcaaaccaagttaaaaatcatttgaccagggactaaaaagtatccttcaagttttcaacagtgtcttaaaaaaaacaatatgtttcccggaaagtagctacagttcttcactgactgaagactaattggtggtggaggtctgtcattaatgtgtaacacactggttttggaaatcaggaatacaacatctgattcccaccttccagaataagttatttttccctctagtgtatgctcttgcatgaaggaaaaaataaagatacaaaagagataaaaagagataaatggatacctcttcccttgtaaatttacattccatttaaccaagcagttcaattttttatgaaaagaaaatcaatatataactttgattttattgtactttgacctataaaagcaatgaataataaataagcaacaacccaaacgtccattaatagatgatcagaaaaattacagggcatatccattcaaaagaattttgcatggttaataaatagaatcatgtagaaaaatagtcaattatttggaagacatttacaatgcattttaagtgaataaagaatgtttcaaaagaatatttaaatataattcaaattcttaagtatttatatttatttgtgcaaaatgctaattggagctgtgtctgggtagagagggtcatctagaggtgaagaaactgaggttcagcagtttaaatgattttttcttttattgttattataattattattatttttgcagagacggggtcttgccatgttgcccaggtggttcttgaactcttggcctagagccacgttcccgcctcagccccacaaagtgctgagattacaggcatgagccactgcacccggccttaaatgattttttaaaattcacatggctagaatatataggactaggtttcaaacctaaatagaaacacatcaaattccttggcccaggctctttttaccatgttaccacttatatataatctgcataaggctgtattaaccagtaattccacagtgggcttagataaatcatttaattttatttaatcaaaataacattctaaaggaactaagtgttgtatcttctttgttttctatttcaaataagaggatttacatttacatttgctcctatcaacatttaaacaattgagttacagagttaaaaacagatttcggctgggcacagtggctcacacctgtaatcccagtagtttgggaagctgaggtgggcagatcacttgaggtcaggagtccaagaccagcctgcccaacatggtgaaaccccatctctactaaaatacaaaaaattagccgggagtgttggcgggtgcctgtagtcccagctacttaggaggttgaggcaggagaattgtttgaaccatggaggtagaggttgcagtgagccgagatcgtgccactgcactgcagcttgggtgacagagtgaaattgtgtctcaacaacaacaacaataacaacaaacagatttgatcctaaagatcaactgatttcagggccaacccactcctgttaaatttctctcacggagtctccacaacttctggtcattccttgcagtccccagagcacagttaggagctcaatccaccagcacaaatacaccaggacagagagaacgggatagccaaggaggcatcatcttttttctattgattcttttaaagtctctacagataattgtcttcattaagatagagtgaaaatattttcaaaaagagataagattaggtgactccctgggtgttcaacatcaatactttctaatattcatttttacttttctacttttgtagcccagagccaggctgatttaatttccacttcacacaaagacaaaaccagtgtgttacacattaatgacagacctccacaaccaattagtcttcagtcagtgaagaactgtagctactttccgggaaactgatattgttcacacaaagacaagacagaaggtgagtcacacagctggcacttgattatgaatcttgattgaaggtgtggctgatcagtcatcctaccctgtttttcctttgttttctatctgtccctccttaatgtttgcatagcagacagatgctatggtttttcttatcttatcatgttatcttttcttattttttcagacagagtttctcttttgtcacccaggttggagtgcaatggcatgatctctgctcactgcaacatctgcctcctgagttcaagcaattttcctgcctcagtatcccaagtagctgggattacaggtgtgcaccaccacgcccggctaatttttgtatttttagtagagacaggctttcaccatgttggccaggctggtcttgaactcctgacctcaggtgatccacccgcctcggcctctcaaagtgctgggattacaggcatgagccaccatgcccagcagatgctatgatattttaatggctgaaaaagtggtgtcagatttgatgatggtgatgaagaaaataattttcataattcttaaagcatatgaacctttttgaaagagaataaagtcaacttaataacatttaaaggtatgagaggacatagtaacccttggaagaccaaccttaagagacttctctgatagcaagaaaaataaagaaataaaagagtaaacaagacatgaaaaggagctttcttgagacaacaaaccccaatgcgggcattacacaaatgtgagttatttttctcctacccattttgggattaatgaaaagaataagaataatctatgaagagtaatgaatttaaagtaaaagaaaaagcttgcttcgagttccagctctaatgctcaacagctggaagatattggtgaaggtgccctcacctcactatttccccatttttttgtctgtgaaaaaaggtgatacctgcctgactacctcccaggattgttgtgcatgcaaacaatgaccaaaacaacaacaaaacacacaaaaaggagtctatattttttggaaaattgaaagtgcaatgcaatcctcagctgtttattataatttttctctaaagtgctagtaagtatttatgaatctgggtaactaacaaaaactcccctgcaaaagctggctagcaaaatatttttgtctctggggtgaaacaaaaacaacaatgccatttttctaaccttggttataaaaaccctaggctggaacatgtaaatcaacttacaaaaataggcacgcattggaaatggactcagactggggaggtgggtatcatcaggtggcaaggtttatttattttttgtcagttgggagaatgtcaaagagcagggtggatccgtggaaatagcactggggaacaaaatacatttggagtcagtcccagctccttccctaactatgtgactctgggcaaattatgcacctcctttgaccctttaaatttcttacctacaaaatgggtaaaataatggctataataatatctaccttacagggccagcatatggattaaattagataatattataaagcgcccagtgcagagcctggtacatggcagatattcaatgaatgtgagtttttccccattattttcctagactacatatttgtttactattttcccctattccatttctttcttggatactgttgaccttgtagcctccctgtatgtaccagagcaacctgtgtagaggattcctttaaaatatttacataaattccatctttactccagtaagtctatctgattataataaaatcactcattctttatcttccattaaattattttattgatcctataaaggtgtctcataaaatttagtatgtaaagatctaagatgcttgatacagctgccgaccatgaagttataaaatacggaacactaaaccaaggggaaattcagagaaccttttaatttccttactccatttcttcagaataacacccaaataaaggtattaaataaaaaagattgcattttattttcctggatggaaaaggattaacactaagcaacagtgtctgaaagttattattatggtttgtgtgtgtgtgtgtgtgtgtgtgtgtctatgtttgtgtgtgtgtgtgtgtgtgtgtgtggatggtattcaacttcttttccttcagtaattccagttgttttttttttttccacttctctttaagaaggtggttgctcttcttggtctagtgaaatcctgcaaattcagttaaatgtaacttctgggatttctcagattacatatgggccctccctcctcaccctaacacccagtagaaattgtttatctttcccttgtacatcctaacattttgtctataccattgggtacctttgagatcaagctctaccatggatatccaaccttttggcttccctaggccacattgcaagaagaattatcttgggccacacataaaatacactaacactaatgacgaataatcttaaaaaaaaggtctgtgcataatttttataacatctaccaccacagataagcaaaaatgtccttgcattcaaagggttggacatggctgcaagtctatactttctacatggtcccaagacatagcacatggtttagaatagaggtggcaattgtgtgaattttgattgaaggtgtggatgatcagtcctcccttccccttgtttcctgttggccctttcttaaagtttgcagtgtgtgaccatatggtactattttaagagtttgagaagtgggttagatatgatgttggaagaaggacaaccatttgacttcccctttccatcttccccaggttacatcactattttaaattatatcacagaaatttccattgtaatttcaagaacagtatattctgtcagcattacgtttgaaaaggattaacttgaaatgcttcttaaacaatacacagagtacctcacattatctgatagtcactttctccagcaaaatcttggagaattgtttgacattgtctttattgccccatggtgacttatgaggcatgcttcagaaaattctgtattaaagaacagaggttccaatagtgccagccaaaatttcataaaatttatttacaatgtgattaattcctggagtccatcattctccatccctttaattcatgcaatcacattgaatgttcacagtatatattactgttcaaattctttcaaatactctgtgtaccgttgcaatggtaattcacaagtagaaatgagtaacattccccaccacaaggatccttgaaggaaactgaaaacaaaagccattatctttgttgaatccagtttgctcacatttcaacacacataactccactgaactggccatcacagcaaaagccacaacacacacacacacagcagcatggagctaaaccacacaactcaacagacaatgcagacaaacttgagtataaaccaagatttttctacctcttttcataacaggttagtgctggccctcagtgttggtgtacagtttttatggcatgggaaaatagggatgtttctgccctataaaaataaatgtgttgaaggctttagtttgagcttacacaatgtcagaaagttccaaaggcactggcacaatacaaaaaaaagaatcttacaaacaaatatatatcatcaaaacacatggcaagatactaagaaaacactggtaggaaaactactggtttctcaggtgatttatgcaacagttttcaacaccttcctgaaaaataaggaataagaaaggcaggctagtgggtctctggtggggcatatcttgtcaccaaccaccactcatataaaatctttaattttaaactgctcagtagatcattttctctctgcagaagtaaaacgcatagaaccctcattgttcttaacattttaagcctcaggaagggctaagggaaagagcatagaaatacatgcactatctttaataaagaaaggaatacaaggaataaaaataaaatataaagaataattattattccttccttttatatgttgtaatataaacttctttccaaactttaattctgtacagataacttgttcatatataacatctttttctactttggaaagggatgggacagaaagataagcagaaaacatgaagttctgaatttgaataaaagaaacacttttgctgttatatcaagaatgcaaggtgggtaacagggctagaaatagggaaattggaaaaatttcattggacttaatgattcataattcctcaaaaaattaaacttaccacattctgtgcaaatttttcaaaagatgttctgcgatccattgagtttccagacttacgtatgtggggtaggataggatgaagggaaataagggaagattaaaaaaaagaaagaaagcaaggaaaacagagcagaaaaagacaggataatgaaatgatgcaacaccaaatccatgttctaaatcagaaggcccatagaggttggagagccgccaagggaggcttcttctcacaggacatgggctctgcttacaccaaaaactttccttgtacaaacaaaatggtgtgattcaagcaaaatcaaattcagccaaaataaagtggatatgtgaagcctttatactgacatttgcagagcctaaatatttaaaaatctagcagcatatcctcagaatttcctcaaaacttttatgagaaaaaattcctattgacaacatcattaattccatagagcattaatgtctaatagaactttccaaaaggatggaaatctcattctatgctgtccaatacagaagcccctagctgtggttactgagcacttgaaatttggctagaatgttatataattttaattaactaatatttaaacagtcccacgtggctagtgactgctgtactggatagtgttactacaaagtatccatttctagttgtaaaggcaatggacttttaaaaatcttattagcctacatgacgatcatgaactacacaaaattataatttaaactcagagtttcaagaagctatgaactattttaacattaaaaagaatgaatgacgttgatgtttatgtccagattttctcttccctgttatattgattacataaggagttatgaacagagagacattgattattaacattgttgaataatgaggtctactacaatacccccataatgtgcttggctaccatgctaggtgtataaaattcatcacagggatattaagtgattcaggataaatgccaaataaaaatattcggaagcaaacattccgacattttgtcatctattattgaaaaaggtgagtctactttcagttatgaggcctgtggttcaaaacatacattctagcttactaaacaaagaaacctctcttcaagtttttgacctaatgactttgttactttcttttctttattgtaattttgattccatgaaactaggcatacagaagactaacatgaaacatgaaaacagcttctaataaattttgcaaagcatgaacatctgcagaaacaaacaaacagaaagtaatacaataagcaataaacaaacagaaacaacttaaatggcccttataaaatgcaaaggtttgggggagggtcttggagtatgttcacttaccattagtccaataccctggattcagcagaggtaattactccaaataattataactgagaactaggccaagaaaaaacaactcacaaaaaaccagtacctttttctttgcctgtagaagctcctgataggcactggatcttataaaacgtgggtatgaatcacttttcatcagtttgtaaatgtgctcctaaaaagaaataatggttgaggtgcttctttatgatttcttgggaaaagtaaaatatcatgatgtcacacatggctaaagaacaaatctagtagcagcgaaaaatagtaataacaatgctgattagaataccttctatttacaggatatttagatcttcaaattcattatctcattcatagatcattgtttaaattggtttaggagctactgaggaggcaaatcacatccagtcattacaaaaatggaatttgattaataaaatgtcataaaattacctcaaatcaagttgttgacttatatagatcactagagaatataactaaatttgctgtctcttaaaactactccaggcctgaagtgggtaatgttgactcagactgagtaatcatcctggatacctttggcctctacatttactgggagggtgccaactacccagaagaatcaaatcatctctttggtacaaattgcatggaaaattgtcttccatacccactttgggtcagagcacaagtccaaaaataaattttgtgatatttaattgctaaatctccaaatttgtgtgctctttcttattacttacccagtgacagattaggtaaatagttgatcatttgcccctaagaagtttgcaatattctgttttgatgatgaattttgatagacaagtcaaaaaaaaaaaaggaaaaaggtactcattcaattcaatctagacccaatctagggaggttccactctggtctaccgcagctcagggagctaacatgtgccttgatcttccaactctagtgaaatatcagttaggtgtagagcttggaactattggagagcattctgaatgttccagttttcttttctttctttttttttttcttgaagaaaatagatgtttcaagaaatgactccagttctctggtcttaaacacaacagcaataatttgaagttactttaaattcatttaaagacattcaggattaaatctcaagacttagcccaatggtgatcttcaaaggatgttaagtttggaactgtatgggaatttgtttgaaaagtagagcaatggctggttttggagttaagcattttgagattcacattctaccttgctcaagaactaccacttacaaatgggataaatataggccaactttttcatctctctgatccttaattttctcatctataaaatagcattgttgtgatgattaaaggaataataaatgtgtagcaaagcatggggtgtggatagtaagtgctcaaatatacttgggtatatggcaggtactcttttaagtgctttcctgtattagttaatataagccttacaaaacccctatggggttggtaaccattatgtccattttacaggtgaagaaactgaggcgtggagaagtggtcacagagcagagctgaaatcagaacccaggcaatttaccttacgatcagattttttttaaaaaccacaaaaaaaactagaattaaatatctgagcttaactgaaaaagaaatctagggccaagtggtattgttttctatagaatttttttttctgtaagaaaagaggatcctcttaggcaagaatatttttaaatgacaccgataactaaaaaaaattctattttaaacctcaggaagggcattccaaacattttccacattgttggctctagaaagatgctcggcattttatcttggactgaaagaaagaaaaatcagcagagaagtgagcagcagggccagagtttctggcctgctctctgtcctgtgtctctctagagtgtaattatttctacattggagaccatggctgaaccacatgggataggtatccagttagctgttaaaattcatgttagtttactacacagttgctgatttctttaaatgaaagccaaggagaaatatattttctatagagagtggaaataaggaaggatattcgtgtatctcattcttcatcttctatattttattttagtaatgtgtgttttttaaaaggtactttttagaattaatattcttctccaaaagaagtttaagaagttatgaagtatgcacgttctgatttaaaaaccaacttcaacacatcattagggagtgggtgcagtggcttatgcctgtaatcccagcactctgagaggctaaggtgggaggattgcttgagcccaggagttggagaccagcctgggcaacatagggagacccaccctgtctctacaaaaaaaaataaaaaaaaattagccaggcatggtggtgcatgcctatggtcccagctacttgggaggctgaggtaggaggattgcttaagcctgggaggccaaggctatagcgagccatgatcatgccactgtaggtaacagagagagaacttgtttccaaaaataaaataaaataaaataaaataccacattattaggaaacactatcccctcattacaagtttatttttcttcttaagtttcaacattttttgagagaaggcagaaattcaagttgtttctacaaagggaattaagatccagtttgagaaaagatgactgaaaatttgccttaggaagttagaatcagttttccttattttttctttctgtaggctaaaaaattaacttgaaaatttaagaaatgtcagaatctaatgtttgattttttttttcaccagagataaaactggtttgagtttgacataactttaagctaattcagtttgaataatttataataatgaataattcaggaatgtcagagtcttagaatgtctacattgaagatgccttaaagattttaaatctttttaaaaaaatgttttaaaaaatcttttactgaggtggggtcatcattagatggtgtttgctcacttactggggggacaaacagagtagaaaatgaagtaaaagttgtaaaatatttcaaatatgccccttcatataaaaatattcaaacttagaaaatattcccaggttttaaaaaaactattcagtttaatgtgtctttgttccttcctagatcagttagagttattttacagttatctaaattgaaaatgttagaaatagctgccatttagaatgaaaataaaatgaatacatctaacgctcaacttctcggaagcacgtttgtggtgtgaggctcaccgtacacccacctgagcatcttcaaatgtgtatcgtccaggttccttcacgttctgtgtggttttgtcataactcttggaatccaagttaatagcactgggggctccgggagccagaaactcttgccatatttcctgaactcttgagggtacttctttaataggcctctttttcaggtcctccactgccagccagaatctatgcagaatgtgagatcgggtgtttactctgatggcccatcatctgaaaattcttgtgacatttacggatcatgcagttcatcatgacgactcacagccagctcactttctctgagggcttccagtatcagggtggtactgactgtgttcaaaggataatcttctttggaagattattatgaaaaataattattaataaaaatataaaaatattaataaaaatattttaaaaatataaataaaaaatattaataaaaatataaagaaacatgaaaaactctctcttctaagtgtttgttgttaaaagcagatctgtcagagccccgtataacactgattttacctaaggaaagtagcacttctgactgttgattgaaaacaaagaggagtttgaagggaattaaaggtgtgggacatggagcctccaattgggagataaagctgtgcattacactgtgttctttggatgttctgtccatttcagcaatgggggctagtatggagagccttttctgttctaggtggtaagggaattacaaagaagctttgctggagttaaaagaggcctggacataagatcagaaaatgctctggctggaaaaataaaaacaattaactaatgttaaggtaatttaattgagagagttatggaatgaccaaagcagcaagctttcacatggaattatttgaaaagttgaaatgtgtagaggcatcattgcaattcagaagccacggaataatatatactgacttacttctgaagatagacttatttataccatatgtatactgaaagaacctgggagtgtgttttggttgataatagcaagtggtaaagtctagtgagaaggggccacattgtattaatcggttgcatttcttcaatattttgctctaggctagagcttgctggttagatctctagaaataatgtttaaaagataaatgagtatatcataatttgttaatagaaacaaacactctactagaaaaaggagctgctaggactgtgttatcctccataaacactcttactgctctaatagtagacgaagtcaaagaaaggcaaagagggccacagagacagcaaacttcaggctacagagtcttaagagaggcacaggtgatcagcagtaccttcgtaactactaagctttaacttgaccattaataaataatcagaaatcagtaatgaagtgcatgagctagaattagaatatcaactactactcagtctagtgatttttgagttttcatttccagattttgtttttttatagatatatgtagcagaggataatctaagtttgacaacgcctcaaacaggaaactaccaccatgacttttagaaaggaaggctcaagacctttccctcttaaaacacagatttagacactgtgcactctaataggaatactatgcgaggctgggcatggtggctcacgtctgtaatcccagcactttgggaggctgaggcgggcagataacctgaggtcgggagtttgagatcagcctggccaacatggtgaaaccccatctctactaataatacaaaaattagctgggtgtggtggcgaatgcccataatcccagctactcgggaggctgaggcacgagaatcgcttgaacccggaaagtggaggttgcagtgagcagagatcatgccattgcactctagcctgggcaacaagagcaaaacttcatctcaaaaaaaaaaaaaaaaaaagggaatactacgcataatccgagggagcagaagtgttgaaattaacatatgctcaggcaagttcatgccagcacactctgaacacatcaatcaaaacagtctctgtcctcaaagaatgagtagagaaaaagataaaccatttaattggccgtaacaccaggaagtacatgaatggctctctaggaagagaacgaactagacggtctgggaaaggcaagcaggaaagagcccctctgctggggcaagtgctggattggaaaagggggatctagacaaagctattctaaatccagtgacatctgaaatgggcctggaaataagcataaaatataaaggggttgagaagttaataaccacacctacactgttatgtaagtgcaggcactgctctaagtgattcacctatattaactcatttaattcccacagtaattctattaggcaagttctattatttccctcattttagagaagaggaaactaagcatatgaagattaagttgcttatttaaggttgctcactattactgtcacagctgaggtttgctcccagaagatctgcagcagatgacatgctcacaaccactccctcacacggtctttctaacagcatcattgcctttcttattctcaccattactgtaattattgtaatagcttaatagcatggaggagccaggtgcaatggcttgcacctgtggtcctagctactcaggaggctgaggtgggaggatcagttgagcccaggatttcaaggctgctatgagctatgacagtgtctctgaactgcagcctgggtgtcagagaaagatcccatctctcttaaaaaaaaaaaaaaatcctatatcctttatataggtggaagctaagtaagtatttttaatgtctttgattcttgatttcctcatcagtaaaatgggatgataacgcctatttcactgggtttccactggattaattggtttccattggattagttgattaaattaattccgttaatgtatactaatgatataaattatatagaaggcactgaaaagtacttggcatatttttagtcactcaaagataaaaactcatgatattactatgttttcttagcacttgctctatgctatgtgttttgctcaaaaaaaagaatgagggaaatacatcataaaatttcaagtttctgctctctattagggagagcagagggtatatttgaagcataagtagttatcgagaaacagtgcttcttatttttttcctgtcctaatatttgaaaaaaaatgctcagacgagtgacacactcactgatagcaggagggcagctgtttaggtaagatgcacggagagttattttattttaagtgcaattcacagccctgttgaccactggaccattttgtctccttcagtgtgtgacacagatatgtcagtggaagcagagtagggctcagatttggggagcagtggacagtagcttggtactggtttgtaggaaaccaagaatgccacttacatgcaatctgacctccttagccacactttctcggcttaaccttcctcagccacgcttttctcatctataaaatgaggcaatatttacattttatgttgttttggtggttggatgtgtgatgatcagaaataatgaatgcaaaatataacagcatacttataaaagtagtagatataaaatatattctggtgtcttgtaggtattcaagaattaatctacatctttcatttatctactgatctatacttactaaggaaacatatgataggcaatatagtagatactcaagaaatatatgtatatgtgtgtatgtatataatgtgtgtgtatatatataagataatctaatatttcttagatataatcacttagcctagagtctagtacggcatagaatgattaagatatgaaatgattaaagcttgaactaagaaattggcaggaattcaattcatgcctgaaacctagtatgcacatgctatcctctttttccaaaggcatcttctctcttcctgttttgatggtttatctcctccccattgtccagctcttagcctagaagcgatttcccctagtatcccttcgctgatctctaactctgggctaggcatccctctctgcttctcccaactaaacacccatgattttgtgctgtgatttgttttcttgtctgtatctaccaatagactgtaattttaatgagagaaggcgatgtttttatttggctaggtgaggctggtaaggcttattacttatttatttactcatgatgatacaaatgatatcagcatgttttcaaaaacttagagaatgagaggaatgtccatctccctagccactaaaatgcctcaaggatcctttatctctgctttatttttaatgcattctttttttttttttttttttgagacagagtcttgctctgttgcccaggctggagtgcagtggtgcaatctcagctcactgcaacctccacctcctgggtttaagcgattctcattcctcagcctccccagtagctggcactacaggcatgtgccaccatgcccggttaattttaattttaattttttgtagagatggagtttgccatgttggccaggctgctctcaaattcctggcctcaagagagccacctgcctcggctcccaaagtgctgggattataggcgtgagccctcgcacctagccttttaatgaattcttgcactcaattattgacaatgtgacctaatatagaaaatgttattagtagtctcaatacagaactttagcaactttagcagcaagatcttgcaaaagcccaagcatgaagggttcccataaactggaaggagaataggaagctgcatgccagcaatccatgccaggcacacacagagagttacattcctccgggttctgtctgtggtcattttgcttcatccatgcgacatgtgtcagcgtcctacatctttctgaatggtttgggattcctacctgttaaatctcctgaaaagaacgtgaccatgcctggcactacttcgttccaatgaaaataaatgaatgcagagaactttcagtaaatgaattttacaggactgcataagtcatggaaaagtaaaaattgggcatcagctttcaaaagaataatgaatgaaagaactcatgaaacaacagtcttatatagtggaaagttatcactcccttcaatgatgttaaatagagctattaaaatccactctaatgtcttatatttaaaaatgcaattttcagatcctccttatgttagcaagttttaaaaatatataaagatgatgtttacaacagatgggcagaatgggtgtcactctctcacgaacagctcaatgctgtgctgctctcaattgccctgtggctattatttaaacatgcaaagagaatgagacagcccaatagtttggtttcaagttatttgatatagctgcccagtctcttcttctctaacttgcttgagaagtgatacgcaaagatagtcaacaatgacaaataggtgatattttaattgaacttcataaatgttattggccaatctccactttgccaaacattgttctctgtactgcatttctttacagagtccatttcaaagccaccaaatttgtatagttaaaacatctggagatacagagacggcgtaaaaataagttataagaaattgatacgttggacagcctttgccttgctatctcttttcccttcattaggtggcagaaattcaatgggttcatgacatcattatgatgttagtggaagaataattgatctattacctccaaaataaccagacacatcacagacagtatttctctggcttataagatccaagcaatgtgttttaccttaaattttccgagctgaattctgactctagaaatttaaggaactgttctctcccaactgggtctttcaatgcctcgtccatgccaaaaccccatcgttttaccctctgctggctcggttctttgctatagaagataaaacaaaggcaaatacattcctttcattagaattcccatttttttgttattacattccccttcaaaatcatgtgtgcctcgaagttcccatctttaccttttctttaaaaatatatatatccgattaacggctctgcatgaaatcatcgtgtacattagtattaataataaagtctaacatttattgagcattatgtgccaggcactttacataaatggtctctttttgtttttgccaaccactttatgagatagccactattaatcttattattttccagatgaggacagtgaggcacagtattatcacttgccaatgtcaggcaagtaataaggggtaaagatccagatattctgaccccagtgccacatttcttttttcttttttttttttttgagatggagttttgctcttgtcacccaggttggagtgcaatggcgtgatctcggctcactgcaacctccacctcccgggttcaagagagtctcctgcttcagcctcccgggtagctggtattacaggcacctgccactatgcccggctactttttgtatttttagtagagatggggtttcaccactttggtcaggctggtctcgaactcctgacctcaggtgatccacccaccaaagcgtcccaaagtgttgggattacaggtgtgcgccaccatgccaggcacacatttcttaaccactacgccacacagggtcatgcaggtatattgaactggggaaaatgcattggtaaccaaaagatctcaatactagctaatgattctggtgtcaattaaatctgtgacctaatcccaactgagtcacaacattttggggttccagctttctcatctataaaatctttagcttgtggaggaagagttctgggcatgtccagtgtttaagattcatggctggatgcaaaagtgagagagaccagaaatgcaatctagagaactgctagaagtgtgacagagcacccatcttttctttgtaaagtgatacgccatgatcctcttatgagtctgttaagactgatgatgtagttctttccctagatagctcatgaaagaaactatggagtcctaagtggtgctttgcttttcttaggaagtgtcttgccagtttctcttacagtgtctatggtaagctcattctgtcttaaaattgaatttataaagacatacttgtgttgggcttaagtatgtatggctttagcattcactttacttgactacatgagactttgtggctacgtgaattttccaggaagataatagcaatgagctaaatttcaagagctgaagatcctaactctgactaattgcacctctaattttgggacggtctttccagcaatgcaaatcttaatgcaaatgcaaatcttaatgcaaatgcaaatgtctaagtttcaaaagccatgatctcgaacaagaatgttagatataggccaatgtagataaagaacaaaattacattcacaattagccaacaataaaatccttcccatttcactcagaccctgaaataaagcaacatatgggcgagaaagataaaatgccacctaccttgcctcaagttcccagaaagtggtgtcatcggacagccatgggttagaagggtcaggtggcaaaagaaacgggtcgtattctaaatactgttccgtgtaacttagtagactaaggagaaaaaacatttccagtttctttagttttctgactggggttgcagccagtccaaagcagggaaaacaatataaaaatgtgggaccaaggaatccttgttcacttaaagcatgaaatccaatggcaatcttcacgcttcagtaactttcatgcaacaacttattgtgcttcttggcagacaactgtggctaaagattccatctctacccatgcctaagccatgtaaatcagtatcccttggttaacatgaagcactatggaagaggtcagtgtgtgaagggcaccgctaagagtcagttccaatctttggttaatcagtccacccacagcagaacagattttatacaactgagagaagggcttaaaagggaaattttgtcaaaagtatttacaggaattaagtaaaatgggagccactgacaagttttttaaatgtatataaaaattttaaaaagggagaagggaaagaagttggggaggtaggatttggcaatgcccaaaagtgaagaatatgaatggcattaagaacagatttaaatgaagcaaaggaaaatatctgaaatttgagtttcattcatattctgaagtcaggcaggaacagtgtcaattgtcattgttaaaataagtttatagagaggctccagtttgcccaaaggtcatcaataaatggaaagtttcatgtcttccagcaggagtgaaaaggctagactctgcagaattatcctctatatctgattcttagtggaacaaggactggatgtctagacatttaagacaattataatcattctgtcatttaaactacatcaaaagagttctttgaaagtttttctatgtgcaaaaaggaaaacaaaatcacattacttacaggattccaattatctgtcccaactcctgtccccacagttctctttcatttttaaacacatgtaattgtcatatgaaattttaaaatttatacagacactttgaaatactcacctgtcagcgacttttgacatttttaaccgatgtctatctaactgtatttgccaatattttatctgaaaagagggttagagaaggagttacataagtaatgacattttcacaattttccactctaaatcatgatcagctgggcaattctgaacaagagtatagtctacgtcagtacaatttcaaagttggttaaaaaaatagaagcagagggctcttaaagagttaacaaaatgaaatgttggaatttgaacacaattgatatcactttagaagagcaatgagtttgaccattctgcctactttaacaaaatgtgattttattttaaaattgtagagattttgctgggtgcagtggctcatgcctgtaatcctagcactttgggaggtcaaggtgggtggatcacttgagcccaggaattcgagaccagcctggccaacatagtgagaccctgtctgtaaaaaaatatatacaaaaagtagccaggtgtagtggtgcaggtactatagtcccagctactctgggggctgaggcaggaggatcacctgggactctgaagcagaggttgcagtgagctgagatcacaccactgcactccagcctgggtgacagaacaagattctgtctcaaaaaaataaaaaataaaattgtagagattttaaacgttcattcatggtgaatacctaaatccagaatcatacttccctccaaatttagaaaataaatgtatttattactataatttcaaaataaatcctatctcctaataccaagaaagtatcaatgatatgtgttttgagaataattttatcaacaattcatgacaaatgctcacatggaataatcacacacagaaaactttaattaaaaacgctctgaatgacttttccttcctgattattgtaaatatactagaaaagtatattttacactcttgataaactatattataataaaatatcagaggaaaagagtcaaaatgagaataaagccccataactgaaccaatcatgagattatttgatttcagacactggagtttgctttgaaatattacttggagtcaacaccattgatcaaatgctaaaaaaaagaggtagtgtatagcatgactccatggctgtacgccagtggtgataagaaaaaacttcaagaggtagagagaaatcagcactgcagaaagcgagagtaagcactcttgtgaagaaaatgtcctatcattggatgtgggaagtgtgacaatgttctcaacctcttgtcctcttactctttaaaagagagctttggagtacaaagtaactattgatgatggagtcacttacaaatcagcatatgtgatttttacaattggttagaggaacaaggatttgggtaaataaagagtgaggggttttgaaaaccattaccatatattgatacattttcaagtaattacaatacttaaaattacaacattttattatcttttaactgcaaatcttccacatgaaacagtcagtcatacaaataacctataaaaatacccactattaacatttaccctctggttttcatagctgttactctgtaaacctttaacaggtcatctcataggttgactcacctgttgttgtaactcatcttctgttggaggtttagtttctggtgtgggtgtgtgggtaggactgtgacttctaatatcattttgtaaaccatagacagactatattaaaataaaaaataaacattttaggacaaaataccgtttacagtcacagactttctaaaaagtaactctagcataaattcagtaaggtctctcaaagcttatttgattaagcttcttaacaaaattcaaaaggcactgctaagataaaaatcaaatgcatataaaatagaagcacagctcggaaaaaatgtgtagttagattattaactttgacagaataattggttatatgtagagagcaaggtgcatgtgataaaatttgagagcaagctgggaataccaagttggagaatgtcaacactaactaacatttcataagcattgatttaagaaaatagagaggtggatgaagaatagaataggaatgcaataactcaaaagaagatttaaaaataactcgatattttacataggaattaaatggggcactgaggagagtgacaagtcaagaattctattgctgatttgatttctgatggtgcaatagaagacaccagggtactcctactctccatatcaacagtgggttatttacttcacaacactagccttgccattgggtgccatttgcaaacatcagtgaccccagaggcgtcatgcatcttcggaattctcaatacccttgtattttttaattaacttgtcaaaaggtcagacctactacttaggaagactcttttttgagaaaggcccattgcttagtaagtataaataaagatctggtgactaaagggataaaaaactatctgtaactgactatgagacatctcacgtgtcaactcaaggaagaagccaaattatttcttcttggatatcaaagtattattcctttaaaataaagaatttaatgtgtgttattgagcactttttctttggatatgagcaagaaggatgagggcataataaaactgcatgagctccacaaaattagtaccagataaagtttacaaagacacttttgaaattagatgaggttagatccagatgcctaatgatgccaattttcaggcccgtcaccaagcttgccaatatctctaaattcaatgtgtttttattcctgaactgctttcacttggaccttaaatccacttaacactacgtcttgactctgtatctgtcttgactctgtatctgcaccttttggatgtggttttgcccttgtgtctcccgccctccgtcctttttatttttatttttttgagacagagtctcattctgtcattcaggctggagtgcagtggcgtaatcttggctcaccgcaacctccgtctcctgggttcaagtgactctcttgcctcagcctcccaagtagctgagattacaggcacgtgccaccacacccggctaatttttgtatttttagtagagatggggtttcaccatgttggccaggctggtcttgaactcctgacctcaggcgacccatccgccttggcctcccaaaatgctgggattacaggcgtgagccaccgcgcctggcctccgtcctttttttggtgctcttatcctttctttatagattttaacttggacttaatcattggaataatctattcccagactatcttgggtaggcctcttcagtgtcctttcttgccctaccaccagaaccttggaacccaattcccatcactgaggatatccatttcttttttttctttttttataatgccaaacaagaggcaggaaatggccatccatttcaacacaaggatttgctcatatgctttgaatttactctgaacaggacggagctgaatgtcttaaactagcccttttatttcatttattttttcactcattcattcattcattcaacatttattgaacacttactatatactagatatagtactaagcattagggaaatacaaataaacaaaatagatgtgcttctttctgcactgggactcacaatccagtggaagggaaagaagttacacaggtaattacacaaataaacatatgactaaaaaagggagcagtattatgaaacaaaaaagaataacaagcatagggcctggaatataaagtgatttaatttacactgaaggaatggaaatggcccaaactgatactagccatatttgaacatgattaaataaaacaaccttctgaattctgaaataacagtagaggttgatttcttaaaaattatgtgttatatacataatggaacactattcagcctttatagaacaagaaattctgtcatttgcaataacatggatgagcctagaggacattatgtttagtgaaatatgctaggcagagaggtctttaccatagaattacacttatatgtggaatataaaaaagctaaagtagagagtagagtgacagttaccagaggctgggatagggggtgaggaaaagaaagctcttggtcaacgggtacaaagttagttagttaggaggaataagctctggtgttctattggacagcaaggtgactattgttaataataatgtattccatatttcaaagtaactaaaagagaggattttaaatgttcttgccacaaaaaggataaatatttgaggtgacgaatatgttgattactctgatttgttcattccatggtatatatgtttattgaatattacccgataaatatgtgcaattattatttgtcaattaaaattaggcaacagaaagatcaccaattatataatagttctacctttcagtatctgctagtttttcaactgtatcaccttaatttttgagaagaaaaataaaaagactctgagacttgaagtttccattcttttttaacttggtttaattatttaaagtttttaaataataatctacaggtcatataaacagtgcttataaaaaatagctgatggttttaacagtaagtttttaggcgaagattaaaaaaataacataaaagactgctagaaaaacacagcaatttgtggtatcatgaaagtaaaatgatctataagttatcttttatctctacatttctataatgatttcaacatttatgcatttcctgtaaacttcatagaggtccgatacgaggccgggcgtggtggctcatgcctgtaatcccagtactttgggaggctgaggcaggcatatcatgagatcaggagatagaaaccactctggccaacatggtgaaaccccatctctactgaaaatacaaaattagccaggcatggcggcatgtgcctgtggtcccagctacttgggaggctgaggcaggagaatcacgtggacccaggaggcagaggctgcagtgagccaagatcgcaccattgcattccagtctggcaacagagtgagactccatctccacaaaaaaaacaaaacaaaaacacaaaggtcccataagagaccatgacccaaaccattgggaggtgttgcttaaaacatcttccaggagcctggctacttgctctgaagttactgcagagtttccatttcttgtcttacgtaaaagtcaacatcaggaagtctccctttcaccaatctgagtactgttcatttcctggggatagtgatagcgtttaactttgattgttggctacaatgaaaacagccgagaagaatataattttacatatggggattattttatggacaaaggaggcaaagagattaatcctattttggcagacaaattatgaaaattatttgcaatgtaaaaggctttgcatgttttagaaaaaaaatgtattcaaatcgtggtacagggtggggtggcatagaactagaaacaggtaaggttagagaggaagagaaataaaatctcttaatgtcttaatatttgcagctggggaaaatcaaattaactaattgagatccatttttagttttaatagcaagatcatttatttgcaatgctttggcttgattaacacgttcctttattcctatggtgctaagacaagcactttttcatatgcagtgccatctatttattcattaaataaaatagattcggcctcctacataaatctgttcatgtgtgatttcccttgacattttagaagagaactagaaaaattatcccgtttttttttttaggcagggggtgggggtttgctatggtctgaatgtttgtgtctctccaaaattcttatgttgaaatcctcaacccctaatgtgatggtattaaaaggtggggactttgggaggtgactaggtatgagggtgaagcccttgtgaatgggattagtgcccttataaagaggcctgagggagctcgtttgccgattccacgatgtgaggacacagcgagaaggcaccatctttgaagcacagagtgagctcgcgaaagatattaaatctgctggtgccttgatcttggacttctcagactccagaattgtgagcaatacatttctgttgtttataaattacccagtctaagatattttgtcacagcaactcaaacagaccaagaactaagtcagagacagtaaaatagaaaccacaaagtacaagaagcctttctgtgtttctatgtgaaatgtaatctctggggcttttctgactgactggtgtggtagtatttctctttctttcacggttgctcagctgagctagagaacagattgtgaccatatctgacacaatatggaggaagtcagtacacagaaagaagcagagagaaggcaaccagagagagaaatcatgagagagctgggtcgactcacacctctgggcaagcttgaccactgcctgccacaaggtttcagaccatgaatcagaaaagtcccctcttggccgggtgtggtggctcatgtctgtaatcccagcacttagggaggctgaagcaagtggatcacctgaggtcaggagttcgagaccagtctaggcaacatggtgaaaccccatctctactaaaaatacaaaatgagcagggtgtggtggcacatgcctgtagtcccagctacttgggaggctgagacaggagaatcacttgaacctgcgaggcagaggctgcagtgagccgagatcccgccactgcaccccagcctgggcaagacagagtgagactccatttcaaaaaaagaaaactcccctctttattcattttcatttgagcagtttctattgcctgcacctttactataccctttacttgacacacttttgtgttgttctaagacaagagtagtttattctgttcagtaacacattaaaatttaaatgtacacatgctgtatatggagttgaagacatgtccatattttatgcagaaacagctagaaccactggattattaatagcaggaaaaccagacagctaattatacatttgctgttgtttttctaggatgtgcacattagcttttcactgatgctgttaactgtaatatttagtgccatgatgtccaaatgaaggtgacagaggaaaaagagaacaggataggaaatagcttactgttattttgaaatatgggtgctaagttacaggagggagcccaaagtgtgggtccaatcacacatacatgcagatgctcttatcatttccctcaggttttgtgacctaggacccctctagctattgtcctacagaaggatacagcctgtggtggtgaattttgtgtcaacttggctggctcatagtactcagatatgtggacaaacattactgtggatgtttctttgatggtgtttattggatgggattaacatttaaatcaatggactttgagtaaagcagtttgcccttcacaatgcgggtgggcctcatccaatcagttgaagtccttaatagaacaaaggctgacctcccctgagcaagaagggattctgtctccagactgccttttttgttgttgtttgttgttttgaagaacaaggatatttactcttaaaaaagaagcgctgtcccacaaaaagatgtacagatttgaaaaacacttattttactgtattaaaaaacaacaacaacagaaaaacaggcaggggatgtctagatggcagaattgaagcagctctgtacgaaaatgaagatggtacgatgatgtgacttcaaagaaaatgactaaaacaaaatttcacaaacatcttcacgtttctaataataatgcacaaaatatcaaaaatacaaagtctgggtttcttccctgtaggtttatgataaactattaaacttctatttaatgcatttactttcataagccttctttgtttagaagtacaagctatacaagtacatacatgctggtattttaccatgaaaatttcacttttcatctcaaactagtgatttgtcttcttacccatacttatatacatttcacttccatcataagacatgtaatacatttctagtggtacattttaatcaatatatattttttaaatattgatttttaaaagaatctttttagtgctatgatacgatggccttaatttaacagctgaagcatgatatggtaactacactgtactgtttaattttcagctgtaggaaaacatttgagttttaaaatataaccaagatgaggctggatagtaataaacaccgaaatactagaaaacagtgaacgaataaataatacattttttttcatcaggggctattcatcattttgtttttagaaacctggaagaaattgtcttgagtttcaaatgttctggtaaatctagtcgtttcttagcctcctcaatgtcacctggaattgctgaaataagtgagtctaaagaatcaaagttcttttctggtctgaggtagccaacaatggccacattggggatttccccatagaagtcctctttgaaggtatgcaggataagcgtgtccatggacttcttcgtattcttgtggtagagggtccatcctatgctcaccaccacctaaaggccatctccacttccgacactggcccaaccataataaatgccaatggatacatcaactggaagattagctactacttgttctggaaaattagctgcggagatgcccagcggcctggagccacggccgaagccccgcaccacttgggcccggcagaggcagggcagatgcctcacgttatagtccagtccgctcaggacacgggctgcggccgggtccgcgcgttctacggagccgccatcgacgcggtgcccggaccctggatcagcaaggggtggggtggggacatggccgtgagctctgcctgccgcgggggcgcaccaggggcctggcgacaagacgacacgccgcggtgggtccctgaggcaaccaacccaacaaaagcttcccggcgactcaagagctgtgtctccccagactgcctttggatttgaactgccactcttccctaggtctccagcctggtggcctcccccatgagattttgaactcgccaagcctcagtaatcctgggagtcaatgccttaatataaatctctgtctctgtctctctcccccctcccgccccccactctgtctctggttcggtttctctggagaactctggctaatacagaatctattacagtaaaaattttagtatcggactcaagaacatcagaccgacagttccccttcaaacttacttagattaggctgatttctttctggctatgctacattatcattctttcacagatccttgagataatacatttttacctatttccttatattgtagtaaagtatattctaattaaaaagaaagacttgaaaatagactaattttagattcttaacatatctcaaatcatgcatacagcaaagccttcgcttcctatatttgataaacatgtcaaacattcaacaattagatacaacattcccaaatgaaatgtgaaatgattctgatattcttcaggcacctatgctagattgttactttagggatttactgggtcctttattcttgtcacggcacgtaattacaggaaaaattattatagctcactcccaaagaaatgaacagcagctctccttgctacgagcattatctgctttcaaagtttaagcatgttccatagcttccacttcctgagcagccacagtataaagatggaggccgaccacacagccaggaggaggcgctacagagacggctcaattatggcggaagggaagggtggcttccaggggcaactggctggcctctgccatttctgtctgtggtttgtgatctcacagcgtcacctgctccgcagatacagagctgtggacccctcagagggtggtgaaacagcttgctgattgctgtcaaggtattcactgacaaaatgcagtggcaatcacaagcacgaatcacgtacactccctttgtcatatgtcatggacggagttgtgtcccctcccctaaattcttatgttgcagccctatcccccaacatagctatatttggagatcaggcctgtgaagaggaaataaaggttaggtgggttatagggtgggaactaatacaatagaactggtgtccttttaagaagaggaagagaccccagagttggttgttttgttttgtttttctctctgtctctatgcacacacaggaaaagccactgaggacacgagaagaaggcagccatccccaagcaggaagagacactccacaggaactgaacttgccaccaccctgatctcgaacttctagtttccgtaactatgaggtaacaaattcctactgtttaaaccacctagtttgtggcattttgttaaggcggccccggcagactacatgaagcttaacaaaatcatatacttatatccatgtacagacatttatctccttgctcaacacctgcacccttatgagaccatgaattaggggagcaaggccctgactgtcccatttactgtggagtacctaaagcccaggacatgtctggcatagagtacagactccttaattttgctaattcagtggatcattacagttcctaaacaactatgagctaaagtatcagtggtgatacttctaaaaaatattagtatgtggcttggagtcggataaccttccatgtaaaataacattatcatctgcgaagattctagcaaattgaacacttctgactgtgagaagctacatttatcaaaaggtgagaaaaatccgttttctccaactgtggaaaataagggtatacctgttatttgctgtcagatttttcaggacttttgttttcttctggcaaatgttagcgctagacagctctggagtgaggccctgtcattctgttgttactgattcacaagaaattagatgttatcgagacaaagagagctagatctcaatgactctgtttctttacaatatttcaccttgcaatgcctcatgggcttttcatcattaaatgagggctgatggtatgtaaagaacgacattgtaaactaatgcttctcaagtgttcaaaaagaagggtgccatgtgaaacacgagaaagatgatctatactgaatatggtgccgaagagagagtataaatgatgactttattgtgtctaggtgctatcttgttaatccatatgcattctcttctgaatcacagcatgtctgtgttagggtctgttgggggaaacaggacacccaataaagtatttcgaagagtaatttcactattcagaaagtggagagaggtggcttaatgcactttttggagagccgatagcatttttgaatcttgttctgcaaaaatagttcttggtgccctcaggatgtgctgtgagcagaggatgaaagcaattaagttgggccagccaccagagagacagaccagacaggcttgctttggtctggcttcgcctctctcttggagagttcctacgggcagaagcatttgagcaccgcatccgaattggttttgtggtgctttgcttcagcttctttatcctaacatcaaggtaaactgccttaaaagaaagaaaaggtacttggaccatattggggcctttgaacatgatggtatgtttctagggatgggagaaaatggcaacacaaaataagactagaaaaaaatattgagtgcttactacagggacacagactctggaaaacacgatggctaacgaaatactaaggaaatggccacagaaaaaagaccttgaactttgtggaatgtattaatccagcagcaccaatctataagctgtgttctcaaagcgactgctacaggccagaaattcttgtgtacatcaagcgtgttttatagaatgaataaaaatgccttctagttgtacgtgttgctttaaaaaatatgtagaaactattgctgtgcattttcaaagggttatttaaaatgtcactggactcagaatagcttcccccacaccctgcacaccgatattctctcagataacaaacactgaaatacaaccactgtcttatggttgtatcacaaaattctagtgttaagaggggcccctgcactctttctggaattaaatatcttttagatgtccccctttcctcaggttttaaaatgcccttctctcatcagtatcaggttttctaaagatgatttccttagaaatcctgttcctctcgtctcagtcagtcatgaccaccgctctgtcttgggaccctggtgtgcttgagcattagggtggggctattcttgaggaagggagggctgtggaaggctgggaagagtgggaaagatactgcatgacatgagaagaaagtgtttttatggctgacgtcctgtaaacaatgcaatccatcaccaagatcagcacaacaaatgacagttttaccttccgtgttttgtgggggtttctcattctggatgacttcttaatgtccacttcagttgtatttacacatccaggctgggaatggaaaaacagagagacaaatgaatctttgggtgtgaaatttctgaccaggacaatcatgaatggctcgctctccagagcccgagcaaatgccccaatgacacaaatcaagggaggtgttttctagatggccacagccagtcccatcagcagtagccagtcataaaagacatgatacttcttaactcttcacacttaaaagccttcagatgctatcctcaaataactcccagagaaacaggaaaaagaaatactcggactgcacatgtgaaagtggtgtcaatacgtatagcgacaaacccgacagacagagtgagggcactcctggacaaagagataccccttgctggttttctgcagacagcctctcgcagagatctctctttataaaaagtgaggctgggccgggcgcagtgactcatgcctgtaatcccagcactttgggaagctgaggtgggtggatcacctgaggtaaggagttcgagaccagcctgaccaatatggtgaaaccctgtctctactaaaaatacaaaaaattagctgggcgtggtggcgggtgcctgtaatcccagatacttaggaggctgaggcaggagaatcacttgaacccgggaggtggaggttgcagtgagtcaagatcacaccattgcactccagcctgggcaacaagagcaaaactccattgcaaaaaaaaaaaaaaaaaaaaaaaacaggctgttattagatgggtgccttgcttttcccaggctggaagactaaaatggcatttagttgagccagctcacatcccagaatgaactgtcttacaaggattgtgaaacccagcaactaggaatccttgtttgccatagacagaatgtgcaatggagttcatggttaaaatgtgaaagatggagaaagaaactggtaaataagatgccatgcttcttctgataaattcctgaccttccttttccttaagggcaggtgaacccctttaaaacagaggggttgatgaagtataggcagcctgctgttagcttcctgacaacctcaggtgtctcatttgtcagatttattgttctgttgtacagaaacaaatagatgcaagctccttgtatatttggaggaggagaggggaggagggaggaagaagaggggaagggagagaacatgaatcacgaaacagagaagacaggagattcaaaaatacatagtagcttaaatgtagaaagggcttagacatcacacatcctttagaagtgatgagaagttaatggctacatggactgtgtttcctttacttttggtgcaggatttaacgatctctggtattagtaaaaaacatcggccaggtgcggtggctcacgcctgtaaccccagcactttgggaagccaaggtggatggatcatgaggtcaggagttcaagaccagcctggccaacatggtgaaaccccatctctactgaaaatacaaaaattagcaggacatggtggcaggcgcctgtagtcccagcttctctggaggctgaggcaggataatggcttgagcccaggaggtggaggttgcagtgagccaagattgcgccaatgcacgctagcctgggcaacaagagagaaactccatctcaaaacagacaaacaaacaaacaaaccatcaagttgcatgtctctgctcaatttctctatttcttcccacagactgcaagaaattaaagcattagatgtccttagaagtgactccagagaaactgtgaatacggaaaagtcttccgtggagttggggtggggttgggaagaaagggcaaaaaggcagagctgatgtgattggcagactcagctgttcactacagtaacgggaatcagttcattgtgtaatgaggacagaggacactttccttaaagaaccatctcctgctagtatagccattgggccaaaactccgccataatattataatagataaggaagtaaatgaggaaaacatttttttttgtagaatatgtatatactacagatacacacacacacactgtactacaaacattaaataaattatgagtttggtttgcatatctatttaggaatagaaatcactggttcagcacagtggtcagcttggcagtgtaggagggaggaagggcacccagctgggtgggactaatttcctaagtgacactgagcaattcactaaactctcccagcatctggttgctgagtatgtgatattgtggtttgatttttttttatggttggtctaagcatttgttttttaaaaagacccccggggattttaatctgcagccggagttcacaaccactgatgtaggtgtaacaaagacaaggtttttaaaacattaaaggatcgagttttcactttccattcgatttctatttctttgcagccttccatccctaagcctgagccataacggaagggaaggcagtaaaattctttaaactcctatcaacatatcaggagccaagcacagtgccaggtgcagtggcttatgcctgtaatctcagcatttggagaggctgaggtgggaggatcacttgctttgaggagtttgaggctgcagtgagctgtgactgagccaccacactccagcctgggtgatagggtgagattctgtctctctctgtctttctttttcttttttttaaagagccaagtatgataagatgtgtcatagagattttcttccatatgttaaggggtgggaaaaattaggatataatatccaggaaaaggaaagcatgtttcttcatgacctggaggcaaagaaagataaaggtaagatactgagctcagcaggtgtttcatttttctcctctgtggaagaaactcgaagaagaagaggtgatagggaggaataaaaagtcccagacaagtatgaggaagcctgtgaagtagtcagtcccattcccatagaagaagccccacatgcaatccgagccaacatgaattttatatcatatgggtgttagcaagaaagatgagcttaagaaaatgcttcccaagcctcttatgtggcagtcaagccatccggagtttcttgcatgccacagtagtaaaaggcacagaagatctaagaatagtgggtggatgggagcctgaagttgggacaaaggctgcagtgtgcagggattttatgctggaagcagatgtctgaaacacaaacttcagcagtgagttccaggtgatgagatggtacctgttgcaacatgcaaacctgtctatagcagaaatcgacaaggatctggaagatgttctgggggtgcttggccctctggccccactgcacaagactgtaaaaacaaaacctctagaccccaaactctcttccaaaccaatcctggatagcagcagagaaaggccgagaaaactgaaaatgtaatcatttatccacaaatgaccgagtcatctaaaccaactatttcaattatggtggcatgcagagcacatgcgttgaaacctacccttcaaataggtttctgagaaaactatgtcaattatagaaaataaagaaactgtattttctttatacatctgaggaagctgaactaatttgaactctaaactccttccataaagagctaggattccaaatcaattttacttcataccaggggtcataattaacaaatggccctggaaatcgtgtcaaccattgaaggcataaagtggaaagattcccctccccagaggaacatatctgactgtcagtcctgaaggaaattagaagtttcatcctcatatttaaaagatgatggccttttaaatttgattaatgaaccattagcttacatctgaaattcccacttgagccaattattaacaccactaatcagcaaattaataagaaagcattgattttaaaagtaaatgtcattagagactgaacggtaagatatgttttataacccggctcccatcccaggaaaatgaaatctgccagttcaaagtttgttactaatgactaaatggttaaaatagtaagctggatctgggatgcttgtctcggaggccctgtaatttctaatgaggcctcatgggacagctaatggttcaacagatctatgatatctaagtcaactaggaaattcttgaagattaaaaaagcttagaggcccaaagttgcctggaatacttctgaataattaaggtcatgacccagtgctgataacccctgaataactgctttcagaagtcatgcactgtggtaagtgaaatatggcaataatttttcttgaattctcttatgtattcaataaatatttctttctgcatctaattgtcggatcttgtgacaaatggtgagttacagaaatgaaggcacgagccctatcccagtaacttcctgatacaataaaaacgacagacacatgaataatcagaatatgggagcataatgactaagtggaagttggcacagagcattacatgacaacagaacattccagacatcctttttttttttttttttttcctgagacggagtttcactcttgttgcccaggctggagtgcaatggcgcaatctcggctcactgcaaccgctgcctcctgggttcaagtgattctcctgtctcagccttctgagtagctgggattacaggcgggtgccaccacacccagctaattttttgtatttttagtagagacaaggttttgccatgttggccaggctggtctcgaactcctgacctcaggtgatccacccgccttggcctcccgaagtgctggaattacaggcatgagtcactgtgcatggccaagacagacatccatttttatgcacagtctgttggttctcctcaacatggcaaacactattcctttaaaagttatttttaagcaatttttcaatctcgatgagaccatgttgtctttggttatttaaaaaaaagtcaatcatctttttgatgcatatataataggtaccactagctggcaccagaccttcgtgaaattcgtaaaattggtttctgcagagctaaacaaatctatcttcccaataagatataaataacattaccattaccaagtagacattccattaaaatcttcaaatatatactatttgctggatacagtattaagcacatagtattgttggatgtaaggaataatgaaatgctatttacatcagcctggaagagaattgtgttatttctagtgattcaaagatgaatttcttttcaaccgaactaagctgggttgcaacattattataacgttatttattataaagtaggatttaacattgtggaagccactcctgagggagtaaacggagcatatcattgagaaatactactgtcataacatttacgtgagtgtcctcatgaggtgcaaaagagaagctggagtttttggtttcattattgatattttaagtaaaagcatctaaatgccatttagttcctttcatgcgatagtacatttttgttagttatagcagaaggtacacttgtgttcaagacaactcggcaaagcctgtggtgaagagcgacagtgagagagaggaatacagaacagctgtgtttaagttccatcactgcagctgatgtgtacctgggagaacagtgtcctaaacgacaggtgagtggaggattagaaatgcaccatcaaatagagctgatagcaagacatcaagtacaccctagaaagttttaaaaaatcatgattctgggaaaattcaggtttcaaatatgcatagtccccccttatcctggggggatatgttttactactgcccacccccacaaaagagatgcctgaaaccacggatagtaccaaaccctatatatgctgtttttcttatatatacacatgcttatcataaagtttaacttataaattaggaacaataagaaattaacaacaataactaataataaaatagaaaacaacaataagtaataataaaataataaaatatgccagcctcactgcgcttgggctttggggtcattctgaagtaaagtaagggtgactcgaacacaagcactgcaataccaggacagtcgatctgataacctagaagactactaagtgcctaacaggtgggtaccacagacagcgtggatctgctggacaaaggggtgactcatgttccaggtggggcagaatgggatagacgagatttcatcatgctactcagaatggcacgaaattacaaacttatgcattgtttcttgaattttccatttaatatttttggactgcagttgactgtgggtaactgaaaccacagagtgcaaccatagataagggggagctactgtatttagatggtccctgacttactatggctcaacttaaaatttttcacccttactgtgagtttattagagtattaaatgcatttttgacttactatatttttggcttacagtggctttattgggacataaccccattgtaggtcaaggagcatctgtatatatattaattcaaatagaagtaaattaatgaaaaagagtcaccgctttgtaatacagtacaagttataaaaactgcatgcatgatccatagtaccccagtaagaatgatcccttattcttacatgaagtaattatagattttaaagtgttcacttacatgaagtaactatagattttaaagtgttcagtctcaggacttttttttttttggcccaggctggaatgcagtggtgcaatcacagctcactatagccttgacttcctgggctcaagcaatcctcttgtctcagcctcttgagtagctggtactacaggtgagtgccaccatgtctggctaatattttatttttaatttttagtagagacagggtcttgctccgttgcccaggctggtctccaactcctggcctcaagcagtcctcccatctcagcctcctaaagctctggtattacaggtgcgaagcactgtgcctagccaggattctttttttaaagatccaattcaagcttttcttcattttcttaggcagttgtcagttgattcagcctctgatcctttcagccctcctcctcccgacccatctacttactaagtcctacgcacaaactgaagaaagttgtttgaggaaattgctccaaatttcttccattcactcttctctatagtatttactcatttgattcctattaggcctcatttgctagctacagactcttgggtatgatatcttgcttcagtgtatgctgtgaatgaactccacacatccaagaggcagaaggaaacagaatcatacgaagtcagcctgaagctgtggaaagtgggcaggttgagtagaagtcacagaccatgataaggtggtaaggactttggtttaattctttatttttatttttaaggttttttttgtttgtttgttttgagatggagtctcgctccaccgcccagactggagtgcaggggcgtgacctcggctcactgcaagctccgcctcccgggttcacgccattctcctgcctcagcctcccgagtagctgggactacaggtgtccgccaccacgcccagctaatttttttgtatttttagtagagacggggtttcaccgtgttagccaggatggtctccatctcctgacctcgtgatccgcccgcctcggcctcccaaaatgctgagattacaggcttgagccaccgcgcccagcccgactttggcttaattctaaacataattggaagccactggagagttttaaacaggagagtgacttcatatgatttatttttcaaaactcattcagaccttacactccacacacacacacacacacacacacacacacacacacacaaactcaaaatgaatcataaacctaaatgtaaaatgctaaattataaaatttttagaaaataacaggagaacatctaggtgaccttgagttgggtgatgactttttagataccctatcgaaggcacaatccatgaaagaaataattggtaacttggatttcattaaaattaaaaacttctgttctgtgaaagatactgtcaagagaatgagaagacaggccacaaactggaaaaaaaataggcaaggttattatccaaaataagtaaagaactcttaaaacccaacaataagaagataccacaacccaattaacatatggacagatgatctgaacaggcacctcaccaaagaaaatatacagatggcaaatacatttatacaaagatgctccacatcgtatgtcattgggaaaacgcaaattgaaataacgagataccactacacacctattagaattgccaaaatccagaacgctgaaaacaccaattgctggcaagaatgtggagccacagagattctcattcattgccagtgggaatgcaaaatggttcagccactttgcaagacggtttggcagtttcttacaaaacactctaaccattcgatccagcaatcatcctcattggcatttacccaaattgagtcgaaaacttatgttcacaaaaaaacctgtacacggatgtttctagcagcttgttcttcataattgccgaaacttcaaagcaaccaagatgtcctttagtaggtgaatgtataaactgtggtacacccagacaatggaatattattcagcattaaaaagaaatgagccattaagccacaaaaagacaaggaggaaccttacgtgcgtattactaagtgaaagaagccaatctgaaaaagccacagattgtacgattccaatcatatgacattctggaaaaggcgaaacgatggagacaaatagttttgccttttccagatcagtggttgccaagggttgggaataaataggcccagcacggagaaattttagggtagtgaaactgtatgacactacaatagtgaatacatgtcattatacatttgtcaaaaccatagaatgtacaacatcaacagtgaactctaatgtaaactacagagtgcaggtgataatgatatatcagtgtcggttaatcgattacaacaaatgtaccgctctggtggggttgggggtggggggttgataatgggggcggctgtgggccggggagaggttgctggggaattcagtactttccacttaattttgctgtgaaccaaaactgctctaaaaaataaaattgattaaaaagcaaccaaacaaacaactcattcaagaatattgagcactttgagagtggattatcagggtgggaacagggcaaagcagaagcaaggggcccagtttgaaggttactgcaattattcaggcaagagattatggtgacgtgggtttgcctgccagcactagagatgatgtgaagtggttgcatctgggatgcattttgaagctataatcaacaaaacttgctgatgggttttgtctgtgggcatgctgaaggaaacagaatatcaaggatgactcccatgccatctgctgagatgggaaagcctgtgaaaagaagagaggaatccaaaatgatccctgggttgtatttacatacaatgtttgtatttgctgaagtctccaaagggaatgcaactctttatgcagtctctatgaagatcacgaatcagagcatttccaacacaaatgcctgtataatcatttgcccttggcctgtccttttgtgccattgcgtttttgcattatcactggtggtatgaacatatcattgaatctgcaacattaaaacatgatgatcaattcctgagaatttggtggagctgtctctcattactcagagtctctgctacactttcctaaattttctgtagtcctaccacattctattaatctgctctaattgaaatcagaccacttcagcctcacatctagcaactatctgtgcatccttcaatgacattccctttttatagactaggaattgccttgcaggtaccattctcaaagagcaaccaagaggactctaaccagtacatttgctatagcttctttgtggtcactgggattacccatgtttaatgttcagctttaaattacctaaaatgttcccagttagaactgctttgaaatttaaaaaatcactgggcagaagctaagttgtcataattatctttaaaataggggctcctgcaggaagaaacaaaaggcctgaggcaagtaagcgtggacactttcctgtgacacctggcctgctgtgcgcacatgagcgattgatgtccttccctttctatgattatttccctacaaaaagctggctgcagtgtgaggacatgcaaagagtttcaattggatgagaaaaaaagtctctcttagatttgagactgaacatgtgtgctccaacttgttctatatcctgggttggcatattgggtacttttatacccataattgaactggcattttgatttgcattatactgttcctctggtatttcactggtgggagggtgagtagcaacacagaattttaggattcctggtctgtgggcttaaatgggtcatcaaacaccttaaacatttttactttaacacttaacatgtttcttgaatgcagaaattaagacatgaaatctaggctatgtctctggtgacaacataaatttccccaatgtaaaggtaaggtgccaaaaagtaggaaaatgaactagctactgaactggagaaaacaatctttatttttttacacagtgctattgttagtactggtgacttacatggtatgctgtaaaggctaaagagaaccaaataaaatttcatatagcatcaataactcacagtaaattcaagggcttataataatttttacaacagatagcaatgggacaactaggaaataagtttgtgaaaatcatcacatattggaattaaccttgaattacaatagctgccttgaattcaatagctttgaatcacaaaggatatggggggctcctaaatcataagttcccaaatagaaaaggggtgcatctccctgtcttagtctcttcagacttctataacaaaataccataaaccaggtggcttataaacaatagacatttatttctcacggttctggaggctgggaagttcaagatcaaggcagtgaaagattttgtgttgggtgagggtcacttttcagttcatagaaggttccttcttgctgtttcctcacatggtggaaggcataatagttctctcttggcctcttctgtaagggcactaatcccattcaagaggaaagaaccttcatgacctaatcaccttccaaagatcttagctcctaataccaccaccttggaggttaggaattcaacacatgaatttggggaggacacaaatgttcagaccagagccctccctttacaggacacacatacagagaaaggccataacacatacctcggtttagcaaaatctctgtaaagaagattaatttcaaagatatactctgttgcattcaacttgatttccaaaaagagaaaaagatgtagtggtgttagaaaagagatttttacataaagttcttttctagatttcatatttattgctaagagccaaaattttattttcagtgctagggaaaaaaaatcttttaaaataattcccatgcatcctcgcattcttacttaatcatatccaaaacaacagagtctttcttgatgatttgaggtcgtgattatttgaggacaatgcttattttttattattttttttttttttgagacagagtcttgctctgtcgcccaggctggagtgcagtggcgccatctcggctcaccgcaagctccgcctcctaggttcacgccattctcctgcctcagcctcctaattagctttaggattacaggattaggattacaggctaattttttttgtatttttagtagagacggggtttcaccatgttggccaagatggtctccatctcctgacctcgtgatccgcctgccttggcctcccaaagtgctgggatgacaggcgtaagccactgtgcccggcctattttgctgtctttaagacagcaatgcctatgaggctagatgatcccaactcctaatgccttttgagcttttatgtgattttatgccatttttagttcctctgccttatcccagttagctgtcactttttgctgctctcagcatccttgactccagcgcatctcattattctctaattcgttgcttggttctgatgtggatcagaaaactatacaaatgctcctttgccacagggtctcacattttagcgaatgaaccgatcaaagcacacggttagagtgtgagagtttaaacagctacttcggttaagactttttgagtttatttcttggctgagttttggatagaattagacttgaagatatgagaggtaagaaaaagtctcaaaactgtaacaaataaaatgtggacaagttctcatgatatatttaggaaaacttatcagtacatacatatcatagaagccaattaaagggggtcagaagtagatgacatcaaacatttatctggagttctaagaaagaggatggcatactgagagctagaaatttgttctgtgctccgaggggtggggagaaaagttaactgaggtgaagggcagcattcttgggttgcatctccccagatcctgagtgaacaatgatgcactctcttgtctacacccagattcttttggaaaaagcctgccagattcattgctaattttggtttagtttcccaaaaaggataaagtgtccaagccagaactctcagtttctctcccctcctacctattcttttcttggttttctgcctttcagtgagtgcctccaaccatccatcaagagactcaagccatcaccaaggaggcatcactaagccctcttttccccttacttcccacacttgattcatcagcgcatcatgcaaactttacctccaaatacaccccgaacctactggcttccctccaccctcactgttaccaccctgctccaagctgccatgatctcccatctggactatcacaacagccttcttatttgttctaattcctctcttgctttgtcctccctttccccaagttattctccacacagtagccagagtcacctttttaaactacagcgacatcacatcggtctcctcgtcaaacctccaaagggctctcgtcatgctcaggataaaaggcaaacaccttgccatgctctacgaggtgttacacttttcttttcttttttttttttgagatggagtctcgctccattgcccagggtggagtgcaatagcatgaactcagctcactgcaacttccgcctcctgggttcaagcgattctcctgcctcagcctcccgagtagctgggactacaggcatgcgccaccatgccagctaatttttgtagttttagtagagagacagggtttcaccatgttggccaggctggtcttgaactcctgacctcatcatccacccaccttggctgcacaaagtgctgggatttcaggcgtgacccactgcgcccggcctcactggccttctttgtgtaccaggcccttttctctgtactagatgctacttctttctccaaatactatgtagtccctctcgatcacatcaccttgcttttatttttatcatatcacttacctccacctggagggtttttgcacattacacttgtttgttttctctgtctttcaccactgaggggtaaattcctcaaatacagggacttcctatgtcttgtttagtatctgtcactggagtctgaaatttcctggtacctagtaggtgctcaatgaatgtttattgaatgaatgaatgtgaaagactttttgaacatacccatctattaaaaatacaaaatgagttttattttctgtttgcttgtgtgtatgtgtgtgtgtgtgcatttgtgtgtgcttgagaatgttggtacctataacttaacctcttggccgactgatcatcacctctcattattatcatacatttatttaacaggaaacaaatactccaattcttcagttagccttaaaagaaacatttctagtgcagaaaaatttagctcaaatgttcttttcctgtgcaatgtgattagcccatcagttgataagtgtaaatagcagattgcttccagatttgatgggggttaagtagttaaaaagcaggaagacactgggaacttacaaagcctcagttttagagaagtcaagatgagaatagagcaggcctctctgtccctgcctttataactttgtttaaagcggttcccatcttgacctacaaatatccaaggacaaacaaaatctgtgcccctatgcatttctttacccgggtgtgcaatggcacagcggagttcagacaacacaactgagccatattatacaaccagcacatctccactgggctgtattatggagctgaagattaaaaccccatatgagaaaaacctggattcaagatataaactaagaaaagataaagctaataacgcctcttctattgtgcagtactttgacatttttcaactataaccatcatctaatatgagtttcataagcattctctaaactatatagattagtcactatgaacctaattttcactgaagcatatcaaagattcaaaccttggaagagaatataaatattatctggtctaacttagcatccaattcatgatttcttctggcaacttctacgacaagagtcattcaaccttagctcgaatgcttgttgcctcctttcccctaaaatacctccatctgcatcacacttgaaagaaaatttttgaataagtcatttatttaaaggaccatgccacttttaaaacatgttaataatcatacctaaaaaagacaaataacatgatgacaaactagttaagattcttggaaaagtagaaacttctttaagccttggtgtctcttctttcagagcgagtgcaataaaaattgttccaacctcctcagtgtatgaaatactgcacgtaaaaggggtcagcacagttcttgacacacagaatatgcaaagcacatattagtttcccttagtattagtattattagcagtataatttgacatcaataaaataatcccatagaagcaagggactggttcttctatgatttcagattatgtttgtcaggaatttttttttttttttttgagacagagtctcactctgtcacccaggctggagtgcagtggcaagatcttggctcactgcaacccccgcctcccggtttcaagcgattctcatgcctcagcctcccgagtagctgggattacaggcatgcatcaccatgcccagctaatttttatatttttagtagagaccaccatgttggtcaggttggtctcaaactcctgacctcaggtgatccacctgccttggcctcccaaagtgctgggattacaggtgtgagccactgcgcctggctgtttgtcagtatttgaggaagttgcttatgaaagtaaacaagttgaactatactgaatggaggaaaagcaaaaagctaataaattttagtaattttaggccaaatatcagatttaatttttaaaaaggtaagcattttggggggggaataaatatagggtaagtgtggaggcaagagtgtaaaactcagttcacttcaaagttcttctgatatatcaagccagaccaatacgttggagttgcatttcctttctttctttcttccttccttccttccttcctttttctttctttctttcttttttggagttccattttcttaatggcagttttctttttttcttttttctttttctcataaggggtaactgctaacatttgaaaatatgtggccaagcgtggtggctcatgcctgtgatctcagcactttgggaggcctaggcgggtggatcacctgaggtcaggagttctagaccagcctggccaatatggtgaaaccccatctctactaaaaaaatacaaaaattagctaggcatggtggcgggtgcctttaatcccagctacttgggaggctgaggcaggagaattgcttgaacccaggaggcagaggttgcagtgagctgagatcatgccgctgcactccagcctcgggcacaagagcgaaactctatctcaaaaaaataaaataaaaataaaaataaaaaaagaaagagaaagaaagaaaaagaaagaagaaagaaagaatgaacatatgtaaggacaaatatctttttttcttttttctttttttttgggacagggtcttgctctgttgcccaggctgcaatgcagtggtgtgatctcagctcactgtaacttcaatttcctaggctcaggtgattctcctgcctcagcctcctaagtagctgagactacaggtgtgtatcaccatggctggctgatttttgtattttttgtagggatgaggttttgctatgttgcccaggctggtcttcaactcctgacctcaagtgatcctcctgccttggcctcccaaggtgtcaggattacaggcatgagccactatgcccggcctgacacatatctttatgttgagttttctcttaatgaaatgtaatttgttttgaaaaaatccagttattgattgtgaggaggtatatgcaattattgtgagggaaatagcagagctgaggagaaatctagagttttttgtatttgagagaggatttgctatcttttaaattaatccagattgcttttaattttaatttaattgtctttctcaggaaagagaaaattcatttgaagaagatagctgatgtcctattaagggaagacagcctatcttttctttctttcttttttaaaaatacaatttgtgcatctggggaaaagcaaatgaacagggaaaaaaaacaagctcaaataatgactgctctctgtgaaatcagagtccatgctggtcccgtcagggttctggcagactgagcccatgttgttagctcagccagcccctcaaagcctgtgtgcacgtgcatgcctgagtgtgtttgtacacattttaaatcttagtttcgctttgatatgatttcaaacctacaaggattgcaagagtggtttaaagaactcccatagactctttacccaggttctcctattgttaacatttggccccattttctccccttccttgtctatatttaaactactggcaaacagaaattcagctatagtaggaatggcccaagaggctggcttctcaatagagtatcagggttagatgctccccttccctccccgacacctgcccagacacccacaactatgcaagataccatcagtacttgagatcaatactatcctctatccacttccctgagagttagctgttggctcttaagaccttcctgctatcatcaccccaacccctatccacatcctcatcatttcagaagaaacaggacagaaatctgggctcatgattttgaaaagtcgccaatccacaagggataaaagcaccaacttaataataggggaagcagtttttattctcattctacccatggctcacataaatagcatcagatattacataataataggacactgtatctacaaatctattcagggatagaaagagcagacagaagatgaaagatatagccaggaagcaaaaaagaacagtttcactcatagcggcttgtgatagccagattgtcaaaatatttttcaatccaaaggaacagatgggaataatagacagaaatgctgttccattttcagagcacaaaagaaatatttaaatttggatgaacacattttggattttctaaaacagctcaaggtatcagtaatgagatcatggactattgataggaaagacagcatcatgagtatgggctgatttgaacttaagaacaaaaagcttgcacagttcctattgatttcaacctaatttgtttctcatgaacaccacaaaactgacaatgccaaagattaaaataggtatgtaactgatatcttccaagggaaatattagggaaaatattagggttctcctacagcttaagctccagatgagcacatgaaattatgcatgtggattgcacatcagttacaaaattaaaaagcaacctccctgaaatctatagaatactatacctgctggctcaaacccagaggtagacatgaacatttctaagggatatttatacctgttgcatttacttgacacaatccatgctgtgactcctttccagcagcctagcatggctgataatatgtagccgcctctcagagatgttgggacaatggacatatactgccctttgcctcagagttcaagtagacatgcaaggtgcaatagaccatttaatacataaaaaactcaattaatcatttcactaataagaaataaaaactagttaacatgcacaaagccggtcctggtgcgatataatatcctgctgtgtcttatgaattgacaaagtttgcatcctatgcaatagagatcacatggggttttggagaaaatgctaggttttcagtcatcattagggatttgactcttaaccatatcaaaaccaacaaaacccaactcttcagagtcttgctttctcttatttgttaattaaggaaaatagttacccaccccacgaagtcattgtaaagaataagtggtatgataaatctaaaaggcttttgccaccagaaactgctacacaggcaatcaatgttattgtcatcgatagtaatccacatgcattattgttctcttacattttgtagaaagaaatccaggtggcatgcatttaacatgtgttttagagtaatgtatcctgaagagagaagtagctcgaacagtaaaagggacaatgctggaaattgacaagcttctcgataactgacaaagtcctgttgcctcatctctggccactgctgccttggttggttcaaatattggagccccgtggaaaagaaaaatctgtgtgcttttgaaactaagtcagtatgtatttaatgtcatccaaaaggatgtagataggatgagggaaatcaagaattattaatttattcatgaattcaaaatctatccattgagtgtctgctgtgttcctggtacttgactgaggcctaaatacagagtcagggacaagtgaagcctagtctctgtcttcttatggggaacagttactacctcatatttaccatgtcattcccagtataaaaatcattcataaaaagtactttcatgttcatctcaaaagtttttttccttaatattatgaaagagatgatttgctctgcttaaatattgtggaagttaacctaaaatataagtgagtggtgagagacattctttagtttaggagggagatttggcaaagaactcatgcgccacagctgtgaggagtatacaggattatccccttattcccctcttgatctagggctttgttctcttcctcctgcttacaggttactgtaaggtggttccagcagcatctgcataggtcaccctcttcactgggaagggtttcattcatgctagggcttaacctagttttattttttccaccaccctttccaaattctattttcccagattctactgtggtgagtaccctccataacagtccctattgacctccttctgctggtattctcactctgtgtggtcccctcccacactgcaccagggttggtttgtgtaaccaataaactatgacagaagagatgacataccacttatgagattaggatatacaaacatgaggttttgacatggggctatctttctattttgggatgacatggcggaaactgtcttggacatccttatggagaggtgcatgtggccaggaactgaagctgcctgcaaaccaccatgtgaatgaagtgaaccatcagccccttcagatgaccatagccttggccaacagcttgactgatgcctcatgaaagaacctgagcctgcatcaccaggaaaaccactcctggattcctgactctcagtagctgtgtaaaatagtgaatatttgttgttttattccgctaaattttgggataatttgttatacggcaatagataactaatatacttaaccttcaaacttcaactccaactcttctgatccccaaaagtatttttcctgattataccagttcatagctatctgctaacctttttacccacctcctcatctccttttaaaagcatgattgctaaaataacttcagctaccaattactgaacaagggttgtgtgccaggtactgtcctaagcaatgtacaaatattatttccatgtgttctcaagggtcgtgtagggtaagtatttatttttcccatttcaaatgagaagtttgagacttggaggcatttagtaaaatctcactcaagaaggaagttggtgtttgagccaaatctttttagctgcagttgcatcccttgaacactacatcacataaaactgtcatagctgtgtgagttatcttgaagtctttgtatctgaggcagggaaaatataaatggagagagcctaagcacagtggcaggagtgggaagagaagtgagaatttttatgtaatccatcattcgggcatttagctcttgacacaatgttgccctccccaacttctgtctcactggatatctttagattaaagaaataacataaattttgcatgagacttttcgaaatcatggaagagtatgccaaaaatccataacattaccattctttatagtcaggtttttattatagaaatcaataagaagcctagtacacgccaatttcacctttgaatatgcatgtcaaaattctaaatcaacatacaaacaaaatccaatatcacattaagaaaataacacgacatgaccaagtagggtttatttattctgggatttcaaggatcactcaacattagaacatctattcatagaattcacatattactaacagatataaggacaaaaatgtataaaaagctttagaaaatagttttatcaatcatttctacttgtaaaaacaaatacactaaaataggggttcttattcaggggttctgcaagatcaaaattatttccataaagatcggaagccatcactgccttgttctcagaaatatacagtagattttcccagatattgtgatgacatgtatatagcaaaggaattgaatggagaaagagataggtgaatggagctgccttctagtaagcttatgattaaagtgatttgcaaaagtataaaacagttccactcttcctgctaattttcctttggaaaatgtgccaatttttcattaaaattacactgattattttattaagtgattggtgtcctattgttatcttacatgaaaaaataaatatttaaacagtccttggttttactgttgagtctgataaatgctaatagataaaacttgtataagcaaagacacttcaggacacacaataatttttaggagtgaaaaggaataataagaccaaaaaataataagaccattttcaaattttcagaatttgaaaatgatagctgtgtaagatacaaatgtaaggtccagtttcttaattctatacatagttcctttataaaagatacagcagaaaaggaaatctcatttataacgagaggtttttttttttaagaaagaaacctaacaagaaatgcatgagacatgcacaagaaaaatctaagatgctcctgaataacacagaagttggtaagaacaaatgcttaggatgactcagcttcagaaaaaaactcaattctcccaagttttctataaatgtataacatttgaatgccaaaaagggttcttttctggtgctagacaattgattccaaagatcacatagcaaaataactaggaaaaacctaaaatgaagagcaacaagtaaaaggtgtattgggattgagagggtctagacttatgagacataaaacactaaaatccaaacagtgatgggcagaatgtgatatctccaacccagatgatgccttttaaccattttgttgcctgtgtaaggaactcatcatccatttcctagtacaggcctcgctagcatatttcaatgataattccctaagtcttccctcctttctttcatcctaattttttccagaataattctatcatgtggtgtgagatttccagagaggtgtatctcttaaacagatctattctactttgcctttaattacatgtttcattcaacaagttacccccttcgtttttcttggtttattgtaagttctaccttactcatcctaatggctttcctctgtgatctgttatgttaacctcagggcctggctttgagcagcatcctgagttagtggaaggaatcctgagctgcaattcagaacacctggattcattcctggctcctctcaaagaaaaagaagtcctgggggaaataaaacaaaactcagtctctctacacttcagtttccttatttatgaaatgaggacaaaattaatgccaactgatatggtttagatatttgtctcctccaaatctcatgttgaaagggaatccccagtgttggaggtggggtctggtgggaggtgtttggatcatgggggtggatccctcatgaatggcttagcaccctccccttggtgatgagtaagttcccgagagatctggttgtttaaaagtgtgtggtgcctcccctcctctctcttgctcctgctctcactgtgtgatgtgcctgctcaccccttcgccttccactctgattgtaagctacctgaggcctcaccagacgcagatactggagccatgctgccacagcctgtagaacgatgagccaattaaacctcttttctttataaagtatccagtttcatgtattcctttatagcaatgcaagaatggtcgaacacaccaacctaacagagtaatgtgaaattaagaagaaagtttatatatgatcacattccgcacccgtactggatttaccaagaggcaggaaggtgttgtgataaagagtatgggtcctgggaccagaacacctgccttcagtaacagcttcctcatttagtacttgtggaactttgcacaacttaaatgtcccatgtctgagattccttatctgtaaagagaaaagataacagtaaaggcatatctcattttattgtgctctgatttattgttcttcacaaatattgtgggtttttgtttttgttttgttctttttgcagattgaaggtttgtgacaaccctgtgtccagcaagtttactggtgccatttttccaatagcatgtgcttgcttgctttgtatccttgagtcagattttggcaattctagtaatatttcagaccttttcattattatcgtatctgccatggtgacctgtgatcagtgatgcttgatgttattgtcgtgatcgttttgggatgccacaggccatttcccatttaagatggcaaacctaattgataaatattgtgtgtgatctgactgctgcatcttccactcttcaggcttccctattttctgagctacaacaatatcaacatcaggccaataataaccctacaatgacttctaagtgttcaagtgaaaggaagagtcccaagtctctcaatttaagcaaaaaactagaaaatattaagcttagtgagggaaagcatgttggaagctgagataggatgagagctaagacttttgagccaaacagccaagttgtgaatgcaaagaaaaagttcttcaaaagcacttgaaaagtgctactctagtgaacacacaaatgataagaaagcaaaacagccttactgttgataggaagaggtttgagtggtctacatagaagaccaaagcagccaaaacattcccttaaaccaaaccctaatctacagcaaggccctaagtcatcaattctatgaagactgaaagaaataaggaagctgaagaaaaaaagttggaaactagcagaggttggttcatgaagtttaagaaaaggagccatctccataacataaaagtgcaagatggaagcagcaagtgttgatggagaagctgcagcaagttatccagatctagctaagatagttgattttcgatgtagacaaaagagctttctacaggaagaagatgccatctaagactttcatagctagacaggagaagtcagtgccaggcttcaaagcttggaaggacaggctgactctcttgttatcaggtaatgatgctggtgattgtaagttgaggctaatgttcattgatcattccgaaaattctagggcccataagaattatgctaaatctactgtgcctgtgttctacaaatgaaacaacaaatcctggatgacagcagatctgtttacatcgtcatttactgaatatttaaagcccagtgttgagacctactgctcagagaaaaggattcctttcaaaatatacccactcactgacaatgcacctggtcacccaagagctctgatggagatgtacaaggagataatgttgttttcatacctgctaacacaacatttaatctgtagtcaatggatgaaagagtaattttgactttcaagtcttattacttaagaaatgcatttgtaaggctacagctattgtagatgatcagattcctctgatggaatggggcaaagtaaattgacaactttctgcaaaggggtcatcattctagataccattaggaacatttatgattcatgggaggagtcaaaatcttaacattaacaggagtttggaagaagttgatcccagcccttagggatgattaagggattcaagagtttggaagaagtaatcgcagatgtggtggaaatagcgagagaactagaattagaagtggagcctacagatttgactgaattgttgaacctcatgataaaactcgaacaaagggggagttgcttcttatggagcaaataaagttgtttcttaagatgaaatctacttccggtgaagatggtgtgaacattgttgaaataacaacaaagaatttagaatattatataaacttagttgataaaacgaggacagggtttgaaaggatgtattccaattttcaaagaagttctactgcgggtaaaatgctatcaagcagcatcacatgttacagagaaatcttttgcaaaaaaaagagtcaattgatgtggcaaactttattgttgttttattttaagaagttgctacagcttctccaacctttagcaaccaccgcccagatcagtcagcagctatcagcactgaggcaagatctcccacaaacaaaaaggttacaacttttgctaaaggctcagatgattgttatcatttttcagtaataaagtatgtttaaattaaggtatgtgcattgttttttagacataatgctattgcacacttaatagactacagtatagtgtaaacataacttttatatgcactaggaaaccaaaaaatgtgtgtgatttactttattgtgatatttgctttatttctgtcatctggaatttaaccccaaatatctccaaggtatgcctctactacctgtagttgttgtgattattatatggtaatttatataaagtaccaggaataaaacctggtacctggtgaatgttctctaggcactaataaactaactgttattatctactgcccatctttttccccaacttgatgaagacagaggtattgattctccaatgttgcctctgctctgtggaaaagaacttcagggacccaagaatatagaacctcaccctttcctctcacaatcaaaggtaagtaagagccaaacaagacaaaaaggaaattatcaacataaacattactttcccctggctctaaggcacacaagcagcaactcaagctaagggattcctgggggttttgtgttgctctaagtggcacttttctgaacagtgaaacttgatgaaggaaaagaccaattttaagtcatctggatcacaaccaacattgtctgtgattacccttgtcagtgtgtgttaagaactggtggtgaaatatcaagtattaatgaaggttgctaagtaaccacacaattacataaatcttttcaagtgcatttttgagtatttttaaataatgaggtaaaatgtaggacatcatatgaataactaaggtaatgcaaccacatgcatgtttaaagagatttctaggcctgattttcttagaaaaaaataagtatagtatttcccagggaaaatattgtctgtcttggagaatgtatcagttgcaatcacttctcttaaagtagtaaataaagaatagttttatcagaaacgactacaggggaatacagacatttttagaggaattgcttcttcaagataaccaagcatgttagcaacatgaaataattatagcaaaaattatattatttacattatgataacactctctcaacgacagcgtaagatacaacttcttggtccagattaatacgaaagctacattcccaacatttgagataatgaagccaatgatgggaatcatttgaaaatttaacaacactcctcacagtaacaatagtcagaagaacagacaatatcacttgcaaaaattggttcaatctgtgaactgataaaaggcagcagtcattcattacatgtactaccagatttcaaagcatgttctggccgggcgcagtgactcacgcctgaaaccccagcactttgggaggccgaggcgggctgatcacgagggcaggaggagaccatacgggctaacacggtgaaaccccgtctctactaaaaatacaaaaaattagccgggcgtggtgcgggcacctgtagtcccagctactcaggaggctgaggcaggagaatggcgtgaacccgggaggcggagcttgcagtgagccgagatcaggccactgcactccagcctgggcgacagagcaagactccgtctcaaaaaaaaaaaaaaaaaaaaaaaaaaaagcatgttcttcattttagaaatggcaaatatatgaaaatccatgctgattacgaaacatacaaaaaacattcaggaatgttctcttgggaacacttctggaaccccctttctggagctatttaagagaaatgtcacatatacatttttgaggctgaacaaagataataattgatagagacaatttagatgattgctttcactgtgtgacaatcacaccctggtcttaaataccacatcactggctaaaagagaatcaggcattaattgcacgtgcaagatcacggactttgatcatgggaaaagacggtctaccaaggagcaagcttcactcttgataatacaactggaatttaaatctcaaactttttttctcccctcttggtcatctattcccagtttgcttaatgtcatacaaatctgtaatgtatccaatttaaaaatttgaattcagaaaaaagcgttatgcaccatctctttttattaaattggctggaatatgatgctctcaaatttcaatccgagttcctttactcaataacactccaatttcaccctctcctaatgcaaagcactgaatagtaggggagaagatccaagtaatgactcaggaaaggagacgctacgcctcgtctggacttttcagacggcagagatctccctgccatgtgatgccatccactggacaattagaaggatgaaaacagttttcattcagacaaaatctgcctccttttatccaaagcaaagcaggctaatcttactcctttttccaatgacagctgcttaaatacttgaagacagatgagtaacagcatctaacttctctgccttaagcttaatttttcatgtcctctcacttactttagtacttcacatcccctccccggcctacacgggttgttctgttcactctgctcaaaagatgggcagagtttctacatgttgtcccctaagtatgcagtgcttgggatgggataccatacactctgtgtgttctgactatttccaggcatggcagaagcatgcctaccttcatctcggacgttacaggccaaacaggaggatttaaggatactttatccacaatttttcagagtataaatgtgacatctctttatagaaaattaaaattgcctatgatatcaaatatcccagaatagttacaatcaatattcagtatattgtctcttaactgtttctctaggtatctatttttataaacaaaattgggatcatattacatataacctttttttggatggtagaatcattgcaaacaatataatatttatttattcactcgtttatttaacaagcgcgtccatagattacacatgctgttgcattccagcctgggcgacagagtgagaccatgtctcaaaaaaaaaaaaaaaaaaaggagaaacaaagaagaaaaggaagaaattatctaaatttcttatccaatttcttatatttagataatttcttatatttagataatgtcttccttttcttctttgtttcttcctttttttttgagacatggtctcactgtgtcgcccaggctggaatgcaacggcatggtcacggctcactgtggccttgacctcccgggctcgagtgattttatttcacatttcagcatagtttttctccacatctttccaagtctttaaaattctcattttgagttatacaatatactgtcttgtggatatatcttatttaaccaccccggtaagttgaatagctatgcgatttcaaatgttagctaccctatgtttaaccactctaattttattgtatagctctggacaagttaatctacttgtgaaaaagattttatctttttaattcatattgtcaaattaatttttatacagataataccaatgcacacacccaccatagcatttagaaacacttgtctttctattgctcttgccaggattgcatacaattaatttgaaattttaaaataaaatatattgaaaaaaattgtcatctctttgtcttaatttatgactagaaaggttaaactcttttcccaatttttaatagccatttatatattttcttttatacatggtcagtttaagccctttatctagtttatgtgaaatcatgatatttctgaattgtttaattattttatacattcagaatatcaaaatttatttatcttgctccaagtattttcagattatctctatgcctttcaattatatttttaaacacaaaatcaagtttttaataaaatgtattagcccgcttattttgtgatttattctgctgtctttatgcgtgaaaagttctctagatcctaacattagctcaacgtaaacctctgtttcaaaacagctatattcatagctctactatagatctcattatagtatttgcataataattattcatttacacccccgttctacttattctggactctgagtatctcagtcactggggcagtatttttcatcctcttctctttagcctttagtgtgggaaactataaatgttggttgaaagacatactaaatgaatgaatcaactgtgtaatgcacagatttttttcagtgaaaatcaaagaaatgtaccactttacttctcttattcctttttttcttgccaaactattgtatgaatagtatagttagaaaaatgtattccacaggaataacgatattttatcatatacttgtttgtttaaagtacacaattaatatacaatcatgcctcagaacaacatgtggggtgtccatacaaccgtggtgcaactaatccttcaaaagataattttgaatttttagcattctctgaagaaatattttgcatgtatcaattctcatccaggagaaatcaatggcaggatttctcacaataatcataaggagaaaaatatttctcttatgattagtgtgatttttcagagaaaaaatatctgagtcatttttgtgggactctgcttctttttaaatcacattgatcatgtcaagaatgaatctaccaaataagacaaacaaagccaagcacactgagtaaagtagagaaccaatacatgggctttgtattttacttcaaggtcttgtctatatggcatacaaagacacacagtggaacaaccatcagcttttctatataggtggacctgatgttaggcaagtaaaattcactttatctgctgatatcaccacatgacgctgttttgttcttgtggtcggatattttgttgagttcattatactctcctatgatgtgccctctgtttcactttgtaaaaaagttatatctctatttttttttgttatgtcatggactttatttttgagtagtttaggtttacagaaaattgagtacagagaacagagaattcccgtatgtcccctcatcccaccccaaagtcccctgtattattaacatcttatattgatgtggtacattgtttcagttgttgagccaatattgatacattaatagtaattaaagtccagagcttgcattggggttcactcttggtgctacatacactgtataggctgtgataaatgtataacaatatgtatccaccattaaggtatcttacaaaatattttcactgtcctaaaaatctgtgctcttcctcttcatcatccctgctttcccttcaacccttcatctttttcctgtctctgtggttttgccttttccacaatgtcatagagttggaatcatatgataactggccttctaagactggtttctttcatttgtacgatgcatttaaagtccttccatgtctttttgtggcttgatagctcatcccattctatcattgaaaaacattctgatatggtttggctgtgtccctgcccaaatctcatctgaattgtagttcccgtaatccccatgtgttgtgggagggacctggtgggaggtaattgaatcatgggggtggttacccccacgttgttctcatgatagtgagtgagttctcaggagatctgacggttttataaggggcttctcccgctttgttctgcccttctccgtgctaccaccatgtgaacaaggacatgtttgcttccccttctgccatgattgtaagtttcctgagacctccccaaccatgctgaactgagtcaattaaacctgtttcttttataaattacccagtcttgggtatgtctttattagcagcatgagaatgaactaatacaccttccattgtatgaatataccatagttattttttgaaggacatcttgattgtttccatggtttggcaattatgaataaagttgccataaacatttgtaggtttttgtgtgaacagaactttcctattcatttgggtaaatacgaaggagtgggaatgctatattgtatagtaacaattcatttagttttataggaaactcccaaattgtctttcaaagtagctgtaccattttgcatttccaccagcagagaatgagagttcctgatgttccacatcctcaccagcattggatgttgctagtgttttggattttagtcatgctaataggtgtgcagtggtatgcaattgttgttttaatttagccctaatgacgtgatgttgagcatctttttgccctctgtgtatgttttttggtgcagtgtctgttcagatcctttgtccatttttaattggctgttttattactattgttgagttttaagagttatttgtatattttgaataccagtccaaaatatcagttgttttgctaatattgtcccagtctgtggcttgaattctcataacatcttttatagagtaaaagattttaattttaatgaagtctaattcattagtctttataatatggatatatgatttttttctttttagcctgtagaagtaatcaattatatcaattgattttcaaatgttgaaccagtcttgaatacctggaataattcccacttcactgtggtgtaaaattcttcttgtacaacgctggacatgatatcctaatattttgttgaggatttttgcatctttgttcatgagagacattggtgtgtagttttccttccttgcaatgactttgtttgctttgggtattggggtaatgctagcctcatagaatgagttaggaggtagccactctgctattttctggaaaagattgtaaagaattgatataatttgtccctctttgctagaattcatcagtgaacccatctgggctggtgcttcctgtcttagaaggttattaattattgattcaatttcttcatttaatttactgttttttaaatttttgagacagggtcttgctgtgttgcccagactggtcttgaacaactgggctcaactgatcctcctgtctcggcctcccaaagtgctgggattacaggcatgagccatcactcctggcctaatttctttaattgaataggttaatctttaataatagatgttaagatgtaggccttctcattaatatatataggcccatatatattatctattttcttggtaagttttagtacattgtgtttttctttctttctttcctgttttttttttttttttttcttttggtccatttcatctaggccttcaaatttctgggcatagagttgtttagaatatttcattattatgcttttagtgtcacagaatcagtagatatagacccttttatatttctgatattagtaatttgtgtcttctccctttattccttagttaacctggctagaggattattgactttactggttttttccaaaaaaagttttgattttattgattttctctatattctcttgccattctcattgatacctgctttaatttttatcatttcttctcttctacttactttggatttaacttgttctcctattcctagtttccaaatgtggaagtttagattactaattttagatctttctttcttctagtacatgtactcaatgctataaatttctctctaagcactgctttcactggatcctaaaaattttgataaagcatatttttattttaagctagtttgaaatatttttatatttctcttgagactgcttctatgacccatgtgttatttagaagtgtgttgtttaatctactagtattttgagatattctagctgttctgatttctagttttatatcattttggtctgagaacatactttgtgtgatttctattctaaatttgttaaggtgtgttttttgacacagagtgcaatctcttctagtgagtgctccatggaagcttgagaagaacgtgtattctgctgctgttgtattaagtattctatagatgtcagttagatccagttgattgacggtgaacttcagttaaaccttgttcttagttccttactgattttctgcctgcttgaactgtaaattactgatagaggggtattacagtctcaaaataaaatagcgtatttatccatttctccttgtacttctttcagtgtttgcctcatactttgatgttctgttgttaaatgcatagacatcaaatattattatgtctttatgaagaattgatctttttatcattatgtaatattcctctttatctctgataattttccttgctctgatgttggctttgtctgaaattaatctagctactccagctttcttttgatcactgttaacatttaacttcatattttaatggatttgtacacacacaggcacacacacgcttgcttcgccaggctattctatacaaatttatttgaagaaaaatagatacgtagggacatttatgggactacaggcaagatagaagaaagacaagagaccttccaaatgaataacaaatcctctttcactctctatgccttcctctaacaaactgaccttgtatcagggtttaactattacctttagcttaatgagtttcagaatcaattctatatcccaaaacatccctcaaattttggtctcatgtctacaactattgacaagatctcgctccatctgaatgtcatgtcatcacactcagcatgccctaaaacaaactcactgttccaaatctgctacgaacccttagcaaaatcctttgtaaatttcatatgtccaccattttctcaactactcagactcaatattttgcattaagttgtatgctacaaaatgttaggtttaggatagggaattgaagacagactttctgctcttcaagagatcatggtctgacagatgttaaaacaagtgatctggtcagggtcaacgaaaatgctacaaaatgctgattatatattggttttaaaaagcataaataaatcaactattctcactactttgtgattaggatttgcttaaattgaagtcaggaagaattcaatgattattgtttctatattgaacattctgatgaagtacatttccatttctctgcttaagcatttttatccgtgacgtctttgttgaatgcttggcatgcattcaaccctaaactaatagactggggaagcaaagaaggtgatctaattcttattgcttcagtgctggaaagaactctaaaattatgaatctcattttctatccagtgattgccttttctccattctgtttctggctcatgacttctaatctacttgaatttatcatttgcatcattagaagttggcaatgacctttagatagctttgagtattaggaagcttttatattgatattttattttccagtcattttcatagtagtcatacagaacccaatgtgtggtaaaccaataaactttattccaactctgtttaataacatttcaaaataggaagacactttccatgggaattctcattcctagggtcactaatcttattaataatttcacaatttttttttgttcttgcttttttttagtttgcctccttaccgtccatccattcacctcttaactccagctcatccacattctttttaaagtatggtgcagaggattgggcacaaaatgctaaaattgagtttcttcagcactttgacaagtagaagtttcactgcaatttagctagatgttaaaatcctgttaatacaagctactaacgcattattctttgtgtgtgtatatgtgtggggcttcattaaattattgaaacattaaatacacaagtcaacccaaatactatattatctttgtcatcctacaatttggtgtatttctcccactatattcttcagtagttagtttctggcaattctgtctggagtccttagtaagttaagagtcctttttagtgttatgaccttaatttttttttctggagtaaatgttgacatacttaggaggctaactttattttatagagatattaagtactagaatgattattctgtgtcaatccgacctaaaagtgacctcatggttttttgaaaggtaaaaaatcatattatgtatattttctacactctaggtaaaatgcacataatatatcatattttacattaaattgactttaagtatattttaaagattctgaactgttatttcaaatttccctttcctcactacatttctggctaatggcttccaatccattcttgaggttggaataataaatgctcgtgtcaaatcggatcaaataaaagtattcaaaaggcaaggtagcatatcacctttacttgaattaaaagctttagaaggatcaggtgttacctggtttttttttattgaaaggtgtaatagcagaactgtgaaagggaaaacaaaatgaaaaacattcaacaaaaatgctgttaggataactccatttctggcttttgaaaataaagatactttatatatttatgaaggcaaatcgattcaggaaaatataatgacataacttaaaagtctttcagttagatcgtgtcacagatctgtgatatttaagctttttattctaatgggaatatcaatctcaagacttttaaaattgatagtgattgcttcatagtttttcaattaaccttctgaaaaaccataacaaaaataagaccctactttcttatctctttttttttacgaataatttctgtaaactaaatatgtgtgtgtgtgtgtgtgtgtgtgtgtgtgtttgtgtgtgtattttagagacagggtttcactctgctacctaggctggagtgcagtggcatgatatagctcactgcaacctcgaactcctggccgcaaggaatcctcttagcctcagcctcctgagtagctaggattataggcatgcaccatcatacctggctaatgttttgtagagatggaatctcactatgtcgcccaggcttaaatatagtttatatattttaaaaattttaggccgggcacggtggctcatgcctataatcccagcactttgggaggctgaggcgggaggatcacttgaggcctggagtttgagaccagcctggccaacatggtgaaaccccgtctctactaaaaatacaaaaaattagctgggcgtggtggcatgcgcctgtaattccagccattcaggaggctgaggcaggagaattgcttgaaccggggaggtggaggttgcagtgaggtaagatcgcaccactgcactccagcctgggcgacaacgtgagattctgttttaaaaaacataaataaataaaaataaaaatgtagatcctttttgaaataataacgtatgtaggttgttacacaatattatcatatctaaatattgaagataggacttatcaggcagccctgttggcaatagccctctagggtgtatattgtataaacatccctggcaggggtattctacacatgttagttggattcccctaggtcaggggtgtgtggtctataatatatgaaaaatgccctgaactctggacttttaaaaacagcaaaaggatatgtgaaaaccgttttaaaataccattttaaaatacaacaagacacctataaatacagctattttttcaaaagcaaaaggacatatgaaaaccatgagtaaaatataataagacacctataaatacagctatatcctctgcggactattgcattctatttattctttctttttgcaggatagatacataaagtcaggatctcattcttgctggagctacttacctgcctggacccacaccaccccctagttccaggcctggctctcccaccgctagctctgaacctgagtacgtcctataaacaacatgagcatctgtatctcccttcagaaaacaaatggtgcagtcatactcatcctgctgtgttaatgactatgttcataaaatgcgacactggactacgagttttaggaatcaaggagtgtgttttagtccactctttatgactggccttagtataatatctggcacatactgatatagaataaaaggtatcattacatgatacctttctatattatatccacatgtatcccatgatccatgttccatattatggaagggtggcaacgccctgtttcacgagtttcagattcaacttttgaaggaaacatgttttagtcattgcattggcagatggctccaggacttacatatttaaataacaaaaatgttggggataaaagtattccccaaacagttcaaaaagtttcataggtgggtaaaggaaccatccctttgaagaggaaagtcaacagtctgacttatttcaggtaaacaggttgataaagacaaagaaaggctgctttgttctaagtcttgcgttcctgcacctagaggacagatcccacattccagaataaaggcttaaataaaaatgcaagcatacaggaaataaaagagttcaaaaataaagggtactaagagagaggggtcatagattagcattaacaccatggtgaccacatcagccttaagtcaaggtcagactatttcatgcaagttatccctaaatggaagagtggaatgataaggctggaggaaaaaagagatggctatgggagtggtcttcagagttattctggttgggacctcagaactgaagacaaaggttgtgatgctccttgattgtcctctgtgagattcatagatgtcattaaaaccatgaagtacaggagctgcatttgcattatctgtttccatattccattttttttttgctttttcctttttttttgctactctctgtttcttttcacgaagaaagctgaaaatttattgtctttcacctgtcaagtgagatgctaaagtgatctgctagctgcttttacccatataatctcatttaatgttcaactaacactgcaaggtaggtagatatatttccattttataagtaagactgctgaatcttagaaagggcaaatcactgtgcaaggtgggcctcgtaaataatggactcatgtctatctgattccaaagcccacctgcttcccactctgccccaggtctccctattcccttttttactggttgttggctgacataataaaaactggaagtgtacacaataggacagtctcttagatatggacatcttctggtgaggggcggtatgcaatatcaggccccaggccataccagattaagcctctggacagtttgagatactctctggtattttcctacacgtggtctgggattctacgttgctcaggaggcaataatttggtgttaacatggaagacctagcttcctagcttcacagatcctgtctagaagacacttaaattttacagtgaatactacaaggtacaaagagtctttcattacagccacagtcaggacagactatgaagaagaaactgagctatagaaatacctattcactttaactctgggatataggatttagggtctaaatatattaggattgattatgacaactgcagaattcatttctagggacaaatgtaaaagtgtagacattcttagaaattatcacaatattgctgttttcccctatgccactttttcttgagggggcctagttaccttagaaagttcttgtcattgcttagctaacactacagccagcaaatagagatagagcttatgtgtttggctgagaaaataacataggagctctcttaggagaacctttctgttaatgtccctgtcatcatcatctttgtctattaactcacagtaaggacccaaaagactaaaaacaagataaacaccagtacctgtatggcagacacagcctttggacaagtgtcagcatttcgcaagtgcctgagatcacttcaaaatgtttaaatttttaaaatgccaagagggattacctctaaagtaatacaggaagttataatgttaagaaaaagaaatggttgaaggtaggattggttttaggcgaacgccattctcagaggctcatgacaacccgaagctctattttcctctagaaaataagggatgatggccgggcgcggttgctcacgcctgtaatcccagcactttgggaggctgaggcgcgtggatcacgaggtcaggagatcgagatcatccttgctaacacggtgaaaccccgtctctactaaaaatacaaaaaattagccaggcatggcggtgggcacctgtagtcccagctactcaggaggctgaggcaggagaatggcctgaacccgggaggcggagcttgcagtgagctgagattgagccactgcactccagcctgggcaacagagcgagactccgtctcaaaaaaaaaaaaaaaaagttcaacaagggagatggagccagtggcttctgggtggtttctgcctccagatcctccttgggatgactttctagttggaagcctagtgaaggatgtggtggaggcctcttggataacactcatatgtgctccttgctggtgggagacacgaaagactagcgcccgacttgcactggatagagggaaagacaactttgatcagattctgcctccaacagaggcacacaaagggctaaggcaatggagcaggggagtgtttgaggtgggatcatgtgtcatctctgtgagcatgagagtctcagagcatgaaatagacgtgggcagtgcaggggagctggcatggtgtgagtccttttgggttgccaggaggatccaggtcatggaagctaaacgaggctagagatgagccaccagatgtccaggggacaaagtggataagcacaggaacataacacattgactggtttctagaggttgcttaaaacaaacaaaaaaaataaaaatcctacttaatgtccttgcaatagctatgcacctgacctcataatcctttttcttcatgaacaataaaactcacactgaattttcagtagcaaagccagttaattctcagttgattctctttgaatctttccagaattcaaaagagagaacaaattcaatatagcatttaacaattacattgctatctgaagctgaaatatgtacatatataaacaaacctttggagactttctattttggtctgactctgaaggtagttgggagaaaattgtaaggtattcttatcaatcttgatttgtctttcatgctatgaacctattatttattctaataatacttatataaatattattctctactgccttgtctgtatttaaataaatctacagaagaaaatgatacagcatcaaaatagaaggaaatatacgaggttgtcttatagttgctggtaaccactgtttaatttcatccataaagttttctggtattaattaaggatattcattaatattactctgaggcacgtagtttaacattaataaggaagaaagccagctaagttattagagatccaatgttatgtcattaaaagtgtgagctgatttgaatttgagccacaggaaatgaaagtctgtgaaagtcaacaaccaaagcaggctactaataggttttaagaaagaaaatcaggctgggcacggtggctcatgcctgcaatcccagaactttgggaggctgaggcagacagactgcttgagctccggagttcaagaccagcctgggcaccatggcaaaactccatctctatcaaaaatacaaaaaattagccaggcttggtggcacatgcctgttgtcccagatacttgggaggctgaggtgggaggacggcttgaactgggaggcagaggttacagtgagccaagatcatgccactgtactccagcctgggccacagagccagatcccataaaaaaagagagagagagaaagaaagaaaagaaaagaagagaaaagaaagaaagaaagaaagaaaagaagagaaaagaaagaaagaaaaagaaagaaaagaaaaagaaagaaaagaaaaggaaagaaagaaagaaagaaagaaagaaagaaagaaagaaaggacggagggagggaaggacgaaggaaggaaggaaggaacgaaggaacgaagggagggaaggaaaatcagggcaggaataacacttgtactatgaagccagaaaaatgtaaacaataaaacatgaaaaactgttttgttgcagtagtttttctttcaaatgtatacagaagcatcagataccttcaaatagcaagagagtaagcaagcgatatcatggtgggaaaatgcatggttttataaattaaatacgatgctattgaggtctagtcatcctacacaaaagtggtgatcttttcttaatgaattcaccaagataccatggagcgtgcatggggtcactacagtctttcacttactttggcagggcacccctcacttcccacagacggagaagatggattcaagacgagagtgcgacgcttgcttaccacgggcctgtgcacgtcccagaacgctctctcttggctgtcaaggatcttcctttcaatcttgtctctcttcttgtccactctgtcaacacagtaacaatagataacatttagtattaattgtagtgcctctctgaacaaaaaggccacaactggaacaaatcttccaaacgactcacaaggactcactttgcttgtgcttctgcttgcatgaaaatgaactcccacttccgggcaaatgctctctgcagcctggccaggctctcctgaaaaacataccccaggtgaagacatttggtgttcattgtcactgctctcttctagcttagttaccacttgtatttgtcaaggaaacaaatagagagtttctaaagccctaagtgtactgtggttctcaatgataagtcatgctccctgaattcagctcatcttcatattggcagtcttaaaggaagcagaaaaacctgttacaaatatcgattttttgaattactgactttggagaacaggactacaaacccaatatgtatctgaaaaatactaaaattacctagtacataaggaggtgctcagatgaacccactggatttttcggtacccactttatagaggaacagaacatcagtacattcctactacgcatgcaatcagcctattcagttcctgacaatacatggcacaccctggcggcccacaacctattcctacacagtgctttgaattcagaaaatctaacatagcaaccatctgcacaaatgacagcagatgacttttatctgctgaagatcactgtcagcagagacaattttggcaaaacccactctttcccagggtaaatggtctttaatcctcagagtttggatatcttcactatgtaggatgtatctgacatttcgacagttaagtcgattttagaaaataagatatgcttcccttttatactttgagtttatgtatttagagttttgccatatgcaatgtgaatgaagagaggaagtaagcaaacagggattcatgcacccactgtgatgccagatccctagaaatctgacccttcagatccatgaatgaggctgggcgtggtggctcgtgcctgtaatcccaacactttaggaggctgaggcgggtagatcacctgaggtcaggagttcaagaccagcctggccaacatgacgaaacccagtctctactaaaaatacaaaaattatctgggcgtggtggtgcacgcctataatcccagctactccagaggctgaagcaggagaatcacttgaacctgggaggcagaggttgcagtgagccaagatcgtgccactgcactctagcctgggtgacaagagtgaaactccatctcaaaaaaaagaaaaagatccatgaatgaagagttaacatcctgcccagaaaaggctgtgggccttactgctgtgcattctatgactatctttgccagaaggtccttggtacttacagcctcatagtctgcgagctccagtcgtgccttgttttgcattgttctcttgcagaggtaaacggctgaaaaaaaaatcaatcatttcttgcctgcttatcaacaccatggcactataagtaaaagtacaacattacaaatcaagggcattgcacttttttcccaagttgtaatttttgatcattttcttagacaaaaaataattatgtaataacattattactgaaattcaagcatcatagtatttatgataccctaataaaataaatatgctaagaaacttggtaacttttttttttcagagatggtcttactctgtcaccctggctgaagcaagtgtagtggtaagatccttgttcactgcagccacacactcctaggctcaattgatcctttcgcctcagcctcccgagtagctgggactataggcgtgagccaccaagcctagctaattttatcgttattattattatttgtagagcagcttctcgctttgttgcccaggctggtcttgaactcctgggctcaagtgatccttccacctcggcctctcaaagtgctgagattataggcatgagacataatcatttaaaaatttttattaaatggtcatcacagtttttagcatcttcaacaaataagaggagaaaacaaaacctcctaaaagggtcaccaaatgaacttaaaaatctatatatccaaataaaatcattttgtgaaaaggaaattatgaattagtggcacattcaacgatgtccagattctactgtcaactgaaacaatctgttcatgtacactgaagacttcttgcatcttcttggcttcatttcacaagagccaatcttccatcgttttgtcactaggagaagggtatcacatcttacctaccttccacagtatttccattttcctgaggagtcgatggcctgggctaccatggaaagtccatctgggcagcagatttataggagaaggtggtgacagcagtgttgcaattgagcaaatttcttcaattatttcagggtattccagtgactctcatgacaaactcaaggcattcacagccctctggtagagtcccaattgccagaacatttttgtcattgtttttcactaaatatgcatgatatttgagtctcatgaaactcaagatacattgtatctgttctagatgctgagtaaatgcattggatgaggactgtcaaatattacttattgtaagtctacctctgtgagtttgccttggaaatatcacctttgcactacacttaccaccccaagttttggataacgacgtccagctggtatcactaaggaaacacactacacagaaaatttaagaccggtgcaaacaggaatactatttactcaatttctgtaaggtttcctgtatgaaagtcaagacgaaggagagagccaaccacagaatgatgctgacattcctacaaatgctaagaacccagtatatagtattagaacacatctttgtacaatctaccataataattttattgttctactaatattagtaatttttaaaagtcagacttcataaacaaaagtgacatgatgtgttcatttcctaattcatcataactgatgctcactcccgaaggatctcttactatagacgccactgtgacttgaataaaatatctaaaatgttctaagcagttgtaaaagaaattgaagcgtaagtgaaatacccctgagggtgtctcttcatgagagaaagatcaaattttcttaaatatctaattgaataatttcagctttcctgtggaattacctctgatgaaatttcaagccccagctatgccctccatcagtcacacctcctgtgtcctcctgcatcagcttctccttgctttattggttttgcccatctaatctttattatttgcaaaatcagctccctttggggaaatgtttctcaccattaggtaccctaatgccttaaagcaagagtgggatgattttattttttacatgactgctcacaaagacattatgtatcttgtaatacaggtgtcctatgatgtgatttttctttaattctctagggaaaaaaatgaaggtgcgggcagacagtgccaggcataaaatattggtatcacaaatatttgttgaatgagtgaattaacaaatgaatgaataggatatcttcagaaggagctatttcgaggtcaaatcaacttaagtgataaaatctccctaaatgtctacttgattctttggtataaagaaagacaggaagcagggcatggtggcttatttctgtggtcttagctacacttgggaggctgaggaaggaggatcatttgagactagtagtttgaggctgcagtgagctatgattgcaccactgcactccagactgggcaacagagcaagactctgtctcttaaaaaaataaaataaaataagaaagaaagaggcaaaaggtacaagtctgagttagcagtgtacagaataatctggtaactgttgaagatacagcaaatatgctcttgaccggataggcccagacctcatcagtctagtccagacacagttgctgtatgatgacaggtacagataatactttttattctttattagcagagagtatcagcattggtcaagatgtggatgaggcagaaggtccaagtagatcaaagatgattccaattcaggaaatttcccaattcattgaagactgacaaaatgaatgcactcatgcatagtcaaaactacagctcaggctgggcacattggctcatgcctgtaatcccagcaggttgggaggccgagatgggtggatcacaaggtcaggagttcaagaccagtgtggccaagatgctgaaacctcgtctctactaaaaatacaaaaaaattagccaagcatggtggcaggcgcctgtagtcccagctactggggaagctgagtcaggagaatcacatgaacccaggagacagaggttgcagtgagccaagatcatgccactgcactccagcctgggtgacagagcaagactccgtctaaaaaaaaacaaaaacaaaaacaaacaaacaaaaaacttcagctaaggcaaggtgcttttgtgccaatcctaattattttggcactgaacatgctctatatggtgctaggtatagacctaggcccagacccaaaagagtgaatcttttataacataaccccgaatatttcctgctgtgatgaaatattgaaaatatcaactaatgatgccatttttggggttctatttaaaatattttctattattaaagatgtaatttcaataccaagtttaaatatatctccctgcagtagttttctgggagatcatcaggagacaatttggaagacttgggaggtcaaacaagtaatttaacaggaggctatgccactaagtgggagaaagtttgggcaggcctgaagtgctactctggctaagaaagctccatagataaggcatagattttggcccaaatgcaacttagaacttagatggaaaagtcaaagtttctggatcccatctttgagtagaaacagaatagaaagtgagtgctgacgtcaggtcttcccctttaatttataaagctctagagaagctggagtggtctctcagacaacactgatgcccatgacaaaggtatgaaagcacatcacacaggtcagcgagaaaatcactaagaccccagtatcaaaatgtggaaagagtaggaatatatcattcaccaagactagaactacaaaagtccaataaatattttaaaattacccagcttacaacccaggtaatgcaaattaacttacattgtcatgctattcttttttttttctcttttaatgtttagtttgtggctaattcttctcttgttcctgaattttaaacagtcaggcagtttgtacaatcttccttctcatgcttgagtaattcaaagagtcccaagttatttgagagatgattgggtcatgaggatggaaccttccttaatgagattagtgcttttattaatagactcgaaggaggtggttcacccttctaccatgtggggacacagcaagacagtgccgactatgaaccagaaagtgggccctccccagacatcaaatcagttggcactttaatcctggacttctcaacctccagcattgtgagaaataaacgtttgctgtttataaacaaaacaaaacaaaagggtaccaagttattaatgagaatgttcatctcaagtaatgatcaaataatcatgcaaattgtgggtgagaagaagtgtgagtggcttctttctcccctccccaactcccttttgtgactctcaccaagaaccatgaactgaggcctctgatcctcctggggctggagtgtaggagaggaaaggggaagactgacatttttattacatttttcattggaatagaactttattatatttgatggagattttgaattttattgctgagataaaaaattaaatctggtatgtaacaaaaataaatatgtgcttcacaggagctttcctttattattttaacattaaaaatttttaaaatattttagttgataaatgagaaattgcatatatttatattgtgctacgtgatgttttaatataggttatacgctttgctatgactaaatcaagctaattaacatttccgtcacttcacattcttaccactttttgtgatgagaactttgaaaatctactctcggccgggtgcagtggatcatgcctgtaatctcagcagtttgggaggctgaggtgggcagatcacttgagctcaggagctcgagaccaacctggccaatatggtgaaaccctatctctactaaaaataccaaaatttagctgcgtgttgtggcgggtgcctgtaatctcagctactcgggaggctgaggcaggagaattgcttgaacccgggaggcgggggttgcagtgagctgagatcccaccattgcactccagcctgggtgacaagagcgaaactccatctcaaaacaaaaaacaaaaaacaaaaaacaaaaaactactctcttggcaattttcaagtattaatggtaactatcatcatcccgctatacaacagtcttccagaacttagtcctctaactgaaactttgcgctctttaaccaatatctgcccccactgcccccaggccctggtaatcaccattctactttttgcttctatgagataaacttttttcagattccacacgagtgacatcacgcagtatttgtgtttcagtgcctgacttatttcacttaacataatgtcctccaggcgcatcatgttgctgcaaatacaagattttttgtatttttaaaggctgaatagtatttcattgtgtatctatcccacattttctttacccattcgcctgttgctggacacttaggttgattctgtatcttggctattgtgaataatgttgtaatgaacgtggaagttcaggtatcacttccaaatactgattttattttctttgggtagatccccagaattggaattgctggatcctatggtagttctaggttcattatttgaggaacttctgtacagttttccataatggccgtactaatttacattcccaccagcaacagtgtatcagggttctcttttctccacattctccccaacgcttgttacctttcatcttttcaatcaaagccattcttacaagtgtgaggcaatatctcactgtggttctgatttgcatttccctgatgattagtgacggggaccaccttttcacatacctgttggccatttgtaggtcttcttttgaaaaatgtctatttaggtttcttgctcattatttaattggcttattcgtcttcctgcttcattgataccaccagggtgatctagcttgccactctctagacttggcaaaagtttaaagctccttatgatttttacggtacctttagcctctctctatgatgctgtttgcccctccagtctgccatgtaggacaggactgtctcacacagggtttagatgatgcctaagagaaacattcacacattttattttttgccttaatagaaggctgcagaacagagccacctccctttcaactcttccacccatagctagacagcctgcctcttgcccttcagaatcccatggcctacaagtctgtggcctattgtgttcccaggggtgcgtgactctcatctagcactctcagcagccccttgaagtctcttatcaggagtgagataaggcgcggtcacccctggctccatccactcagggctggtggaagcaatggctcccaacatcctatggattccagactcggtcttcaagacaatgccttgcccttagacccttgatgtgagcagaaagcaattactgggatcatgcatatgttagtggaacacagcccctttacacctgatcttgacccacttaacactttggctgggtttccatgttaacatcctgttacagaaaccattttccactcagcaaaacagcagagagtttaaaggggaataatccattctggcaaaagaagagtgaaagagagctgctggtgggcaaataaacaggggaaagtctccttggaaaggacgtgagagtgagtaataaagccttaaaacattcatggccataggctgggtgtagtggctcacacctgtaatcctagcattttgggagctgaggcaggcagattgcttgagctcaggagtttaagaccagcctggataacatggtgaaacccaatctctactaaaatacaaaaaattagctgggcttggtggtgcacacctgtaatcccagctccttgggaggctgaagcaggagaattgcttaaacccaggaggcagaggttgcagtgagccgagatcaggccactgcactccagcctgggcaacagttgaatgagactttgtttccaaaaaacccccaaaaaattcatggccataattctaggacttgcttttctaggactattacccaagggaataacaggaaagctagagggctaagaatacactatattaaatatggaaacacaaaggaaattgcaagaaaatcatgaatatctgttcaacaagatactagatcatcattcaaaatgatgtgtacaaattgttctacctaaaaagctgaaataacttgatttgtaaaacccttaattcctcctcattgtaaaagtccagaaaaatatataaagtaaaaaatatacagtaaatatatatgtctaaagtatttatatatttatatatgtaaagtatttatataaatatataaagtaaaatatatacagaaaaaatatataaagtaaaaaatcattataataccatttctgtcattatttggtatatagtttgattttcttttatatatacatctgctaatacacatatgaatatctgtttatatacaaaatctatatgcatatatttattttaagtgtgctcaaaactgtaccacacatgctgtattataaactttcttctttaatagtctgttgtggctaacttttcatatcaataagtgctggtctataatattttttaaaaaattatttcatggtaatccagtgctgagatgtaatgtaatttattttaatgagttcttattattggacatttgggtgatagctattattttgctattatatgctaacagttgtgtgaacatacacgcatgtatatatatgtgtctttatgtatgcatctttatttgtttttgaaattgccagtttcctgaaagggttattgctgagtcagggcccatgcacctttcaagacctgtgatctttataaccaaatttcagaaagtttagacatgagcatatatcagatgcttttcaactctggagagtctattttcagcaaagccatcagagttattctgttaagacataagtcagatagtcagtgtactcaaaaccctcccttttatctactacttcccatctcatctctctctaggaaaagccacagtccttactgccccattaagtgaccctctggatttatctcccattcaccttccaccctgcctgagcctcacaccagatgtcccctatgtcttctctcctttccgtctctggagagccctaccccagagctgaactgaattctctccagaatatcttcccccttctccaccaagcccctttcccagtttttctccacacaacttttcatgtcctaatgtacaacttatgcattcatttatgtagttaacttcttagtttttctccccctattcttcttccctccaccgacccaccagaatgtcacctccaccaggacagaggtttgcctattctgttcaccaatcaatccgcatggctagaagagtacctggcacatagtagatgctcaaaacatagttggggagtgaaaacatttgcctagtgttcattcgaggttttgtgttttcttttctttcttttcttttttctttcttttttttttttttttgctttgatgaattaactaattaactataatttgctgatttttctattgggtatttaacatttttaaattagacttaaggcccattaatacattagagataaaaactaatgttaggtatatatgaggaaatatgttttttccccaggttttgggggaaaagtttactaaacaatgcagaaaatattcagcatacttaagagaatactgatttggtgtatacacacacacacacagaggatcaacagtacatggtctgcaatctgctttttttcacttaaaataacattactgagatttacccaggctgttttcaatagatgtagcttatttcccttaactgctgtagtctatcctatgaatgtagctcacattgattagtcatatccctattactaaatacacaagttttttttctttttattttttcctttttctattacaaagaacaatccagtgaaagtttctctaagcatatattcctagaaatggtatcaaagggttgtggcgataggcacagtttgaattttatgacactgccaaaattgtcccataatacttgtccagtaatgtacaaatattcctaccttcattccagacttgaatttttgccaatccggcttgagagaggtgcattaaagtctaaccctttcagtagatttctgtgtctgttttcttgtatctccaacagttttcatatcacagattttaatttcaaaaatgtctacgaatcgattgtccccttcactaatgtggctcaatttaatactttttaccttggattattttttacttgaccaatattgcaagttcaaattttattttctacatgtatttgcctggtatatctttgcctcaccatttattttaaacgagtcagtgtgtcttacttctctttcctctggaaagatatttgtagattttatttaggatctaatctaaagatacttgttctttttacagatgaatttaaaaatccccattcatttttgaaagctgtttgtattccttttctcaagtcttcatcactctccctctctctgatggtatttcttttgttttctaccttttgttagatggagtgagttttctttcattcctacgtttataactggaaagtgacaaaacttgttaccactccgttagtggccatgctcatatctttgtacaaatgcttaaatatgtatttcttgaattttaatctcagaaactgaacactgcttattattgcttccctccataaatgatggagaaattagcatatcttcactccctccagtctttccaacttttttaattactagaatttatcataaactctgtcatagttttaaaaaataattatagcattcacattccattcagaaaatatttttatcacaattatttagattctgcagggcatgcagagaaagctggtgtcttggaaaattaaggctgaaaattttgtcttggaacagtggtttttttaaaaagtctatatttgctgaaattattttatcaaatctcagatgctccaaaattgggcacttcctatcttattttattattctatttgagacagggcctccctctgtcacccagactggagtgcagtggtacaaccattgttcaccatagccttgacctcctgggcttaagtaatcctcctgcctcagcctcctgaatagctgagactcacaggcacatgccaccatgcctggctaattttaaattttttgtagagatggggtctccccatattgcccaggttgatcttgaagtcccgggctccagcagttctcccgctctggcctcccacagtgctgggattcaggcgtgggccatcgctcctggccctgtgttaagttactcttatttctggtctttggagtttgcttgctcatttataagtgaggctgctacactggtgaagttcaaatagagactaatgctattaatcttgggtttcccatcacggctgttgaccagccactgcagcaatccttcaaggccactgcattgctctcctcccagtgtctcccctctaccctcgagcttgctccccagtgtctgagagagcctgtgctgctctataaactgaggtcacggacaaagctttctcctctggtgccacgctcatgcctaagaaaccttgctccaagatggggaaagcctttctgccctcccaggacccacttatttccagccctcatgcatcaatatggggaattcctactggggttggtcagaattccatccaatgctaatttctcgagaaagtctgacaccaccatgtcccttccatttggctaaattttattgattccagaaaaatgttaatttttcaaatgagtagtgtgtggtaccattctaatttccactctgtgctaataattccttttcctctggttttgctttctttttattctttgcaggaagagggagggaaaaattttggtaaacttctggaaagtatggtgtattagccaattgttacttgtaacatcaaccccaagactcaaatatattttgtaattatatttatgctgaatacacatatatttagaaccacagtgatttttggatttaaaaaaacacatactgcaattattcttattttcatgctaaagaaaaagataattatgttctttaaaaacagcattttcatggaatatgatgcagccataaaaaaggatgagttcatgtcctttgtagggacatggatgaagctggaaatcatcattctgagcaaactatcgcaaggtcagaaaaccaaacacagcatgttctcactcataggtgggaattgaacaatgagaacacttggacacagggaggggaacatcacacacggggggcctgtcgtggggtggggggctaggggaaggatagtattaggagaaatacctaatgtaaatgacgagttaatgggtgcagcaaaccaacatggcacatgtatacatatgaaacaaacctgcacgttgtgcacatgtaccctagaacttaaagtataataataaaaaaaagcagggttttcaaaataattcttcaaataaaggtattttaaatttactgttagtagagtactttaaaatctagcattaatttaaagatttagacattagcaatgcacttataagaatgaaaagttaaagaataatttggagaattttatttttaaaatttatgactcaacagcaactgaaacatttattaagtgcaagggaaattgaatcttaataaaaacaactagcaataatattataaaatttgtttttaattatttaattttctgatacatagtaataaagactgtgttgtcataaagtaagagtaagagttaactactatatgggatcatataccttgataaaagaagatttactaggataagaaaggtgtactatgaacgttgaatactggactataaaaatctttttttttttttgagagagagtcttgctctgtcacccaggctggagtgtcatagtggcatctcagctcactgttatctccacctccctggttcaagctattctccagcctcagcctcccgagtagctggaattacaggcatgcatagccaggcccagctaacttttgtgtttttagtagagatagggtttcaccatgttggccaggccggtcttgaacccctgagcacaagtgatccacccgccttggcctcccaaactgctgggattacaagcatgagccaccgtgcccggcctgtgcaaatctttaaataccctcctgggaggtggtgtccttaaggagaaagaattcctttaggacagttctggaataatggccaggaactattaataggaaaagaattagacctgtgaatttctgtttctcccaaaggaaagggaaatgtcattgaacgattctaccatgagcctacttacaattctgctctatcataaggcggttacatgtattatccagagccttaaattaacaatccaaggaagaagctactgtcctgtttatttaattgatggtaatgatgaaacccagagagctcaagtcctctctcggggccacatagtatgtcggcaagtcgggggttcttgggtctcagtgatcacaaaacagatacgacacacaaaacgtgaaggcagtggcaatgaaggagacaattccactctggctctcagtgctgaaaagggagaaatatgcttctgttctttgaagtgtccatttttcttggggtccattttttttcatttctgagaatatggcttctcctttaagaactgttattgtcattctaaaggtttactgattgaattcagctccctctgcattcatccctaaactacattacagattgtatgttacccttactctcactgcggaaattgctgatgaaacaaaatagagccatttaatttaccctttcgttttaaatataacaatgtcaccggtgtctgatgttccccttcctgtgtccatgtgctctcattgttcaattcccacctatgagtgagaacatgtggtgtttggttttttgtccttgcaacagtttgctgagaatgatggtttccagtttcatccatgtccctacaaaggacatgaactcatcattttttatggctgcatagtattccatggtgtgtatgtgccacattttcttaatccagtctatcgttgttggacatttgggttggttccaagtctttgctgttgtggggtggggggatgggggagggatagcattaggagataaacctactgctaaatgacgagttaatgggtgcagcacaccaacatggcacatgtatacatatgtaacaaacctgtacgttgtgcacatgtaccctaaaacttaaagtataataataataaaaattttttaaaaaaacaaaaaacaatgtcactataacaaatctgaaaggtgtggctgcttttctcacgttcatgcgttttggcaacttgtagttccttaaggtgtgacggatactctcttcttcccaaatgtactttcttcatctcctttaaacctcacattaaatcctcattatttgctgattccctgcctggaaattgcctacttactaaaatttgtttgtagccctcaaatcaataactcatggagctttcacggttattcatggccattcacagagtggcaaattctcaagtcacctaacagtcacatgaccagctgatgtcaaccaagacaatgctcggcctcctgttccagctctcatactgtaaacaaacatcctttttgtgggacatgtggtgccacattttttgcatttatgcttttggttgacaatcttgctatttaaaatggcccctgggcatggtggctcatgcctataatcccagcactttgggaggctgaggcgggtggatcacctgaggtcaggagttcaagaccagcctggccaacatggtgaaaccccgtctctactaaaaatacaaaaattagccaggcgtggtggcacacgtctataatcccagctactcgggaggctgaggcaggagaatcgctcgaacctgggaggcagaggttgtagtgagctgagatcacgccattgcactccagcctgggcgacaagagcaaaaactccatctcaaaaaaaaaaaaaaaaaaaaaaaaaaaggccccaagagtagtattgaagtgctgtctagtgtttctcaatcagggaaggctgtggcgtgccttacggaaaaattaacgtgttagataagcttcattcaggcatgagttatagtgctgttgcctgtgagctcagtatgaattaaaaatatacattaaataagatgtctttaaacagaaacacatatgcatgaagattgtgggttgatccattgacaaaaaaatgtgaccaggggcttgcaggaaacttatcctgtatttcccccaggatcaatgattcagtatcccctaattcagcgttcaaggtaactttataaaacattgctactctggataagaagaatcacacatgtgtttgtgtcttattccctctgctggagaacactgatgaatgtttttgtatactgcagggctacagtaaccaaaacagcatggtattggtacaaaaacaggcacatagagcaatggaacagaatagagagcccagaaatgagggaacattcctgcaaccatttgatcttccacaaagctgacaaaaacaagcaatggggaaaagattccctattcaataaatggtgcgggataactggctagccatatgcagaagattgaagctagatcccttctttacaccatatacaaaattcaacttaagatggattaaatacttaaatgtcaaacccaaaactataaactctggaagatgacctaggcaataccatcctggacacaggaacgggcaaagattttatgacaaagacaccaaaagcaactgcaacaaaagcgaaaattgacaaatagtatctaattaaacttaagagcttctgcacagcagaagaaattaccaacagagtaaagagacaacctatagaataggagaaaatatttgcaaactatgcatctgacaaaggtctactatccagcatctataaggaacttaaatttacaagagcaaaacaaacaactgcattaaaagtgggcaaaggacatgaacagacacttttccaaacaagacatgtatgtggccaacaatcacatgataaaaaggttcaatgtcactgatcattagagaaatgcaaatcaaaaccacaatgacataccatctcacaccattcagaatggctattactaaaaagtcaaaaaacaacagatgctggcgaggttgcagagaaaagagaacacttgcacactcttggtgggagtgtaaattgttcaaccattgtggaaagcagtatggcaacttctcaaagagctaaaaacagaactaccattggacccagcaatcccattactgggactatactgagaggaacagaaatcattctcccataaagacacatgccaatgttcactgtagcactattcacaatagcaaagacatggaatcagcctaaatacacatcaaggacagattggataaagaaaatgtggtgcagctacatcatgggatacgatgcagccatgagaaagaatgagatcatgtcttttgagggaacatggatggagctggaggccattatccttagtaaactcatgcaggaacagaaaaccaaatgccacatgttctcacttataagtgggagctaaatgatgagaactcatggacacgaagaggggagcaacagacactgggatctacttgagagtggagggtgggaggaggaagaggagcagaaaaacattaagtattgggtaccaggcttaatacctgggtaatgaaataatctgtacaccaaacccctgtgacacgagtttatctgtataacaaacctgcgcacatactcccaaacctaagataaaagttttaaaacaggacgttttctgtaacaataacacatacaaaactctcatattctatacctcctaacttcattctttcataggtaacattatttgctcttttgcttatcgtattatttttaaaccaatgcaatatctattttaaaaaatgtaataaagtaagaaataccatactttaactgttatgataattataattctgagccactgttccaagcaaaatggttaaaatatttccatgtaaatgttcatgtaatactttcatgtaaatctcccataatactaggtcaagggttcttaatttctctgtctcttatttaaacatatcaaccaaagtgacaggttctgagagtttgcacctttttaaagtaccacaataatccatccagtggaacatgacacccaatggataagcccagaggagccgtgtgactttcaaaggaaagttctgtcattcaaatctgtgctcattgaatctggactaaaagaatcatggttgaattattcgttgaatattttggtaaatgagacactaaaataactgtatccaaccctgtggcatcttgcttaataaaataactgtctataaaaatgtaaaccccaaatgatcttcaaacacatatttcattgaatatctgaacctgtttccacttgattccttcccattcccactcctcaccgctctctccctttctctttctttttcttctttctcaaataaaaagagagagacataagcagagtgttaaaaataaaggatgatctaaccaatacgagactgagagtcccaaactgctgctaaattactcaggacattagagtcagactatgcctagaatagaaaaagggcaattttcaatctttttctccccaaaaggcccagcaacatggggaagaaaatagtgatcatttgcttaattgtctgatcctctgatcactaatatggaaagacacattcacagatattctagaacatgccatgtggtataatagaaggaacaatggcccatgagtttgaagaccttgggttctggccttcctgttaactatgatattggatgagtctctagaccatcctgatttgctcacctgtgtaatgagaataaagatacttggtgtgtctattccataggactgaggtaagaattcttggagatgatgtgttggagagttctgtgttaactacagacggaaagtaatgtatggaattactagatatattgtactttcaggtcactgcataagtttctactcaaaagaaaattatagcaagttcttttataaatgaaatatccttttgaagatcattttgagtatataggttttttttttttttttttttgagatggagtcttgctcttttgcccaggccggagtgcagtggcgcgatcttggctcactgcaagctctgcctcctgggttcacgccattctcctgcctcagcctcccgagtagctgggactgcaggcccctgccaccacgcccggctcattttttgtatttttagtagagatggggtttcaccgtgttagccaggatggtctcaatctcctgacttcgtgatctgcccgcctcggcctcccaaagtcctgggattacaggcgtgagagtatatagttttatatagagttcttttttaagtgagataccacagggttggacctagagttatcttagtgtctcatttgacaagtgtctcttccttgtagaactgcaatgaatttgcactgccaagatttgtaaacaatatcgattaattacatgtgtctgttgcatcttgaatatactgccaatgatttttaaatatttttttaaattatctcaaaatatatttcaatttaaaacatgtaactagttttattaagtgtttaatggatacctcagtgtcattaaactatatttttaattttctatttaattattaattctttctgttccctcattccttttatttgtgttatcacttatcttgctacccaaacgttgcatacaattaatcagctgatcactattttctatcagtagcttccccatgttgctgggccacttggggatacaaaagattgaaaactactctttttctattcacatatttattcaacaaacatgcactgggtgcctactatattggtgatgggattgggagtatagacaaagcttctatcctcaatgaggttacattatagagaaatactaagcaaaaaatgtcttggacagggcagaaaagacagcactgcagttgcacccgcacaggtgatgtccctcaagaacgcagttcctggagctgggaccacgttaattcttctgtctacctgcagagggcgccattgcaccaggtacgctttcagtctcacctggtaaaactagaagatggcagctttacaaagaatttcaagaatcctaaaacagtaaaggggtcttatgtgggctaattgcatgaggtgctgaacttaagtatcttcagttgctggagaaaagcagaaattctgcgtttaaggggagaaaatggaggaaaagtgagacaggtgtgtgtggatactggatgtattcatttgtttcaccttgtgcccggcttttcctaaggcctggagacccggcgatgaacgcagttggctatcattgctctcagagggcttactttgtactggtctgtggtgtgacaatgtagaataatgtgaataaagtaataacaatgtccaaaatttattgaatgctttccatgagccaagaactattcaagaatttcacatacattatcttgtttaaactgcacagccgcgcgttgagaagaggtgctatcaactttcccattttgctgatgaggcaatttaggctggatgagaggacgagactgagtactactttcttggtggaggcgacagtcaaagccaggcattagaccggaatcgactcagttaaccactaggctgtgtgtgacagctggaggttagggaacgcggaggcagagagagggaagcagcgggtgcaaagggcagagctacttcggattttatgacggtcaaaggcctcaatgaagaaagaggtaacatttgtttttgttttgtttttgagacggagtcccactctattgcccaggctgtagtgcagtggtgcgatcgcggctcactgcaacctccacctcccgggttcaagcgattctccttgcctcagcgtcccaagcagctgggactacaggcgcccgccaccacgcccgggtaatttttgtatttttggtagagatggggtttcaccacgtcggccaggctggtcttgaactcctgacctcaggtgatctgcccgccttggcctcccaaagtgctgggattacagacgtgagccactgcacctggcgagaggtaacttttgaattgaaatctaaattgtaagagggaatcaactccaggaatatctagaggcagagagcaccatcggtacagcaagggggactgccctgagcagaaaataagcagggaacgtttcagaaaaagtccaggaatgggacaccagcagcagggtggctagagctggagggaagggagaggttatgtcagggctgagccgggagcctacggagccctggctaggggctcaggttcgctatcgcaatggaaactcctgggagctgtgagagcagtgatatgatgggatttacacgtaattatttctccgcttctaggaggcgactggatggtaaaagcaagagcaggtagcagacttttaaataacaataataatcgtggtaatgatacaataggaaaacaacacagcattggtgttatcttgatcggtgaaatacattagttttttgttgttgttccaaatcagcccacttggttctgttacttatctaactagagatcagtctgatatgacgcatggtgattttgaaataccagcacagaacatccctgagatgacggtgatctgaaaagagccctggccctgttcttgtagtgtcccctcctccatcgcatgcgcacactagaggctgatggtggttcgcggatgctaccaagaaggtacaaaaagctgattttacagggatttgtctgacccgtgtacaattatctctcagagtttccaccttttgtttcttcactcctcctatttgccaaaacagtcactggtttgcagagacttccctccccacactctgccctcccgtactcagtcctgcaaaacggagcttgtgtcaaatgaaacaatctccgtttcctggtggacatacttccttgatctctggggcttctgcccttcttttttttttgagacggagtctcgctctgtcaccaggctggagggcagtggcgcaatctcggctcactgcaacctctgccttctgggttcaagtgattctcctgcctcagcctcctgagtagctgggcctacaggcgtgcgccaccacacccagctaatttttgtgtttttagtagagatggggtttcactatgttggcccaaatggtctcgatctcttgaccttgtgatccgcccaccttggcctcctaaagtgctgggattacaggggtgagccaccatacccagccttgcctcctttttagaagaagattatgataatactaacaatagcttgaagataataatgagaataatgaaaataagtattgcttaaagttaaaaataatgaaaataaataatgcttgaagagaatgataatgaaaatagtaacagcaacaataataataatagttaacatttcactagcatttgccatgtgccaggcactgtgattgtgctttatagattaattatttctccaaacaaccctgtgcagtgggtgtattattgttacttctatttttcagaaaaggaaactgaggcacagagagtttacaggatttgttcttgttgcacagctaataaatggctgcattggaatttgaacccagttgtctgggaagagccattctaatttggagaaatatttagtacaatctctgatcaaggacaaatcctaaaatgtagcttggagagcagtttaatatccaatggcaagaaccgccattcattttgcaccaacctaatgcatactcctgctgaaaaaaagaggcctacgatattcttgagagtgcaaggaaaggatagtgacatcacctgatcaatgcagaaagaaaggattatagtgagacaaaactttgcaagactcttaagaaacagtggctttaacttcatcaaatttgctacctgctcttagttgagtaacaagtaagtcatctgtcctctctgagccagattcctgaaaaacaggtaatttaattatttttttccagcatcactgggggggtggttatgaaaattgaaggaaattatcaatgtaaaagctttctgaaagcttgtaacatattatgcaaatgtaagattaactatatctgcaatgcaactgattatcagttctttagtgaagtgtaatgataattctaagtgttacttcagattcaaatgaacatataattttagaaataaactagaatttggcctcacgaccttggccataactttcttttttataataaccaaccatatatttatattcagaatctctctataatgcatctatttcttcaagctatatttaaaatatattaagtaagaaattaaaatgaagtcatttttttcaaacgtacaatgtaattttatattaaattttaaagctaaatgcattcattcagtgattaatttgtttaatgtgccaggcaatattccaggcactaagatagagatatataattcagaccaacattcttagtctcctaattccttgtgttaaatggaggaaacaaataagtaggtaaacaataattaattttaatattttgctatacatttcacaggtaagtggataacccccatgactttgcaattcaaatttagtgtgtcagacacttccatatatgttatctcctgtgaagttcagggtagctgtgtgagttaaaagaaccacacatttaatttgttgctttcttattagatggctcagaatggaaaagggttggcgaaagttttcagagctagaagtgacagagccagggctggaatagaggctttagggcaagaagttctgagaagaccccagagactctgagaggacgggaggatcttatcatcactgagcaagatactgccccaggggtggtagtttatggtttttattcctcacactgcttccttatttagtgagcatgtaagttaattaaatcagagtatgtataatgcatcatataactctatgctaatggttcccttagtatatcttatgtttctcttatgtactttgcttgcattctcttctgaggcccctagtaatgacgtgtccttttagaatatgaaattaaaaccaagtattctaaattgctttcatcatctggaaattttgatgtatttttgacatcttacaattatgtcccttaaaatttctctagaggttctagaacaagggctatttttttgtatgctcacttgactgcaatttcaagctatggaaataagtgatcaatattctcccaagccaaaagccccgtaggacaaccataaagctcctcagtgaaattcagaaatggtcatctaaaacgttgcttttcacagccctacatttttctttcttactgctgttaagttgagcctaaagctgtcttcttacatattttaagttgggcctaggggtttctccatacataataaactggaacctaactgtatgtgtaaacaacctactcttgtaccaatcactgagttttggtcaacaaaaggcagctcactgttgaaactgtgtcaaataaggaaaatgtcaagctgaaccaatctggctgtttcttttcctcacttctattttccatgagccgtgttctgttttctgtccataaatctttttcaaccacagtctctctgaacctattctgatttggggctgcctgatttggaaatcattctttgctcaattaaactctgttgaactatttctctaagatttttcttttaactatcaatctgagtatagatacttagtgtctttagagctaaatgtgttgcaactagatcacataataaatttcaagaatcaagaacacttatttattcattcactcaatacatctttttgaatatctagttaagtgataaatactgtcctaggaactaggaacgctaagataaataagatgtagttcttgaactcccaagaggatcaatccagtgaaatagacagctgactgacccagtcctcatgaccaccatctactgtggggccagtgaaaatcgaagaaggctttcctaaactggcaatacggttgttgagtcttaaaggacctagagtgttaacatagccataaactttctacgtgactcagtttttctttgattaacttatccattgcattattaagataaatccattaataatgaatagttgcagtaaagacatctttaagaaaacgattttgcttttaagtaaagcagcaggtgagtttttatatgtaagagctcgtcaggagttaattttctttctcttccctgattcatttagcttatgttaaaccaggcatatttctcccatagtatttaaaaacaaatatttaaccacatttctctgaaaattatttaggaataggtcttaatatccttctatttgaaatgagagccttcccttattagaaaaatcttcatgatgcttagaaagactgcattaaaaaaaaacaaaactccaaaacttgagaatatatagtcctttaaatctgcagttccactgaacaacctaaaaagttctgtgaatacccacagaggaaaaggaaacccagttctattttgcaacttccattgcaatttcttccttgaaatttttaattattttgagtgagattaaaagttactaagcatatgagattgaagagtttttcataactgatatattattgttatgtgtcattttaattccactttgacttgaacttcaaaattaatcattgtaaaacaatcagtgcttatttgggcattgatcaatttcttttatccaaactgcttctcgaatctcattccttttttcttggtttaatttcctgcttatagaaggctatttttagtagatctcttagtgatggtctgtgaatggaaaactctttcaatattggttgtcaaatttaaataatatcatatctggctatacaaatataggttacctgatattttctctcagtgccttgaaactattcttcatttctgaccttcatgagtgcttatacaattttggagataggctacgtatttattcttttgctgctttaaaatcctcctttataaaagtaaagtctctttttccttgagtttcttcaagtttggggaggtgcatctattggcagactttacattttcaccaactgtaactagcgctcagtgtctttcaaaatttgaggatttatgtccttgttcagttctaaaaactacctcaactatgatttcagtaaatactgcttgtttcttgtgctctcctactgaaacccctctcatgtgttctcttctgggtctaacatcctttactctatgtgttttaacctctcttccatattttccatctccttatgcaactgtgcagcattctagatctttcttccaatttacttgtgcactgaggttttaattataacgaccatatttatttgtataatatttgtattattacaaagcctctttggttgtttatcaaatcttcctggaatttttcctgatttttttttctaatattatctagctctcatatcattttttgcgggtaattttatataattttaatggtctaaaaatattatttagattattctaatataaatttcttgtcaatctgtttacttttctttatgatacagtgttttcttgggtggtttctcattttcgttgctagctcaccttcagaagaataggttttcttatgggaattccatgtgcaatggactaggaaacaatattctatagcaattttagctttactttttccaggtgatatagtttggatatttgtccccacccaaatttcatgttgaattgtaatccccaatgccagtgatggggcctggtgggaggtgtttggaccatgaggatggaacagtccgtcatggcttggggctgtcccatgatagtgagttctcgtgagatctggtcatctaaaagtgtgtggcccttccccctcactctctccctcttgctcctgcactatgtgacatgcttgttctcttttcaccttccaccatgattgaaagctccctgaggcttcaccagaagccaagaagatgccagcacgatgcttcctgaacagcctgcagaaccatgagccaattaaacctcttttttctttctttttctttctttctttctttcttttttctttctttttagttatactttaagttctagggtacaggtgcacaatgtgcaggtttgttacatacatatacatgtgccatgttggtgtgctgcacccattaacgtgtcatttacattaggtatatctcctaatgctatccctcccccctcctccaccccatgacaggccccggtgtgtgatgttccccatcctgtgtccatgtgttctcattgttcaattcccacctatgagtgagaacatgcggtgcttggttttctgtccttgccatagtttgctcagaatgatggttaccagcttcatccatgtccctacaaaggacatgaactcatccttttttatggctgcatagtattccatggtgtatatgtgccacattttcttaatccagtctatcattgatggacatttggcttggttccaagtctttgctattgtgaatagtgccgcaataaacgtacatgtgcatgtgtctttatagcagcatgatttataatcctttaggtatatacccagtaatgggattgctgggtcaaatggtatttctagttctagatccttgaggaatcactgcgctgtcttccacaatggttgacctagtttacagtcccaccaacagtgtaaaagtgtttctatttctccacatcctctccagcaactgttgtttcctgacttcttaatgatcgccattctaactggtatgagatggtatgtcattatggttttgatttgcatttctctgatggccagtgatgatgagattttttcatgtgtcttttggctgcataaatgtcttcttttgagaagtgtctgttcatatcctttgcccactttttgatggggttgattttttcttgtaagtttgtttaagttcttcatagattctggatattagccctttgtcagatgggtagattgtaaacattttctcccattctgtaggttgcctgttcactctgatggtagtttcttttgctgtgcagaagctctttagtttaattagatcccatttgtcaattttgtcttttgttgccattgcttttggtgttttagacatgaagtcctcgcccacgcctatgtcctgaatggtattgcccaggattacttttagggtttgtatggttttaggtctaacatttaagtctttaatccatcttgaaataatttttgtataaggtgtaaggaagggatccagtttcagctttctacctatggctagccagttttcccagcaccatttattaaatagggaatcctttccccatttcttgtttttgtcaggtttgtcaaagatcagatggttgtagatgtgtggtattatttctgagggctccgttctgttccactggtctatatctctgttttggtaccagtaccatgcggtttggttactgcagccttgtagtatagtttgaagtcaggttagcgtgatgcctccagctttgttcttttggcttaggattgttttggcaatgtgggctcttttttggttccatatgaactttaaagtagttttttccagttctgtgaagaaagtcattggcagcttgatggggatagcattgcatctataaattaccttgggcactatggccattttcatgatattgattcttcctatccatgagcatggaatgttattccatttgtttgtgtcttcttttatttcgttgagcagtggtttgtagttctccttgaagaggtccttcacatcccttgtaagttggactcctaggtattttattctctttgaagcaattgtgaatgggagttcactcatgatttggctgtttgtctgttattggtgtacaggaatgcttgtgatttttgtacattgattttatatcctgagactttgctcaatttgcttatcagcttaaggagattttgtgctgagatgatggggttttctaaataatacaatcatgtcatctgcaaatagggacaatttgacttcctcttttcctaattgaatatcctttatttctttctcctgcctgagtgccctagccagaacttccaacactatgttgaataggaatggtgagagagggcatccctgtcttgtgccagttttcaaagggaatgcttccagtttttgcccattcagtatgatattggctgtgggtctgtcataaatagctcttattattttgagatacatcccatcaatacctagtttattgagaatttttagcatgaagtgccgctgaattttgtcaaaggccttttctgcatctattgagataatcatgtggtttttgtctttgtttctgtttatatgatggattacttttattgatttgcttatgttgaaccagccttgcatcccagggataaagccaacttgaccatggtggataagctttttgatgtgctgctggattcggtttgcccgtattttattgaggatttttgcatcaatgttcatcagggatattggtctaaaattctctttttttgttgagtttctgccaggctttggtatcaggatgacgctggcctcataaaatgagttagggaggattccttctttttctattgattggaatagtttcacaaggaatggtaccagctcctctttttacctgtggtagaatttggctgtgaatccgtctggtaccggacgtttttcggttggtaggctattaattattgcctcaatttcaaagcctgttattggtctattcagggattccacttcttcctggtttagccttgggagtgtgtatgtgtccagaaatttatccatttcttctagattttctagtttatttgcgtagaggtgtttatagtattctctgatggtagtttgtatttctgtgggattggtggtgatataccctttatcattttttattgcatctatttgattcttctctctcttcttcttgattagtcttgctagtggtctgtcaattttgttgatcttttcaaaaaaccagctcctggattcattgattttttgaagggttttttgtgtctctatttccttcagttctgctcggatcttagttatttcttgccttctgcaagcttttgaatgtgtttgctcttgcttctctagttcttttaattgtgatgttacggtgtcaattttacatctttcctgctttctcttgtggtcatttagtggtataaatttccctctacacactgctttaaatgtgtcccagagattctggtatgttgtgtctttgttctcattggtttcaaagaacatctttatttctgccttcattttgttatgtacccagtagtcattcaggagcaggttgttcagtttccatgtagttgagcgcttttgagtgagtttcttaatcctgacttctagtttgattgcactgtggtctgagagacagtttgttataatttctgttcttttacatttgctgaggagtgctttacttccaactatgtggtcaattttggaataagtgtgatgtggtcctgagaagaatgtatattctgttgatttggggtggagaattccgtagatgtctattaggtctgcttggtgcagagctgagttcaattcctggatatccttgttaactttctgtctcgttgatctgtctaatgttgacagtgggatgttaaaatctcccattattactgtgtgggagtctaagtctctttgtaggtctctaaggacttgctttatgaatctgggtgctcctgtattgggtgcatatatatttaggatagttagctcttcttattgaattgatccctttaccattatgtaatggccttctttgtctcttctgatctttgttagtttaaaatctgttttaccagagactaggattgcaatccttgcttttttttgttttccatttgcttggtagatcttcctccatccctttattttgagcctatgtgttgtctctgtacatgagacgggtctcctgaatacagcacactgatgggtcttgactctttatccaatttgccagcctgtgtcttttaattgaagcatttagcccatttacatttaaggttaatattgttatgtgtgaatttgatcctgtcattatgatgttcgatggttattttgctcattagttgatgtggtttcttcctagcatcgatggtctttacaatttggcatgttttagcaatggctggtaccagttgttcctttccatgtttagtgcttccttcaggagctcttataaggcaggcctggtggtgacaaaatctctcagcaattgcttgtccgtaaaggattttatttctccttcacttaggaagcttagtttggctgcatatgaaattctgggttgaaaattcttttctttaagaatgttgaatgttggcccctactctcttctggcttgtagagtttctgctgagagatcagctgttagtctgatgggcttccctttgtgggtaacctgacctttctctctggctgcccttaacatttttttccttcatttcaactttggtgaatctgacaattatgtgtcttagagttgctcttctcgaggtgtatctttgtggcgttctctgtatttcctgaatttgaatgttggcctgccttgctaggtaggtgaagttctcctggaaaatatcctgaagagtgttttccaacttggttccattctccctgtcaatttcagatacaccaatcagatgaagatttggtcttttcacatagttccatatttcttgaggctttgttcatttctttatactcttttttctctaaacttctcttctcgctccatttcattcatttgatcttcaatcactgataccctttcttccacttgatcgaatcggctattgaagcttgtgtatgtgtcacgtagttctcatgccacggttttcagctacatcaggtcatttaaggtcttctctacgctgtttattctagttagccattcgtctaatcttttttcaaggtttttagcttctttgaaatgggtttgaacatcctcctttagctcagagaagtttgttattaccgatcgtctgaagccttcttctcccaactcctcaaagtcattctccatccagctttgttccgttgctggcgaggagctgcattcctttggaggagaagaggcactctgatttttagaattttcagcttttctgctctggttactccccatctttgtggttttatctacctttggtctttgatgatggtgacgtacagatggggttttggtgtggatgtcctttctgtttgttagttttccctctaacggtcaggaccctcagctgcaggtttgttggagtttgctggaggtccactccagaccctgtttgcctgggtatcaccagctgaggctacacaacaacaaatatttcagaacagcaaatgttgctgtctgatccttcctctggaagcttcatctcagaggggcacccagtcatatgaggtgtcagttgacccctactgggatgtgcctcccagttaggctactcgggggtcagggacccacttgaggaggcggtctgtccattctcagatctccaactctgtgctgggagaagcactactctcttcaaagctgtcagacaggggcgtttaagtctgcagaagtttctgctgccttttgttcagctatgccctgccaccagaggtggagtctacagaggcaggcaggccttcttgagctgcggtgggctccacccagttcgagcttcctggccgatttgtttacctactcaagcctcagcagtggcagacacccctcccccagcctcgctgctgccttgcagttcgatctcagactgctgtgctagcagtgagcgaggctccgtgggtgtgggaccctccgagccaggcatgggatataatctcctggtgtgccgtttgctaagaccattggaaaagtgcagtattagggtgggagtgtcccgattttccaggtactgtctatcacagcttcccttggctaggaaagggaattccccgaccccttgtgcttcccaggtgaggcgatgccccaccctgcttcagctcatggtccgtgggctgctcccactgtctgacaagccccagtgagatgaacctggtacctcagttggaaatgcagaaatcacccgtcttctgcgtcgctcatgctgggagctgtagactggagctgttcctattcagccatcttggaacaagaaccaaaactcttttctttataaattacccagtctcaggtatttacagcaatgcaagaataacctaccacaccacgtattccaagggctcgaaagcctgaacccagtttttatgtttatttattggcttggtgattcctgacatcatacttacgcatagcacaggcttggggttttacttcttctaagatactaacttgtttctctttccacttccttattgcttccctgggttggttggcatagttataatggcttgacgttgaggtcctgtctttcttctggggtctcagtcactactcctcactacgtatggtctccaagtcatgttcactgtcactttgggagcattactcctcattcccactcctagtggaatattaaatccagtattctcccagacctctgcaggctttcaaacttatcactcttcatttaaattcattcttcgtttctcacatctagttatatattttctctgatacacctagtaatgtattgttacatttttagctaccatttctttgtgtctaaagaaatagggcatttgttttagttctgacaaccctttatgttaagggtcaatagagccatcgaaatgtttttctctccagattttattcatcagaaaggctgctttcctttaggaagttgtcccacaaaatggtttccataaattcaatcaattggtaagacagaaggtctcagttgaaaactatttcaaatgcaaactactaaaaccatcagggaggtaaaaatctaatgtttcttgtcaactatatagaaaaatatgtttttgtaaacaattggttgagtttaaactacaaaaaactacaaataagaagcattacaactatttagacatatctctacttactatagaacctttgctgtgaagagctaatctcatggtaatattttgccaagatgatgaaataaaatgttaacttaaaataaatatattttatttggctaccattgttatttctctttttttctggagtacactatcattacatttctttgcacctttaacagggaaattttaggacatgattatatgcatgagccctgggtcacattttaagccacaaaaccagaaagacaagatgtttctaatgtttgatgctgtcccttctattcaactgccatatatgctcatatattttaattttttaaaaatagagacaaacttccactatgttgcccaggctggtctttaagtcagacaaatgcaattacttgattccaagatggtagattactggtttgtttacaatagagagaaactaggaaacaaaactaaatatttaaacaactatgggacatctaaatgacagaacgttatgcaactattaaaacaatgtttttgtagagaattaaatgatattagtaacttatcataacataatatcaagcaaataataggacatacaattgtattttgaagaatatgtatatgtgtttaaaagtagcaaaatgcaacatagtataattttagaaatgctaataattcctaggtcattttaggttgccttgtgttatcttgtattttctttccatactttgaaagttttctacagggaataaaaattacttttataataaaaatccaagaaaaacatattggtgttctgatagcaaagtttaaataatcatgaaggcagagttcagacttttcaagaccatgctgcacagaattatgagtgacaacaacatgggttatgccacaaagaatcagctgtcaaaaagaagaggaaacaaatatatcaaagtaggccagaaaatttgctcatcagtgctgtctgctagaactttctgtgataacagaaatgtggtatgtctgtgctgtccaatatgatagccattagccacatgtggctacagagcacttgaaatgtgactaggagatgaaggaacagaatttttaatttaatttaagtgatatttaaattttttaatttaaatagtcatatgtaattaatggcttccatgttggacagcacaaatctccttcgtcacttaagggttattgcctattcattagtgggaagaataatatatttatatcaatgatatgttaattatatattaaaaataaataattatagataattatagttggcagaactggcctagttattttccccacaacaatgctgatcttcctatgatgagtccaagattttgcaacatttggcttttgctatggtttggatatctgacccctccaagcctcatgttgaaatctgatccccatgatggtggtggggcctaatgggaggtgtttgggtcatgggtacagatccctcacgaatggcttggtgccatcctagtggtaatgagtgaattctctttttagcaaccataagagctggttgttaaaaagagccttgcactttcccacctcacttgtgcttcctctcttgcaatgtgatctctgcacgtcagctctccttcaccttctcccatgagaggaagcagcctgagggcctcaccagaagcaggtgctggtgccatgcttcttgtacagtctgcagaactgtgagccaaataaacctcttttgtttataaattacccagagtccgctattccttcctagcaacactaaatgaactaagatagcttttaattacaacggtggcatctgttactactctgcattctcatcttcattccaggtaagtaaattttaagttttggcttctcttagttccaagacacaacataagtcattccctgtttttgggaggagagagtcaggatggagaaaagaataaaatttattgaaaatttaaaattaagataattaactatgtgaactaaaagtgagtaatataataccttctcccagaaaagatcaggacgggagtgttacaaagctttgacatttcttaaagtgcactctgctgcattttgtgtgtggtctatgtgtaatagctcatcttcaacacacacatacaaacacacactcaagtgtgagaataaaattaacttattttcttatgtaattttggagtaagtttatttagagtcatatgttttgtatttttattgaaatatatgcttgttacctgcagttttgtaaaaggatagcatttattctctctctcttccttcctctgtctctctcaaattgcccagagggattaatcaacagaaatctaaattttagaaaacctgctttaaaagagtacttgttctctattttgagtttatgggacaaatgaaactgttctttcaatgggtgttggcaaagaaggtctggaaaagtttatatgaattgccaagcatggaatattgatcattagccaatcaagctggatgatactggacattatacttagtccacagaagaataatataggtatatggatataaacatatttttaaaatgttgaataagggacagttcagatctttttcaatttcagttcataatgcatggtattttcaatgctccatgcatggctaaatacacaaacatcataaatgattctaaagcatgatagggtgcttgcccttaaaaattaccagtagctaacacttttgccagttcagggtacaaaaaaaataaagaccaggagatgctaaaatgatccatatcactatggttataaactttgaaacttacaatgcacaccttaaaatcaaagtttccaaggaaaccaatgaatatattttaagacaagaataatatgatttgcaaatcaaaatccatttaagactgttgccacagcactatgtgttgattggtgcttgccatatttttttaggaagtcagaaaaaaaaatcttatgttccatgaatccagcaataactaagactgcaaccctgattttcttacccgtctgccttgttaacatgatatatgtcaaacataatgaagaatatgtaaaagaacccttgttaccaacaaagattttgcaatatcttcaatacagagaatagaagaaccagaaagaagcagcgacaggtaggcggagagaggaagggaggaaactactgactgagtaaccatgtatgattgggaataaaatgggatctcaaaatcagattccattttgcacccaaccacaactgagaaaactgaggctcaaaaaagtgaagtcattgacacaaggtgttgactattaattgctgagtcaggatatgaagcccagttagtctgattccaaaacttatattcttcctggtggatcagacagaaggaatgggaaaatgcaatgcactcagggtgctcagtggaagcgttggagtgtggagttcaagtcctgagcgaatgtattcctggataaagaattagtcatcaggggaaggtcatgctggagctacgctgaagggtaaagtttgtttttggactctacctgtttcctctccttggctctaagatgacatgcaccagggatctcacctctaatcccgccattgcatgaagagaatgccttgcacatgactagatgctcaacaagtatttgtaaatgtgcatcttaaaaattggtcatgtcagttacgatgtgaaattcaccagtgaaaatgctagctggggctttgaacctggagctactaatttcccaggttccatctcataccatctgcccggcatagtcctaccacccatattgccacactggttttagcagggcaatcctctgaaagtatttttgctacagtggcttgaggcatagtaatactagatggagactaggaactctaagcaaatatctataaagttcacaacaaggctgtgttgatcactctggaaagaggtggtgaaacgattctctttgatgactcctcctgtgtctgcgtatctgtgctttggatagcccacacaggtacatcattaaatgccctcccagggtactgcaccagcctttgagcaggatttaaccttcagagtgcactcagcaattgcaaagtagtgtgctggtgactccattcccagacgtccctcttgacacactgaactctagagtgtttcatctcgtggtatgaaccaagaattggaacagtcacttgggcagagggattctaggtcctccgtataacctaagcaaagacatttttcttttccaagctagaaaaacatgcctaaaacagaaataagtataagcagtctttgcaagccttaccatttctacctccctctggggaatccaacctgtggtatagcactggacctggacaaatagcacagtgatctactaggagtacaatgtgttatcactgttgcttttattataacagctggcagctggccaaagctttgcaaagaaaccagaaagcaacagcagggcactgggctgccttagaaaaacatttcttggctcaaagaggagcctctttaacaagaacccaacacctcaaacctagcaaaaaagcatagctcaggtcaatcacataaaacacagcttcacaaaatctgtcccataacaaagctagaaatacaatggtgtaataaatttggtatacctaagagcctgagaaaaggtacagctgcttaagaataagttatagaaaatctttgttaaatactctagggaaggattcaggcatcttcctacttatctaactttttagtgtattctaaacttggccaggaaggagaggtgtgatcttggcttggtgattcctgtagatctccggactttggctgcctcacctttacctgaaactgttgaatgggatgctagattccctccagctctgacattccatgactaaagaaagtcaaggtttaacactgaccttgacatcctggggcaatggagagttttagtgtatgcaattgtcatgcctgaaaaaatgtcaaaacatggttagggttcctctccttgttcaggagaataaaatagtatattttaaatatgctagtataaatcttataaataaaatagtataaatctcccttctgttaagagaatgtagaaataaaataaataaaatactaaatactaaatagtattagtatagtaaatagaaataaaataaataaaatactaaatcgtagaaataaaatactaaatactaaaataataaaatactaaagtttgctcaaggaaaagatgaagttagatatgtgtttccttttaaggaggttttcatgaaagaattttttttggcagatcacttgagcttaaaaggagtattgttgtttcagaaatagcacaaaaagctgttccccaacaagggatgcagcagaggcagaatgtttaccacctagggtgttagtgaaaggccctgtctctaaacatcccacgttgagataacttcaatgtttgatcaaaaagtaaatcttatcccgtaataagtgagcaacgttctgtttcccctcacccctcaatattgaagcaatgacaagataagtcctctcctgtagacacatttaccaaccaagtgaaacatggcgtcttgtcggccttaaccgctagacttgagagaatggaattttcatgaaataagagtgccgatccataaaatacatgccattcgttttgatttaaattataaacaatcttatccatggtcttcttttatttttattttttaattttcccttccattctttgatttttaaggagtctccttacaaagtcagaacagtttttgtttttaccatagccaccatggttaactttttctttagaaaaatgttcagtgatatccaagggcagaaaaccaaacaccacatgttctcactcgtaggtgggaactgaacaatgagaacacctggacacagggcgaggaacatcacacaccggggcctgtcgtggggtggggggaggggggagggatagcattaggagagatacctaatgtaaacgacgagttaatgggtgcagtgaaccaacatggcacatgtatacatatgtaacaaacctgcacattgtgcacaagtaccttagaacttaaagcataataaaaattaaattaaattaaaaaaagaaaaattttcaatgaaacaaatgcacttcctgaagttactaagcctacacaaatgaatgaatgaacgaatgtctttcctgtagttcttaagcccacatgaacaaatgaatgaatgaatcaatcaatcaacgtctttcctatagttgttaagcctacatttacgtaaaggggagttgctcttacactgacactgtcaaaaccctctacctcccttccactccctccctgccaggtaaaagctccacctaagatagaaggcaacccaggttccaaagtaattcctccctcacctgtgaatgaccagaattattatcctctaagtgcttctattgtcacttgaaaaaggtacctgcttacctgattcaattaattcacaagaaaactaggaggaccgcttggtttacccaaggaattgggactaggaaagtttgttaatgtgaacaagccacctaaatctgtgattctcaaagaaagacctgaattccattgctctgaggactagaaaacagcccagggctgcaagtgtttccttcaggttgcagggaaacaacatgcaaaaaggttatgctaacatttggaacgcacgaactaaatttgcttgttaataaaatttcctgagacctctaattcggactttcctagaaagtctgcctgtcacatcatacgcagcagaatcacaaagttgtgaatgcacacgtccttggataattgggattccagtaattttccattccaagaggatgttttattactgctcctcagtgttctgagttggtcatgattttcagagactgatgtttatgaatttaagttgaaaatttatgtttatgttatcctcatcaatttagtttgttataagttgtttggtgaatcccatacagtgcaatgaagcatatttgcatcaatgacatttctagactataaacttccaattatttcaccaataaaatatgtatactttacagtacaaatgcgagttatccataccccatcttctgaaacaaatatgtctgttttccttgtatattcccacccctagtctacaattttgcctatatagtgtcactttattattatcgctaagttatttttctacctataacttacctagagtaagataacacagccatggaatcttttaccctacctaaatgtgtcataacaagatgtctttgaaactcagctctaaatgctagcatggatggaaaactatggttccatttgcaaggctggcttacagagcacaaggagatacagttatgaaagggctggactacgacagaagtagtaggccaatagatctatatagtcagctttttgtcatgtaatttattaactatgacacaaatgcatttaagaatatcaagtatttctctggctcttgacacagttgacttaaccttttgctgtctaaggaactgaggctttcctgttctgggtgctactggcaaatgttctagtacttgaagtcgggatgcacagcttcaaccactgacttatcagtgcagccacctgtgtattgcaactggccattaaattaaacaccgagccacctgggtttagttcggtcacttccataagtgtatttagcattggtagccctgctttattaaagtgcagcagacgtgctcttctgtcccttctgtcccttctgtttgtggttctttgggaaagttctgatatttgcttttgttttgtgcttgctttcgtgtttttatatcttgtatttatccctgaacatatttcgaacatttttttaaggaaagaaattcttttgtgtatatatagatacttgcatgatatactgtcatcaagtttcggttcctcaaaaggtcttggagctgtcaggtgtgatgtactccaaccatcaaagttctgtggaacacggtttgtatgtaaataaatgtggggcgtttggcccttgaaaccggaagacattacggtaggtgaaataagccagaaacagaaagttaaataacgcatgtgctcattcatatgtggaagctaaaaaatagttgatcttacagaagcaaaaagtagaacagaggaaactagaggctgggataggcaggaggaagaggggttagggagaaattggttaaaggatagaaatttagagctagagaggaggaataaattctagtgttctgtagcactgtaacatgactatagttaacaataatgcatggtttcaaagagctagaaagaggatactgaatgttcccagcacaaagaaataatagtgtttgagataatgaatatgctaattaccctgatctaatcaccgtatattatatgtattgcaacatcactatgtaccctataaatacatacaactattatgtgtcaattaatttttttttgagacagagtctcactctgtggcccaggctggagtgcagtggtgtcatctcagctcactgcaacctccgcctcccaggttcaaggggattctcatgcctcagcctcccaagttcctggaattaaaggtgtgtgccacaacgcccaactaattttttttatttttagtagagatggggtttctccatgttggtcaggccaggcaatgatccacctgcctcggcctcccaaagtgctgggattacaggcctgagccatcatacctggccaattaaaaaaaaattttttttaaagaattctctagttcattcctactatattctgggcaaaagctaaacatctgtgccagacgcatttattgtctttctctctctcaatctctctcctttcattgaagcttccctttaattcccaaataaatccaactcccttccatattgaacaccataccactgactcagcatcatttacatcttgcagggaggttctttctctgtctttttccccttatctattcatccatccatccatctctttctctcatttcattgccaaatatttgggaaagcagtccaaggttactgctgcctttgcttcttcacctctcatcctctccctgaaatctgatctccctacatctctcattttctctcttgattcttcttctggtgatttcttcttaaatgttaatgttctctaggttccaacttgggccctctttttgtcttagtctacatgtcctctctgaatgatctcatccacgaccatggctttaactataacctgactctagtgattcaaaaatctttctgtccaacaccaatctcttgtctttactttagaattggatagccactgcatactgggtgcctatagctaaacatccagctatctgtaagtcttgtaaacacaacaacggtatggaaatccaactgaaaaacactcatgcccagtggaccatgaatttaaggcaagtctgatggtgtgagaaaagcataaaacccagtcagaaaccttgggttccaatcccagctcaattgtttttagtcatagggcaggtcctctatctatctgactgtgatttttcacttgtagagtatggcttactgtactttaaagattttctggccgggcgcagtggctcacgcctgtaatcccagcactttgggaggctgaggtgggcggatcatgaggttaggagatggagactatcctggctaacacggtgaaacctggtctctactaaaaataccaaaaaaaaaaaaaaattagccaggcgaagtggcaggggcctgtagttccagctactcgggagggtgaggcaagagaatggcgtgaacccatgaggcggagcttgcagtgagctgagatcgtgccactgcactccagcctgggcgacacagcgagattctgtctcaaaaaaaaaaaaaaaaaaaaaaaaaaagattttctgtgagggattaaatcagataatgtatgtaaaggtgtgatgtaagctggtaagtgttattccaatttctgatatgctattatttaaaatgtagttggacaagcaggagtaacatttaaaatgagacaaaaagtacaagccaccagaaatgcaaatatcaaattaatttgtcccagtaaactaaatataaatagtttttacactttaatgtacatctgaaagagcttattaataatgtcaatgcttgagctacagcccagatttaattggttgggaaagaggtcagtaatctttacttcaaaatcattccaattgtcacaggcaagtcagggccacacttcaagaaatagtgaaatataatgcacttgagggatggtcaatcctcaaaatattctaaagacttgtaaaggcttcagaactagttccttcttgagaagcacattgcttcttttgctgagttcaaattgtaatgaatttcaaggcttccaattctgggcttcttacataaagcaatcattccttcctcactcccaacacaaacacataatttttaatatataaataaatatatatatttacatttgcatattctgttttcattaatggaatttttttcctgtatactacatgagtaataatgtaaagacacgaaataaaacagacactaattaggcatgtttgaacatctgttgctaccaaacattttctatttctcttttcatatctctgctgatgggtttagatgaaaagactacaagcctgcatacttacagggaggaaggagccaaactggaaaaccagtagcacaggtcggtaggaattaatctcagcaggctcgcttcagcattcggagacacaaccagcaaaacacttccaagctggtggctcagttaatatgtgaagctatttttagtacaacagagagcatttctagagattgagattataaaccagggatacatcccaaacatattaatatggttttaattttattttacagataccatgtttcagaatattttaatctccatgtgaataattgtttttattttgtatgtatgcatgatgtaagtatgcatacagtacatttatatgcacgagcattattcatatacatgcatacctacatgtaaaaatctgggtaagagagtaaatcagatgttttagtccttgtatatataaggtaaaagccagaccttttaatgacttacacatttgatcaggaagttttgtgttttgaaatgacaaaaacttggaatattttcgaaaggagtagaatactttcggccataattttcatttttaagatgccttaaatgttttagttccttttaataaataatcttacacaatgagttggttctcactgtcgtattaggtaaatgggttttgttgttgttcgtttttgctaaaatgggttttgttgttttttgtttttgctaaaacgaaaaaacttcctttttattaaggaagttatatgaaagtccatcacttccacaaattaggaggctacactactgcaatttggctgaatcagtggatatttttaatgttgcttattttgtgctttaaaattgcagttatcccagagcatctgtaattttgttttttttttattttgaacaaactgttatctgttaaattaacaataagaaaaatgttattttatctatgtttattcattcttcaaaattcttccttttgttttttttgtttttttaattttcttttttttattattattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccacaacagaatgatgatgagatattcctggtaagatgtaatgttttatttttcttcctggatctatctctgatcttgttccagggcacatcaatttagaaacactcatcgattatgatagctttgagaacaaacattggaacattaacatgctaattttgttctttacaggttgatggtagaaaatgtataaagtttaaaaacatgcaagtcttattagcattctgcttagataaatacaatcttattttatttctctctccttttattcatgccctgccaattgagagtgccaggtttctctccttttctgtttcacagcagctccaaagctaaagggaaaccaaggtggaaaataattaccccaaaagagacattttccatgacactaatggctggatttcagatactttccaaagctcattggaaagggagaactcatggagaagaaacaaccaactttaagtatcccattactctcagaggttgactcagagcctattccatgtagaaatactgaagagggtgtaaaaaagaacgaaaagcagaaacaaaataaataaataaaaacaacatagtcatgctttgtttatccttctttcccttgcaaacatctgctctctggagtctgctctggcatttaaggagcttggaagtcatccctcccatccaatctcacaaagaaaaaaaaagctgaagaagtaaaaaccaacaattcctctgaaatccctcagaggattgatgtcagagggcaaaccattgaccccatgattggagacaaagacagaaatgtacagagaatcatgacctagagtaacagaaacctttgggaaaaccaacattgggatagaaaaacttaaactgcaactgattagttgttcgaggctcaatgtggattaatttgagcattaaaaactcctttgaggatcagggagcagttttaagggggctaccacacatttgtgacttttacttccaggagccctactaggtttgcacaatgagggtcagggagaaatttcctaatgcttccaacaaggaacagggaaaaagtaaccattccgaaatacacccaggtcactctgttcttcttatggcctgtctcaaaagaaactgtattacccagagcccaacagactgagattatagcagagcctaaaccaccggggagtagggaaatatccaactccagcccctctatccttcccattgcacctaaagaggaaaaacccccaaaacccaaggagcacatgtggagatcatggcccaggggtagaggctcactgtgggactgggtcctaatcatcagattatacaaagcatcccccttcccctgcaccttaccacaataccagtagggctcctgtataataacagatgaacgcaacggaaagaactgtatgacccatgccttatttaagaagaagtttctaggaaaacccaaagacaacagcggggaataaaaacaaggacatcagaggagatgttagcctctaaagcctctagctacagcaaacagtaaacacagctcaattactagccagataaacataaaacctcacagtaatggcctgtatgcctcatttatttagtacatcacatcctactgtcaacaacaaaaaaaattccaaggcacactaaaagacaaaaaacacagtttgaagagtcagagcaagcatgagaaccagactaaatatggaaaatatatgggaatcatcaggtatgaaattaaaaggaactatgatgaaattcaagaaataaaaaacataatagaaatgaagaatgaaaaattagttcatcaatagactggacatgattgaggaaagaatcagtagagtttggacatgtgtcaaaagaaacctccaaactgaaatacaaagagaaaaaaaagtataaaaaagacaggaaatgtcaggcgcagtggctcatgctgtaatcccagcactttgggaggccaaggcagtctgatcacttgaggccaggagttcaagaccagcctggccaacatggtgaaaccctgtgtctactaaaaataccaaaaaaaaaaaaaaaaaaaaaattagcacatggtggctcatgcttgtaatgccagctattaaggaggctgagcatgagaattgcttgaactcaggaggcagaggttgcagtgagccaagatcatgccattgcacttcagcctgggtgacagagtgagacactgtcaaaaaaaaaaaaaaaaaaatagagagagaaagagaggacagaacagaatgtctaaaaactgtgggggtaattataatataaaaggcataacatacatgtaatgggaaaatcagagaagaaagaaaagaacagaagacatatttgaagcaataataactgagattttccccaagttaatgacagatattgttatgagcttaattatgtcctcctgttcccccagcctcaacttatgtcaaagccctaactcccagtaacctcagaatgtggctgtatttagagataaagccattaaagaggtaatgaaggtcacatgagatcataagggtgaggtcccaatccaatatgactggtgttgttctaagaggaagagactcaggagatgggcctatacagggaaaaggccatgtgaggacacgggaaggtggccttctgaaagccaaggagagagcctcaagagaaatcaatcctgccagcaccttgttcttggacttccagtagccagagcacttctaccctcatatttattgatgagataataaatttctattgtctaagccatacagtctgttatattttgttatggtggctctagtaaaggaatccaccaagccacacaacaaggaaactcaaacaacaccaagcacaataactatcagagcaaccacagacatatcacattttgacttcagagaaccaaacatgaagagaaattttgaaaggagcgagggtggatgggatgagggaaaccttacctggagagaaaaaataaaataactgctttgaatttctcatcagaaaccatgcaagcaagaagagagtggggtgatagatttaaagtctctaaagaaaaaacccattaacctagaattctgtatcttgtggaattatcaaaagtgaaggaaaaacaaagactttcttagaaaaacaaaaactgagagaatttgttgacaaaagacctgccttgaaaagaatgtttaaaaacagttcttcagaaaaagggagaatgatataggttgaaactacataaagaaaggaagactattagagaaggagtaaatgtacgtcaaacaaaatctctttatagaaagtttcttaattgatctgatggataaaaaagtgttcaaaatgataccagcaacaatgcaattggtggttatagcctaaaggaaaggaatgacagcaatattataagagataagaaggagaaagtaggaatactctgttatgggatagttgcattacatgttaagtgtacagtgttacctaaaaatggacttggattcgttgtaaatgtatattgctaactctagaaaaactgtaagacatttaaaaggaattataattgatactgggcaaaaagggaaaacagaattatataaaatgttcatttaaaatcagagaaggcagaaagagacaggaagacaaaaggaaactaatataaaacagttataaacattaatgtaacagttatagatattaaaccaacaatattaataaccactttaaatgtgaatgatatacatcaagtaaaagacagggactatcagagtggatataaaacagaaccaactatattctgtttagaagaaacttgctttaaatacaaagacacagattaaaagttaaaggatgaggaaagatatgccatgctaaaactaatcaaaataaagctaaattagataaattaatttcagacaaagactctagaaaaaacatttttcagggataaatttcttttattgcataacaacagaaggttcaattctccacaaagacataacaaccttaatgtgtatgtgcttaacgacagagcatcaaaatacttgaggtaaaaactgacagattacaaagagaaatggatgaacaattactatcactggaggcttccacacacatatatctgtggttgacagatctagcaggcagaaaatcaggaaggacagaatcaaactaagcagcaccatcaatcagctgaatttaatggccatttatagaataattaatgcaacagcaacagaatctatagtcatctcaagttctcatgacatgcaccaagatagaccacattctaggtcataagacacaccttaaaaatgtaaaagaatagaagtctttcaaagtatgatctcaaacaatagaattaaactagaaatcaacaacagaaagaagctggaaaatctcaaagtacctaaaaattaaacagtacacttctaaacaacacacgggccaaagaagaagtctcgggagaaattttaaagtatttcaagctaaatgaaaatgaaaatacatgttatcaaaattcacaggatgtagtgaaagcagtgcctagaaggaagttgaatgcatatattagaataaagaaagatctaaaatcaataatctaaattcccatcttagaaaactagaagaacaaaagcaaattaaatctaagccaaacagaagaaaacaaataataaaaatcagagcagaaatcaataaaattgaaaatcaatagagaaattcaacgaaaccaaaatctgggtgcttaaaacaattaatattgatgagcctctagccaggctaattaagaaaaaaaaaagaagacaccaattactggtataataactgaaaaggaggccatcactgctgatcccctttatcctaaaaatagtaaaagaatattatgaacaactcaaccccacaaatttgataacaaatttttggttcaaaaatttgaaccaagtttttgaaagatacaatctactgaaactcacactaggagaaatagataatctaaataggcttatacttattgaagaaattgaatcaacaataacaacttaccaaaacagaaagccaccaagcccagataacttcactggggaattctaccaaacatttgaggaagaaataatactccgtacaatctcttccagaaaatagaagcagaggaatattttctaactaattctacaaggccagcattactctaataccaaagtcattaaaaaattaccaaaaaggaagactacagaccaatacttctcataaacatagatgcaaaaaccaccaacaaaatattagcatattatatccaacaatgtataaaatattatacatcatgaccaggtgatatttattccatatatgcaagaatggttgacaatttatacattaattaatgtaacccatcacatcaacaggctaaagaaaaatcatgcaatcatatcaatacatgcagagaaatcatttgccaaaatctagcaccagtcatgataaaaacccttagcaaactagaaatatagaggaatgctcccaacttgataaaaaaaaatgcctacaaaaaacctacagctaatatagtacaaatgaaaagtctctcttctccctgccctcatgcctaagtcagagtctcctaaagaaccgaacagctgaggaagctcttcattggagggctgagctttgaaacaaggtgagagcctgaggggccattttcagcaatggggaatgctcatggactgtgtggtaatgagagattcaaacatcaagagctccatgggctttgggtttgtcacataggccactgtggagaatggggatgtggccatgaatggaaggccacacaaggtggatgggagagttgtggaaccaaagagagctgtctcaagagaagattctcaaagaccaggtgcccacttaactgtgaaaaacatatttgttggtggcattaaagaagacacagaagaacatcacctaagagattattttgaacagtttggaaaaattgaagggattgaaatcatgactgattgaggcaatggcaagaaaagaggctttgcctttgtaatctttgatgactatgactccgtggataagacggtcattcagaaataccacactgtgaatggccacaactgtgaagttaggaaagccctgtcaaagcaagagatagctagtgcttcatgcagccaaagaggtcgaagtggttctggaaactttggtggtgatcgtggtggtggttttggtgggaatgacaactttggtcgtggaggaaacttcagtggtcatggtggctttggtggcagctgttgtggtggtggatatggtggcagtggggatggctataatggatttggtaatgatgccagcaattttggaggtggtggaagctacaatgattttggcaattacaacaatcaatcttcacattttggacccatgaagcgaggaaactttggaggcagaagctctggcctctatggtgatggaggccaatactttgtcaaaccatgaaactaaggtggctatggtggttgcagtaacagcagtagctacggcagtggcagaagattttaattaggaaacaaagcttagcggaagaggagagccagagaagtgacagggaagctacaggttaccacagatttgtgaactcagccaagcacagtggtggcagggcctagctgctacaaagaagacatgttttagacaaatactcacgtgtatgggcaaaaaacttgaggactgtatttgtgactaattgtatgacaggttattttagtttctgttctgtggaaagtgtaaagcattccaagcattccaacaaagggtcttaatgtagatttttttttttcacccatgctgttgattgctaaatgtaatagtttgattgtgatgctgaataaatgtcttttttttttaatgtactgtataaagttagtctgctctgaagccatcttggtaaatttcccccaacagtgggaagttagaattccttcagggtgatgccaggttctatttggaatttatacacaacctgcttgggtggagaagccgttgtcttcagaaaccttgctatagttgaactgatagttactgttgtgacctgaagttcaccattaaaaggaaatagccaagcaaaatcataaaattattggttataaaaatgagtgttggcacatcttatgcaatatactaaattgaataatggtaccagaaaaaactatagatgggaatgaagattgtgtaacatctattatcatgtgtaatcaataaatgatttaattctcttgaagaaaaaaaaaactagatgctttcccactaaaataaggaaaaatgcaagaatgtcccctctcgctactcctatttgccattgtactggagtcctaggtaatggaataagacaagaaaaagaaaaaaagggtatatagtttgataaggatgaaataaatctttgttcaggaagacatgtttgtctaggtagacaatctcaaagaaacaacaacaacaaaaactcttagaactaagtgatcatagcaaagttgcagggtacaaaaaaagtcagcggttttcctatgtaccagcaatgaaaaattgaaatatgaatttcaaaacacaatactatttatgtaagcagcaaaacttaggcatacatctaacaaagtatatagaagatatatattaataagagtacaaaattcttttaaaagaaatcaaagatcaaaatcaatggaaagacataccaaatatgtggataagaagactcaatattattaagatgtgagttctttccaacttgacctgtgaattcaatgcaatctccatataaatcctagcatactttgaggatattgacaaaccgattccaaagttgaagtggaaagcaaaagacccaaattacacaacacaatactgaaggaatgcaatgacagagagttgacactaccaaacttcaaaacttactataaacctatagtaatcgaggcagtgtggtattggcaaaagaagaaaaaaaataaatcaaggaaaaagaatagagatttcaggaagagacttagacaaggtagaaaaggtaatcgaatggagagaagatcctattttcaaaaaatggtgctggaacaactagacctctacatgcaaaaaaaataaatatagactccagattttactaatttcacaaaaattaacttaaaataaattatacaactaaaaataaactgtaaaactataaaacctttagaatataacataggagaaaatctaggtgaccttgagtttggcaatgactttttagacacaacatcaaaagcacaatctatgagaaaaaattgtaagttggaatttattaaaatttaaaactttgattcttttaaatacaccattaagacactgaaagacaaactacagactgggggaaaatctttgcaaaacgtatctgataaagcactggtatccacaatatacaaggaactcttacaattcaacaataagaaaacaacacaattaaaaaatcggcaaaatataatatctgaacagaaaactcaacaaagaagacgaacacttggcaaatatgcatgtgaagaggtgctcaatatcatatgttattagagaactgtaaatttaaaaaacaatgagataccacatctattaaatgactaaaatccaaaacattgaaaacactaaatgctggtaaggatgtggagcaacaggaacttgcattcattgctggtgggaatgcaaaatagtgtagccactttggaagactggaagtttcttacaaagctaaatatactcttaccatatgatccactttcctaggtatttgctcaaatgaattggaaacttatgtcttcaaaaaaattctgtacatgaaggtttatagcagctcaactcgtaattgccatatgtggaattgattaagatgttcttcaatgggtgactggataaactatggtatattcataaaatggaatattcagtgataaaaagcaatgaaatatcctgccatgcaaagacatggagaaactataacaaatcttgttaagtgaaagaagaaaaggctctacactgtgtaattccaaccctatgacattctgtaaaaggtaaaactatggagacagtgaaaagataagtgtgtgccaggggttagggtaggggtatggataaataggcagaacacagagaatctttagggcagtgaaactaaatggtggataaatgttatacatttctgaaaacccacagaatgtataacacaaagaattaaccctaatataaactatggacttttgttaacaattatgtattaatcttggctcattaattgtaacaaacatactatattatggtaagtttttaattataggggaacgtataggtggtactgaggcattttgttggaactctctgcatattttgtttaattttctgtaaactttgagattctctgaaaaaaatgaagtccattaatttttaaaactctgctccctagaacatgattttaggagccactaacacctggcttcaaaaacagacatgcagggatggattcattaaaagtgaatgacaaaggcttggaaagttcttcagaggacaataaaatagaactgtagaggccctcttacagctcttataaaacaagcaactgtgtaaattaaatgccaaatggaatccagatgaaaaaaaaaaaacacacacaatttgtcttaacggaatggatatatttgaaagcactgcaatgttttagataaagaaataaataatgtctacttttagaaaaatgaatttctttcactttccccaatatcttaaattctcagttttctaatattatagataatggaattattaatggattatgcagatatttaaggcactgttattttatcagctattcaaggttcaagacacagttctaaagtcatataggctattaatttggttttatgtgtttatttcaaaattcttttaaattagttcaccatgtatttgatctctttagttggtcataaatcccttgtcatctcttccccaaaacaaaactttggatatggcaagctttctaccaatggtaactgaccaacttaaaatctgtccctgaaggaaaaattactatttatctcaaatctgctataattattttatgtcagcctacaattgctgtggttggccaactagaatactttctttttgctggcctcttattatcatgtatgaaagatgtattgattctcaacatccttttattattactttagtatggttttggcaagtggaacttcatcttgtctagttgtttgggagcactagctacagtctttctccatgggtctgaaaaccttcacaacatactggagaaaagacaggccttccattgaacatttactgaggcataaatcatcaccctacaagataatgcgatgttttgaacaactttaattgtttaaattgggaggttcttatgtggggaacaaatttttccttctgcaactgtcatatgttggttttgccatacacaccagaaagtctgtatctctcccacacacatctctcccttccatactaaatatgtattttttctggctaaatattccttgtccttcaaattcaaaatttaatccaattcaaaaattaatgtggttaccatgatcttgacaaaatctacattgtaattaaggtcttttaagatagcccaagaaccaaatgtaatattaattgtattaccactaggatggcgtgagtgatgcagtcacctcaggtgcaaaatctaagggagtgtcaaaaaactcggtaatcaaaataaataatattttaatgcaatatttgcaaaaataacattaatcaaaataatattttagtgcagtatttgaaaaaaataaaaattaatgcaaaaagttcaaatggacaaggatttgggtgtgatgggtgagatgagtcatacaagtaagtacaggggaggctcctgtcttttttggacatttcaatttcttggagttaaaatcctatttggatattagagattcaacccttgaaaggagccagcctaaagacattgttccatttgtactcatttctttttttcaataataattttaatttttagtttagattcagggggtacatgtgcaggtttgttacatgggtatattgcatgatactgagctttggggtatgactgatcccaacacccaggtagtgagcatagtccctagtaggtactttttcagcccttgcacccctccatcattccccccaccagtacctgccagcgtctattgttctcatctttatgcccatgtatacccaatgtttagctccctcttataagtgagaacatgtggtatttggttttcttttcctgtgttaatttgcttgggataacagcctccagctgtatccatgttgctgcaaaggacatacttttattctttttcatggctgtgtagtattccacggtgtatatatattacattttctttatccagtacactattgatgggcacctatgttgatttcatgtcttcgctgttgtgaatatcgctgtgatgaacacataagtgcacatgtctttctggtagaataatttattttcctttgaatatatatccagtaatgggattgctgggatgaatatagttctagttttagttctttgagaaatctccagacaactttccacaatgactgaactaatttacattcccaccaacagagtataaacattctgttttctccatagccttgtcagaatttgttatttattgattttttagtaacagccattctgactggtgtgagatcgtatatcattgtggctttgatttacagttctctgatgatctgtaatgttgagcattttcttgtatgtttgctggctgcttgtatgtctttttttgagaagtgtctgctcatgtcccttgcccactttttaacgggattgtttcttgcttgttgtattgtttaagttccttatagatttttgatattagacctttgtcagatgcatagtttgcaaatattttctgccatcctctaggttgtctgttaattctgttgatagtttcttttgctgtgcagaaactcttcagtttaattaattagttttatttagtttaggtcccacttgtcaattttggtttctcttgcaattgcttttgaggacttagtgatgaattatttaccaaggccattgtccagaatggtatatcctaggttttcttctagggtttttatattttgaggtcttatattaatctttaatcgatcttgagttagtttttgtatatggtacaaggtagcggtccagcttcattcttctgcatgtggctagccagttattccagaatcattattaaataaggaatcctttctccattgcttatttttgttgacttggccaaagatcatatggttatagatgtgcggctttacttttgggctctcaattctgtttcattagtttatgtatctgttttgtgatgtgtataaaatggtcatttctaggaccctttgtgtgcaatgtgtgtgtccagaggtaccagtaaaaaccctgcctcggcttctgtttcagtttgctacaactgacactgtctctacttcttaccaaagctctcttgagttttcctgtgcctttgtctcgagcccacactgcaagtccttagtgctggatctctcttgatgagcaaatacatctgggaaagcccatttctgactccactttaactggcttgaattagaatgctttttgtacttgcacacaaaataccagaaatcttatccaacttgattttcgaagaatggagtttataaagatataggccttttagtccgtattggcttgtcttagttattgaacagaatcaaaacattccatttttctataaaaccaagataattatgaaaaagtagtttttcatatcaactgatctattgaggcttatgttcagcagaacctacttggtaagtttaaactggggatggaaacaggtcaggatactaacaaaatgaaataaactggttttttttgttttgttttgttttgtttgtttgttttttgagatggagtctcagtcaccaggctggagtgcagtggtgcaatctcagctcactgcaacctctgcctcccaggttcaagcgattctcctgactcggcctcccaagtagctgggactacagacgtgcgccaccatgcccagctaatttttgtatttttagtagagacggggtttcaccatgttggccaggatggtcttgatctcttgaccttgtgatacgcccacctcagcctaccaatgtgttgggattacaggcgtgagccaccgcgcacagccaataaactcttctttaacctgccttatgcaataaagtccctgtgccccaaagttgtcttagaaaagacagcctaagtagttactgtgctttggacttcacagcccaagtacatcacaccatcaatatcctctttaaaagccgggagtgaggttttataaaagtatgctttaaacaaatggcagcaggaaattcaaagttgggtaattcatattgctgctataatttgtttgcacctaaaaagaaaaatcgtagaaaatgaagcatcattgcctgcaggtacagacacgtatggtgtctgagatcattgttattctcttcctctcatttttctcccatatcctcttaatggaataattacattattgtaatttacttgtatataattcaggcaagctaagcacaaccaataatatgtttcttcagaggaaaaaaacccaaacataataattaaagaataaattagttactgtaagtagcaagtattccaggtttggggagaaagtgtaggagatgatcccctcagaaatggacaccagtggatggtaacatgtgtgggaacaagagtgattccatcttggatgctaatctgccatgttggctcctgattaaccctgagtctgggaatgcctccaaggtgtctagttgatgatttactctctatgtagaaacacttatttactctgagttacacctttcctccacaacaacccttgatcttgttgcatacattacccgtagctgtaacacccatagcattctctcggccacccactcattccttccagagcaaatatacttttcctccaggatatataaaccctgggtctggaaggttgtagtgcgaaggcctacctttcttgtggccacccaagaccacgcttctgtctgtaagttccccaataaatcacccttttccaacacactggatttttctgctctgttctttggtttcttggctccttctgtatttggtggacacttcgcatatatgaccctttcacggaacaatgtgaaacttaaacatgcagcattttgggacgatctactttaagagatgttctgtaaatgatctgctgtgtaggccatgacatttcctcaggctcaccactgaaacatcaacctactataaaatgataaaacatgtgctttaaatgtgagcactctaacatatttatgaaagatgacacaacagatgggcagaaagaaacactgagaatgggaattttattttctttataatttttttttttttttttttttttagacggagtctcactctgtcatccaggctagagtgcagtagcacgatcttggctgactgcaacctccatttctcaggttcaagcgattctcctgcctcagcctcccaggtaagctgggattacaggcacgccctaccacaccctggctaatttttgtatttttagtagagatggggtttcgtcatgttggccaggctggtctcaaactcttgatctcaggtgatctgcccgcctcagcctcccaaagtgctgggattataggcgtgaaccactgtgcccggctgggaatttgcttttcaacagggaaaagaggcagtgtatctgccaggcaataatgatgacaagcacaaaacactaatttcaatgtattgagtatgtgagaggaccaatactagtttccttagctgtattaatttgaattattttaacaactttaggaagtcaatatgatttctgtttgaaaagtgagcaaacttaggctcagagatattgcacgcctaaagtcacacagttggtatgtggttatgacagtatttatgttcaggtctgtctgcctccaatgcctgggtttttctctatgagctccctcttagctgttccagtgttcctccactagaatttcatattctttagtgagacaatctccaggcattatcctagcttgaataaaatgctccagaaagttctccaactcaaatctacaaatcagtagtcgttttgtaaaataacttctttctccaaggacctcagttttgaggaatgtgtgccctggatgaagaaactggcattctcactactggaaagaaataattttgtctccgtattaatttttcggtattctggtttttagatttttttttcatgagttatgttagtttcgactcttttgactagagcctgaccattcttggatgatcgactaaattcaagtttctgaaatgacacacatgagagatagctttattgattttctatgaattttcttattttttcttcttataaaaatgtctctccaggagcaacaccaaagaaagccaagctgctgcaaagcttctcactgcctttgtatattatgccagctcctctacctcaaacgcttgccctgccttctcatctgaaaaatctttcctcttaagatccagctcaaatggtaccagttctctcgcaaaatcattctggaagaccccagggaaagtcaatttctcattcttttaaacattcacataattttgcatatatcactctcctattcacttgacactctacagtaactccttctgtataatcctattttcccatctagcctgtgagctacccaatggtgtcaatgaactcagtcccctttgcgaacctagcatcttctactgcactggcataggaagaaaaatactcaataaacacttgcagaaatgacatttaaaaaccatgcaatcttgtctttgaaaactgtactgttcaggaagatctaagaagatgaatacttactaggggctctttttctccttgaagagcttgagtgaaataatggctgttgaaccaagtttgttctaagttcactgaacttgatttattagcattgaattttcttttttagcttttttttttttttttttgcttgtaattggcctcttcatgtttaacacaaccctccacctataaaaatcataggatacttcacagaacagtgagaaaagcggacccttgggacgtcaagggacttactaaaaagcacacagctaagtgggagagttgaactagaactctggttctatgggtctattttttattctttctagtaggccaggttgctatgacaaaacaataacccctttaagcttatttacagctctttaacctaatcagaaggctttctttaatagttgcagagggcaccataccacagagaaagttgtcacgaggtctggtgactttccaaacaaagccgcttatcaattcaatgttaaaaatattggtcccatcctgagaactgtggtttccttttcttaatgaaaaaagcaataaaacgcaagtacacatccatctacacatacaggctgtcaataataaaataatgagagatggcactgaccataatctgtgttttccggctcccaacaatttgatggccaaaaatagggggtctgcggaatgaaaagaagtggaacccagattagacaaataaaaaattagtggagtttctggccagtgaattacatttatcttccacaattctctatattagtttgctatatgttttataatacagaacatgttccaagagagacattgaaaactctttgtctacatgtactttgctgaccaattgctcagcttctaaacatgtgtagtaccagcaagcaggtatttagaatgtcatccctttgctgtaattttacaccaactgacataaaggcaaaaaggtctgattgtatattcaagcaaaaagtattcatccacagagaggactgaaagagtatgttcggcaagactcaggatgaaatatatttaaatataacaaattgttttctatgaatcatgtatttcaacactgcttttggtagctccaaaaagctcaaccaaccgatagactctttctctgagatctgacaatgatttgcctggctccattagtcatataattcagttctcagcattgtccaatgagattaaagcaactttttactctcacttttaaagacatttcctaaattcctcttgtaactaatttctaccatttagtcgtgcaacagggtgactcgagtcaatagtaacttaattatacatttaaaaataactaagagtgtaactggattgtttgtaacacaaagaataaatgcttgagggaatggagatcccattctccatgatgtgatgactccacattgcatccttgtatccaaacacctcatgtattccatacgtataaacacctattatgtacccacaaaaattaaaattataaaatttaaattaaaaaaacctacaaaaaataaataaaaatagaaacatttccttacaaagacacttgtttctctaaagttttaaactgcacaaatcagagattttttttaaaggaatagtgtcttaattgagtgatacaatctgcaataggcagaatccagattctgtagaatctagaaactgactgactaaactacaaagaaaatgtctgaccgagagaaactttattattatcattaacatttatattttctaaaaggactttcctagccctgctagctgaacatgcttggctcctgaccacgaagaaacctgatgatcacctgtctccttatcaacccctagtccctggaatgatgaggcctgcaggactcactgtaacagtgatggcaaatatcagtactgtgggcttaattctatctgttagctaattacactaactaccatgtgcaataagcatatttggagtcatctctgattatctgatcattttcccctctagaagagagactctaaagaagggaaaatgggtagatagggagaactgtttgaatctctacagaaaagtctttccaaactgtctcagaggcccccccgactaccatcacccagggatttcaacttaccctccgttctttcttgggaattacagtagtaaaataaagaaggctactaacagtagttttgtgaacatgagaacaaaatcatcgtaggaattctgaagaaagaaaaaaagactaaactgctagacaaaagaggatagtaagactttatgtgggtcacccttatcaccccaatctcacttgactccataggagatgaagctttgagaattcgatttcttaaaaataaaattgaatcaggattctaggatagccctagggggacaaagtagttaaaactttgctttcatgtagggtgtcactttttttttttttgagacagggtctcactctgttgcccaggctggagtgcagtggtgcggtctcagctcgctgcaagctccgcctcccgggttcacgccattctcctgcctcagcctcccaagtagctgggactacaggtgcccgccaccacgcccagctgagtttttgtatttttagtagagacggggtttcaccgtgttagccaggatggtctcgatctcctgacctcgtgatccgcctgcctcggcctcccaaagtgctgggattacaggtgtgagccactgtgcccggcctaaaaacgattttctgatatgctatttcttaggttttataagagatatatttctactttggtatctttctttttttttttttttttttttttttgagacagagtctcgctctgtcgcccaggctggactgcagtggcgcgatctcggctcactgcaagctccgcctcccgggttcacgccattctcctgcctcagcctcccgagtagctgggactacaggcgcccgcaccacgcccggctaattttttgtattttcagtagagacggggtttcaccgtgttagccaggatggtctccatctcctgacctcgtgatctgcccccctcggccccacaaagtgctgggattacaggtgtgagccaccgcgcccggccggtgttactttctgagatgcttcttacggagtgcattgttccctctgggtagtttctatattttggggagtatatatgtgtatgtataggtgtgtgtgcaggcatatctatttatctaaccttaaaatacctattctactcagacaagacatatacttttttcccacaaaagcacaaaaaatattctcaactgcattcttatatttttcttcattctccatcatttactttagtgagaatttaatgactgtaaaattaaagcataaagtaattttttcttgtgatattatgtggaaatgccactaaaccaatgttcttcactaatatggaagattttttctaagaagtagtgttttgatctgtagtaaacgataatataggagaacaacaaactcttacagttttttttggaatttaaatacatactttcatagttctaccatacattaggacattttaatgcatgagtttcttgatttttcaatattggcttccttagctaggatgaaactcatccaaaactgttcaactgttgttcaataactgttggagcatatactaatgtattgaaagtcatgaaagagagctaaagaattacatcagatctcattttcagttagctaagagaggatgattagacaattgtgactttacggtaaatttaaaaaatcacatgattaagacatgtactacaaatttgagacaaatatataaactgtcatgccaatgaaataaagatttctgtttatctcaaattaatgctttgaagactctttagatttttttattattattattttgagatggagtctcgctctgtcacccaggctggagtgcagtggcaccatcttggctcactgcaaccttcgcctcctgggttcaagcaattctcctgcctcagcctcccaagtagctgggactacaggcacgcaccatcacatccagctaatttttgtatttttagtagagatgacgtttcaccatgttggccaggatggtctcaatctcgacctcatgatctgcccacctctgcctctcaaagtgctgggatcacaggcgtgagccactgcgcccagcctagattcttaatgatggttagactcccaatcattcactggaggatttgtaaacacggcatcccaacttttctactttaatttatgattttaaaatatccttccaaggagttgaatttcacttcggtgtaataaagaactttcgctgcttggaaccaacgtaaaaacagaagtgaagaccttgaataataatttgttttctattattggaactcttcaaatatggactggttaatgacttggtagacattatagtagaaattcagttacctctgagttttctggtgttttttaaaatcttggtttcagaactctaatattattagatttacaaatgtgtttgttatatttagatactatttcaaatatggatgcatcattaaaatatgtaacatttactatttagcactaatgtaattttaatgtgtatatgtatagatagtttattttatatctgcctatctatctcagcacactgaacttgacaactctctgtctatccctagtagttacataattcatatgtcatttgtacccattcccttgctttgttctaaagctcttttaaaaattctctccttttctcctgtgtgtatggtgatcccttccttcacatggcttttttttttttttttttttttttttttttgagactgagtctcgctctgtcgcccaggctggagtgcagtggcacaatctcggctcactgcaacctccatctcccaggttcaagctattctcctgcctcagcctaccaagtagctggaattacaggcacatgccacaacacccagctaattttttttgtttgttttttttttagtagagatgaggtttcaccatgttggccaggctggtctcaaactcctaacctcaagtgatagcccgccctggcctcccaaagtgctgggactacaggcatgagccactgtgcccggcctcggtgcccttttagacccatgagcatgactaagacatgtaaaccttgtctgtctactacattttctgggaatagagatttctttaaaaaaatcaggaagcattagtcacataaaaacaatttatttgctgatcaccaataattcctagttattaaaaatttaatcttggggccagaagttactttaataatatgctattttaagctaccattagtgtaagttttgctgtataaagaataaagctccattaatgtaaagcttttttaagttacgtaatttaactaagtgcttgaatacttaggtcagtatcacagtttcaggatacagctttatttcctcctagctcttaagtccaaaactgtcctacgattatttgccttggaagaaatgagtccaaggaaggggcagtgagactgttctatgaggacaataatctttaaaatgattttttaaagcaaatgattaaagtgatttttaaagcatatttcctctttgttctcagttttcccaaacaaattttaggtactctgattactattcagtcatttatgtagacatagagcatttaataatacttagaacaagtgagaagaaggctccaaagtctgaaagttggactgtggggagaaccctccagcaaatacctcttggaaatggattagagtttgacatccagcattttatgtgccttaattttacaggctagaatctgctaatcagttattaatgagccataatgtctactgaaatgtagaatatactttaggtaaatcaatgtgaactcaagtgtcaaatatacttacaatgactgaaatcagagtccacaatcattgccagaaagaataatagcatctgtgtcatttgcaaatgacctagaatgactcttatcagtttgcaagttatctgaggtgtcctgttgcagttgagtgcacacacacaatatatcatcatgtcagtctttacagatttgtagaagagcctaggatgctgagagtttattaattagctgaatcctatctggagtttcaagcattcctgttaaaatttacttgggctgaagatggtctggatcacaggcaagggtcagacagaggaagactctccggtccttccgaatgccattaagtcactttatgaatttcccttaagcttttcatataaaatagaaattcaatcatcacacaatttagctttcacacatcatcttgactaagcatactttatctttctctgtgtttattgctttttatgtctttagtttaatgttaatcagtttctaactagcctaagtcaaagtaaaataagtcatagtttttaaaagttctgttcaaaagaaacctaactaacaaacgaaatgcgggcttctagtttactgttaaagaacatttctaataaacttacttgaaaccggtaaaaggtgccatcatccttgagtgtgaggacatgatctgagattggaaagaagtagccgtgggcagccattaatgttcccaaatggagcgcctccactgttttatgaaaacaaacaaagaacataaaaaagccttttaaatgtattcttttataggaatgtaacgtttttgtgtggttccttttgtcagatacagtaagttcctcttgaaagatttaatttctgacttccttgttctttgctctcgagataaacttccttgtcccttctcctaagctacctgctctgtaaacaacttctcctaccagtcccagtctgtaactcacatctcttccttatttggaaacagtcctcctttactcctggctacccattctgtaaactgcccctcccactgaaacaggtcttccagccaaaactacacttcctgcctttgccgtgccctgacatgcccaaacatgccttgtaccgaaacggacagcctctcccttcccacctaattagccatattcaattttaaacagtagccaatcgggtcagtttagattgtgtggtacgactccagccaatggggacaggacacagaagcagggactaatagcgttagggataaaaaccccttccctcctttgttcggtgtgctctcgcagtggccagaagtgcgagtggcacccttctgcagaagtaaatttgccttgctgagaaatcctttgtttgagtgctcgttttccttgcgactcccagctcttgtttctaacactttagagtacattcttggcattctgaaaacctggctttgtgctttttcttcttttttcagctctttctcacaagacactaagatggttctagttcctggtagcaactgccatgaccaacctcatccaatgacaacaagtccatgagaagataaagttaagaaacattaaaatgggaaggctcttctcaatctgtagagtatgtctccctcattttatagatgtgtgttggcccatgtgataatgttctctcacaggcagttgcatttggcatttatagcactttaaacttttaaaagttttcacttgcatcacctcattctcaatatcatagcaatctagtaccatcagtaatgtttctaatgatatggaccattattttgtgatgctatgagggaatgttaaggcatcaaggaccatgtatgctgcactattgaatctacagactggtgattgtaaagattgttctagcttttactattctatacagtgttctaaatatggagtaggaagagatttattggacaatgtaaacatatagtctgaaactaaggctgtaatactcatactgtttatagctgccaacaatttcttccaacaaaagggttagtaaaatttggtcaatagttattactgcgtttgtgcagagatgacataaagttttctaacttaaaggctagaaaatatgaaattatgcaaaatagttttctaccccaacaaaaaaaatatatgtacagttgtcccttggtatcctcaggggattggtttgaggacctgcacagataccaaacatcaaggatgctcaagttccccactttgccctcccacatctgtggatttttgatcatgggtggttgaatccacagatgtggaagtcataaatagagagggcctactgtatgtagaaaataccagaaaagttagatttatttatctgtttatgtatctttatgtataattcatttataaatttatttctgtttcttagtcaagaagctaggattcttacagcagttctaggacaacatggatctatctatatctccagccatcaaccatggggagcttttacacctcagttaagaactgagtaactaagtagctagctatggtacagcaaagcataagaatcccatccttttaccccttacacctacataaataaacaatttgttgttaaatttttatctgttttggggtactatgatgccccttgaaattgttatctagcattttgcaaacatttcaattgataacttctacctctgatctctccctgcattgttcttgccgataataaagaacaactgccaattattcttcattctttgccctggctttggaagactgttactaactgctccagccatcatctccaaactcgcagtcaagtctctctgtatagaatgttgttttttgtacagaggagcatttttttttcatcaattttgtgcgtgtgtgtgtgtgtgtgtgtgtgtgtatttccatcatttcaacatcctttcagttcaaagtcaaggccttctcaaagcatgcattgctcatagcaacatgcctacctatccttgttaaaactttagtgccagggtgtcattgtggaaagaacaagaactttggagacacccactgtcttctgttactttcattctctgtgcctcccccatctattaataaaggtcataaacctacctggcaggattgacgtgagaatgacataagcacacttgtaatgaaattggaatcatgcttccagcctagtaggtactatgtatatggtagctactgtgcttcattatttacacacaaaataatttttacttttctacaaaccactttcagagaatctacttccatacatttgccttctgctaggttgagtgaatatttccaacacaaaaaaaacataaaactttgaagtgatagatatgttaattattctgatttgatcattgcacatttcatgtattgaaatattactctgtaccctataaatatctaacaaaagttttaaaaagctaggctgagtgaggaatcctgacagtcctaagcagccacgttcatcaacatcatcttattctctttttttttgactgtctgtaaaattaaaatggtaagaggatctagaaagatagttggcccataacaaatgagcaggtggttatagtcctggttaaattctgaatccctaagtacccctgtggacgagtgaagaatatgccatcccaaaataccccagattgtttcaagttgaaaacactggatgaattgtagtttcagaaagggctagctggcctatctcttcctatatgcagcaagccataaagattcctctgggaggggtatcttgcttttgccagggcaagaaaatagctcttatcaccagagactgggagttgggggctgcaatgaacctgaataaagggctggatgcggtggctcatgcctgtaatcccagcacttcgggaggccaagacggatggatcaattgaggccaggagttcaagaccaccatggccaacctggtgaaccccgtctctactaaaaaaaataaaaaataaaaaacttagctgggcatggtggcaggcatctgtaatcccagctacttgggaggctgaggcatgagaaccacctgaattcgggaggtggaggttgtagttagcagagatcacgccactgcactccagcctgggcgacagaacaacactctatctcaaaaaattaaattaaattaaattaagaaataaacttaatcaagtaacccctactttccactagttttatgcccccaatatattccctagtgattctgctagaaaatttactgccttcagccagattttctttgttctgtcatttttttcttaaatttattattgtttgtctaaaaagtatagaagtgtcttgctttggccatttcttcagacttcacactcttgtgaagatccccatgtacatgtaaaactaataaaatgtgtatgattttctctattaatctgcctggtatccacctggtctccagatccacagaagagcttaggggggttgcagatgatctctgacttccttacacctgttagggaatatagggtggggcaacatgtaacatcctttgtaggtggcccatctgtcttcgtatagccatctttattattttagtcccagcagtctgtggcctgggaagatagtgttagcacactttcccggaagaaaaattaagttacggcacataaggaaatctgcggagtatagatacaagaagggaaaactgagatgcccaggaagatagacagtaagaggagcttctgagttctaagcataggaaagagtgtgactaaaaccaagccaaggaacaacaaaaagcaattgggtgttaaagtgttgatgaggattagaaaaatagagtgaaagtaaatatagagatgctacaaaaaagaaaaacagaagtgagtgatcataagactattcttgactcctgcatctcattaactactaatttacaagttatatacttatagagtgcaaagtgtatgttggcaggttcttcttcatgtaatactaccataattagtcattaataaatgcttgcaaatgagtatgagtgaattagtaaaattctccttccttttttgaggtacaatattttcatttgatttgatgatatgcattctcattttacttctcttctgagtgatacttatgttccataattttacaattaaggaaaatttgttttgatacttttgcatcatgtcatgaatttagtagaaatatactggtggtgatacaggtaagacctagatttaatttctatgtgagtcacacacatttcatatgtcaaggtgaaatcaaaccttttgacttaatagttaagaggactgatcttctcacaatgcttacaaatggttttaagatttttggtcaaatagtaatctagaggtactgaaataataatagatattttgtgttcattacaggatctccagaaaatatagctccagagcaggataaatgcctagatgaaaaatcagaaagttggggtgaattttttgcttcatttaggatgacaagtttagcactcagcatatccatggcaaaagtagcaagtgaatcaatatttgctaaatcaatgaacaaggacatttatgagtaaatgacacaccaagaatattaaaaacctaacactgcatagaaaaacaccaggctaattattgtgtgttataagctgttgaggtggggctattgtagctattttgttgtgagaaaatataatagtgatattaacaagataaatgccagtaagaatggacttggggcagtattctcaagacagacttgtttattgttagggacaaacatggtgccacagttccctgtggtcccactgctccgaaatcttagcaccatcttaatctaataagaatccataagaccgctgacaatcttggaacaaagtgttgaaagagtttactgagtaatctgtcaagatcactctcccaataacggcacaccagatggcccagcagcatcacgcttcacggcaaaataatcgctaattaatcttctcgtacatgtgttattctcttcacccacacagctaaagttcaacaataaacctactaaaaaattccagcttatttttttgtttggatattcaagccatgagcaagctgagaaacaaaaatcaatctccaaacacctctgattaagtgaacagcctagaacagctttgttaagcctgataccaacataggatgatttcaccccaaactctaaaggaatggtattatcaacatcctcggatagcgaagagaattctccacagcataatttgcttttgaccacaacgatttcaaaaagttaacaggatgaaaaccacagtataaaagaggcttgtggaactccaggggtgcaatcggttagctcacggtgcttataaaagaggcttgagtacttgagtgtaaagtactctatatttacaatgtaattttaaaactcagtaatatttttcttacccagaggctcaacttcttgcagcctcctcttcttttaaatacagctcataattttgcaacgattaataaaatgcctctgagtcaagaaagtaatttaaaaacttcactgaatcctgtatttttatcactatcatgttatttactcttatttatgtgcatgtattaacatttttttcatttccaacacagtataagtatcagtagtgtgtggggagaaatattttaaaagaaaatctaaaaagaaaaaagatggcagctgattatattaaggaaacagagatgctaaaatgaagacaaaggtaagttacttaatgataaaataacaggtattcatcaggacaattctgagccataaaaagaagatatgttagacttgttactttctgtttaagaagacatggaagtggtcattttagaaatccttcaaaatattatgctttattttttagaactggcatttggaaaggtaagattattcatgtagaaaaatctcatatgcggaacattttattctccaacaaaaccaagtaaaaatggactattaccatatttagaaatttctgaagtaagtttattttctcaacagtaggagttagtaaaagaagtacctcagctttcatctttttaaaaaaaacatcatttgcatgtaagaaaaatcaagtgccgctttctcaacagcaatcataattcgggatagagaagtgaataataaggtgacatagaatagataagctaaaagagattctatttgggagaaataaaaacagaatcataatttatatcaacattgaggaatgcaataagaaattaatataagtaaacgctatttccaaaaaaggagcagagtacaaaggctatgccagtcccctgcctaggttcacatcccgggtccctcatttgctggctgtgtgacctgagcaagagacttggattctctgggccttggtgccctcatctgtaatcatctgtaagaagttgacaaaataataatgccaaagattagcagtaaggatccattgagataatatgcacaatgcacttaaaacacagtctaccacacagacatgctcctgagatgagagttattatcagttgatacttatgaagtgtcacattcaggagcacttaatctagtttaaggggcgatgggaaacattagtagctagtgttgctctgggtttcccagtcatgttaaacacttccaattcaactctattttaaacgccccaggtgatcaaaccagagtgttttgtgggctgaaatatgcctatgtttttccctacagcaaagaacactaacaaaatcccaaaaagaaattagggacaaacttattatatatcacagggatagccacagatttccaaaggcggcatgctccacacgctaggtttacaaaaccatactgtgaataccagatgccaatgagagacctgcctgctttagaggaggactgatgtgaggacaccctgaacctgacagtagaagaataacagggacagagagagcacggggacagcaatcagaatgggagatgaattcttagggaagcataatatttgcctaggactaaaaaaagaaaatcgacattaaaataataaagcaattggcagtgagagcaacagataatcataagtcaacgatcttttttacacacacagagtagaccagtctagatgtctaatggcagttatgacatcttaggcattctgcatagatgaaaaatcatgctgaaatttgaaaaaatgatccatgtaatactggtgtgaataactggtttcagatctacattatacagcctatatgatattagcatgttcattccccagatttagataggtagttccatcagccaatcctttaacaagattctgttatattatatgtgtgtgtgtgtgtgtgtgtgtatatatatatatatatatatatatatatatatatatatatatatatatatgttaggtgcatagaatagtattcagatgagataaaaatcatgcttacttcatctaagtacagtgtgaggaaaccatcacaatggcaagggccagggcagtaataaattacagtggaaaacaacattccatctaaaattcagtatacattctgcaaaatttccattagttaatctggctgaatgagctggaagaaagtagggcactgaattaactttttagtaggcagaggagtttctacagcatgtatttcttcaaatcagagagagcacacactgccaaacaagcacatgtggaaatcatgggaaaaaaaggctcaactgcaagtcatggggcttaaattctaatcctagtgcctgtaactgcatgtcaggagtaagtcacttcctttcttttgttttgagatggagtctcactttgtcaccagtctggagtgcagtggcgcgatcttcgctcactgcaacctccgccttccaggttcaagcgattctcctgcctccgcctctcaagtagctgggactacaggcatgcgccaccacgcccggctaatttttgtattttagtagagacagggtttcaccatgttgggcaggatggtctctatctcttgacctcgtgatctgcctgcctcggccttcccaagcattgggattacaggcgtgtgccacgcatccagccaagtcacttcctttcttagagctggcatctgtaaatgcagcggggatcactaaagactttttagttctgagtccatgacaagatgtgcagtcaaaacactagctagaagttgtggcagagcagccgccatccttatttttgcctccttgtgtcaaagggaaatggatttttctttatttctcagacattcttgccattgcccatgtcccaatactctaacacgaaagagaaaaatagcccaatacgaaatataaaagctgattttaatttcagttgcttataactcaatcctgatgattctcaagggctgctatagtatagagtttttgtacacagagcaaatgaatgcttattccaaataggaactggttttatgagtgtgttctatttacacattttcaaaaactagttgtaaaaacgcacacatgtcttgggattagccaataacacatcccatgtgccaaaatatcctgaatgcattttgtttgaaaatcaaatatcactcctaaggaataagcaatatagtcttctcataatacctgttaatggtatctcttttaaaaatcactattccttaatatttgaaccataatgaatgataagtctaatttcaaagccacaggcttggtcactgaaacagtcacagtttttatgaaatttcaaaacaaaatcagtggaatgcacttttatctgtattttgcagaaacaaatgcttgaattgagaaaagtgtgtaggacgtcaggactgatgtttgcaacttttgaataatctttacagcaaagtatcattttaaaaatcctagtttataaaagcacatgtatttatcaatttttatttttaaaatctctgtgtgtatatgttggtgtatgagttttagtaactaaaataatctgaaaataagaattttagattttagaatacctaaaatctaatacacaagctttccatgaacctactggatagagatcatctttctcaaaattagtttggaaactagatatgggtaaatttgttaaataagatgtattaaaacattttttctgtttgctgttttaaaaccagcacagtctttcataaacaatttgattgtaattttaaataccacaattaaaattataactactgcctaacaataacaatgaggcaggttcagaatccataatgagtaaattcagatgagttatttaaagtattaacaactcccctcaaaaatccccccctcttttcttcaccattctgcttgctaatttcactattttttgtaattagccagaatttaaacatcagatgtttttaaagaattaaaatcaggctgggcatggtggctcacacctgtaatcccagcattttgggaggccaaactgagaggattgcttgagactaggagttcgagaccagcctggacatcatagtgagactccatctctacaaaaagtttcttaaaaaattagcagggcatggtggtgcacacctgtggtcccaggtacttgggaggctgaggtgggagaattgcttgagcccaggaatttgaggttgccattagccatgatcatgccactgcactgggtgacagagtaagaccccctctttaaaaaacaaaaattaaaaaagaattaaaatcaattagcctccaagaaaatatggtttcataaggttcttttaataaagtacatagtgagacagctttatttccagaattcaaataaattctaggggaggtgggggactgggacaggctggtcaatgggtacaaaattacacttaggcaggaagaataagttttggtgctctattacacagtagggtgactatagcaaataacaatgtagtgtatatttcaggatagctagaagaggagattttgaatgccgttaccgcaaagacatgataaatgtttaaagtgatggatacggtaattgccctgatttgttcattatattatatatacatgcattgaaacatcacatcataccttataaatatatacaactataaggtgccaattataaataggaaaataaattctagatgctgtaggtgatattaacaagaagaaatgtctggagcctcagtggatcagtaatcttggtggacaacacacacatgccccctggtgggaagagtactgcattatatggggcaatggttatgaggctggcctttgagccagactgccctggccccgttgcatcttagcagttctttagtcttcaaaattcaaatttttaccattttcattatgtaataagctttcctataaatgtgatcatcattcttagaacacgtatcttcagactggcttctctcctaaattcctgtatggtattctgaacagcctttgtgacatctccacgtgaatattgaataaacatctcaaattcatcatgtcaaaattgaattgttggctttcatctgaaacccactcttctcgcagttcttctcacctgagttaatatcagtgactttcattccactgctcggaccaaaaagcttggatcgtctgatgtctttctcccattcaccgactccagtccagaagcaccttctgatgatcctgttttgctgtatgttcttagaatctgccctcttatcagccacccacatccaccacctccaccaccccagtccaacctcatatcatcctgtggctgagtcactgcaacaacattcaaactaatttcattcacactttgccctttgctatgatgattatcttaaaacatatattagatcaagtcgctcctgtgcaagccctcaacaatttcccctatttctcaggatcgaaataaaattccttgtcataggctttacaagatcttatatgatctggccaccccagttacttctctgtcttcctttcctatttccttgcccatctttacatatcctcctctagttcacagacctccttgttgctcctcaaacataccaagcatgcgcaggccttaggctttgctaggctctctgcctggaatgctcagaacccttcctccagagagcagaacaccccacttccttccttcagttggattctagccaaagccactacatcagagacaccagccctgactacactggtgtagaagaccgcgtatcttttagttggctttcataaaaaccatttttatttagtactcatcaccacttaccatataacatatttacctatttttttattgattattatcttgtctagtgaatattttaagctctaggtaagtatggacatttttgtctgtttgcttggttggttttagtggtttgtttgcttgatctactctctgacagtgacttaatttctgagatattgcaaccaactaaaaaatatgagagcggaaatggataaaaggatcttacattagttcatagcacaaattcttagaaataaaataggggagccaaaagacgcacatattttttaagtgttgctattttatttatttatttatttttttgagacggagtctgtgttgcccaggctggagtgcattggcgtgatctgggctcattgcaaccacccctccctggttcaagtgattctctggcctcagcctcctgagtagctaggattacaggcacgtgccaccaagcctggctaatttttataattttagtagagactgggtttcaccatgttggccaggctggtctcaaactcctgacctcaggtgatccgcctgcctcagtctcccaaagtgctgggattacaggcattagccaccatgcccaggctatgtatgtctatgttttttaaacgtaatattgttccatctccagatggcatctggagatggcattattagcaataatacatatatagtataacatacatatatattatatatatataatttaaattctcaccaaaagggtataaatgtgttggtatccctgtaaagtagttaaccacttggaattattatttattttctcgttcttcatttgctgggaagaaatggcattttgctttaatttgacttaactggagttatattgaattttagctaaaatgcacagtcttttaatacacagtatgagtgaaagaaaagacatttcaagttgacagggaaggtttcacaaaagggtaggttagactaggaatggaaggattttagactgttggtcaagagggaggtccttcaatttctccccagttctcctaaaaatgctctcttttcttattttctcacctttcaattttgatttgtttcctaggcttatcttatgtaattaattaataaaaatgcattccctttttatttttcaaattctttgctccattatttactcataccaggttttattaatttaccctattagacttcatttcttcagccattcacctgtcatccatccacccatctgctatccactcatccaccatccattcacccatctgctgtccatctaacagataattattcactgtctgcttggttttaggtgcttaactacaagccacagatataaaagtgaaggtgacactctccctctctctaccctcaagagactcacagtgacatggagtatcctgtgctttaaaaagccaaggatgggccgggtgtggtggctcacgcctgtaatcccagcattttgggaggccaaggtgggcagatcacccgaggtcaggagtttgagatgagcctggccaacatggtgaaaccccatctgtactaaaaatacaaaaattagcagggcgtggtggtgcatgcctgtagtaccagctgctcgggaggctggggcaggagaatggcttgaacccaggagacggaggttgcagtgagccaagatagggccactgcactccagactgggtgacagaacaagactctgactcaaaaaaaaaaaaaaaaaaaagccaacgatgacttctggttttaactgagacatttaaagagcttagaagctgtcactctcatcctttcgacaaaagaaaaccaaacaagctgaaaatcaactatttttcctggaccattcagagaagtaaagttgtaggacaaacctccattccaaaatctgcatagacaggctcatccagagacatgaccaagatctacttacttggagcagaagcttttggatccataaactgacagaaacatgaaaatagctcttctgacaaagaacttgagactcagtgtgaactagcttgacaataaggaactcgaggggctcatagtgttggtggggaatggagcacatgccttcatgagctacacttccagaaatcccaccagattctcatggtgaagatccaagaaagatccctcatggctctggcagaagagggaaaagtaatcattgcgaaaaatgcccagagccctctctataacaaaggcctctaccccaaaggaaagacattgtcagacattattctcaccagggaaagggcatttctccaactacagtcccctctagactttgtctctcaccgaagggaggaataaaagcaaacaacattaacaggggcagagcttctacaaaatagtttgggaaagctacagctgggaaaggaagatagtggtgggagacaggggatctatacttctggagaacacttgcaaaggtcacagctccaagggacagactctgaaatgctgagatttcattgaaatattatataattctctcattccctaacaactatccaccatacctataggctatggtataatatcagattacagctgaaagagctgttaagacacaaacattctctgaggtgaaatacttagaggagctcaaagtcacagaagaataaaaataaaagcactagaggaatttgaagcttctgtcatttataaccacagcaaacattaagcacggtccaagtactaaaccataaattagcacactaaaggcctgagttcccattacctaatacaagatgtgcagctttctttcctttctctctctcttttttttttttgagatgggagtttcactttgttgtccagctggagtgtagtagtgtgatcatggctcattgcagcctcgacctcccaggctcaagcaatcctcccaactcagccttccaagtagctgagaccacaggcacgtgcaaccacaccgggctaattttttttatttgcggagatggggtctcaccacattgcccagtctggtcttgaactcctgggcttaagctatctgcctgccttggcctaccaaagtgctgggattataggcatgagccaccctacccagccatgttcagctttgaatgtaaaattacaaggcaggcaaaaaagtaagaaaaacacagtgtgaagaggcaaaacaacaatgagaaccaaattcgaatatgacacagaaattggaattatcagacaggaagtttaaattgtaattaatatgttagggactctaatagaaaaagtgcaaaacatggaagagtagatgaataatgtaagcagaaagattctaagaaagatattcgaagaaagaatcaaaatgaaatgttagaaataatactaaaaaagaaataaagaatatcttgctgggctcattagcaggctacacaactctaaggaaagaatcagtgagcttgaagattaaccaacagaaacctcaaaaactgaaattcgaagaaaaaaataacaaggaaaacaaaaagaacaacaataacaaaagcatccaaaaactgtgggacaatatctaaaagtgtagcataacataattggaataccaggaggagagcaaagacagtgcagcagaagaaatattgaaatgataatggctgaagactctccaaaattaataacaaatgccacactacactcagagagaaagaaaagtaaataacaaaaaaatctaaatctacacatatcttattctaactgcagaaaatcaaagaaaataatcttgaaaaaagcgagaaaaatatccttacctatagagaaacaaaaatatgaatgacagtgcgcttctcatcagaaactatgtgggcaaaaaagagaatacagtgaaatatgtaaagtgttgaaggaagaaaacccactaacctagaattttacatcaagtgaaattacccttcaaaagtagaggagaaataaatattttctcagacaaacaactgaaagaatacattactagtgggcttgccttgccagaaaggttacaaagaagttcttcacagagaacaaataataatatagaccagaaacttctacatacataaagaaagaaagaacatcagggaagaaataaaggtaaaacaaaatctcttatttttcttattcttagtttatctaaaatataactatttgtttaaaataatagtaacagtattaggtgattataaaatatggataagtgaaatgaacaacagcagtgtcgtaaaggaagaaagggatgaattgggaatattctgttacaaggtaccttcatggtatatgaaacagtatagtgtaatttgaacatggagttagattaattaaaatgtatatcgtaaactctagaacagctgctaaaaactttaacaaataagtacaattgatatgctaagagaagagacaaaatggaattatttaaactgctcaattaaaaccagagttggctgaaaaagaaggggggaaaagacacaaatgaacaaatgcaatggagaaaatgcatgttttgtccaaatgcattgcaatacaatgaacaaaatacatacaaatatgtaagaagaatccacatatatcaataatcaccttaaatataatggtctaaatacaccaactaaaaagcagagattatctaagtggattacaaggaaaaagacctgactatacatgtatataataaactaattttaaatataaagactcatatatgttaaaaggggggaaaagagataccatgttcacactaatcaaaatcttttgaaatagtatctaatacagaagcaatattaagtttaggcaaggcagacttcataacaagcaagtttatcagggataatggaaagcattatctaaagagatcaattcttcaacaacaataaattgattatgaagatcacttttctattacaatcctaaatgtgtaagcacttaacaacagaatgttaaaatacataaggcaaaactagagagaactgaaaggaaaaataaactcattattacagttacaaacttcaacaccactttttcattaattgacagaccaaataagcagcagaaaatcaagcagtcagaatatagttgacctgaaaagtactatcaatatataaattgatagtatatcaatgatataaattgacatttatataatgttctatccaacaacagcagagtaaattattctaaagcatacatgaaatattcatcaagatcaaacacatcttgtgtcataaaatagatcttaaatctaaaagaacagaaatcatacaaagtatattctcagatgcaaaggaattaaactagaaatcaataaaagaaaggtagttggaaagtctccaactatttggaaattaaacaacataatctttagtaacccataggtcaaagaaaatgtctaaagagaaactgaaaattatttttaactaaattaatatgtaaatgcagttgatcaaaacaggtggactgcagcaaaggcagtggttaaagggaattcatatcattattaagcattaatgcatttattacaagaaagatacaaaattaataacctaagattatacgctagcaatattagaacctagagaaagaagagcaatttaaacctagagtaatcagaacaaaagaaataataaaattacatcagaaatcaataaaattgagaacaggaaaacaacagagaaaaatcaacaaaattaaaagctggttcttgtaaaaggtcaacaaaattgacaaatctctgcccaggcaaaccgtgtgaaaaagaaagaagactcaaattaccaatatcagaaatcagagagtggtcatcattaaggatccatagaattaaaagataataaaggaacactatgagcaatactatgcccacaaatttgataacttagataaaaaatgaacaaattacttcaaagacacaaaccatcaaaacttgcataagatgaaatgggtagcctgaatagctctatttctagtaaattattgattgaatcaataattaataacttccccctcaaaaaagcaatgggcctagataattttactggtgaattctatcaaacatttagggaagagatgattccatttctccacaatgtctaccagaaaattaaagcacaggtatcccttcctagctaattgtaaagccagcattaacttaatactaaagtcagataaatacaggaaagaaaaacgacagaccattttctcttattgacatagaaacaaaagtccttaacatattatcaaatggaatttaacagttaataaaaagaattatacaccacaaccaaagggacttattgcacatatgcaagcctgatacagcatttgaaaatcaattaatgtaattcaccataggacaagctaaaggtgaaaacttatacgatcatatcaatttgtgacaagaaatcattagacagaatccaaaacttatccatgtaaaagaaaaaaaaactcttagcaatctaggatcagaggagaactttctcaacttgatgaaaacatctacaaaaatactacagctaacatcattactaatggtagaaactggacagtttctctctaacatcagaaataaggcaagagtgtcctctttcacacttcatttcaacattgtattggaaactctagctagttcaataaggcaaagaaaaaatgttatacacattggaaaagaagaaatagttaaaattgcctttgtttgcagatgattataattgtctacgtagaaaatcccaaagaatctacaaaaacactcctgaaatttaaaaggtagaatatcaagtttataggatacaagctccataaataaaagttaattgctctcttatttaccaaaaatcaacaattggaacttgaatttaacaatgccattcacaatagcagcaaaattggaaatagtgataaatctaacaaaatatatacaaaatctgtgagaaaaactacataacactaattaaagaaataaaagatttaaaaatggagagagtccatgttcatggactggaatgctcaatgttttaaagatgccaattcatcacaactgaaaaactgaactaaagattcaatgctataccagtcaaaatcacagaaagctattttaaagatactgaaaaaatgactgtggagtgcatataaaaggaaaaagatccagaataaccgacataataatgaaggataaaaacaaagttggctttaggaggccgaggcgggcggatcacaaggtcaggagatctagaccatcctggttaacacggtgaaaccctgtctctactaaaaatacaaaaaattagccagacatggtggtgggcgcctgtagtctcagctacttgggagtctgtggcaggagaatggcatgaacctgggaggcggagcttgcagtgagccgagatcatgccactgcactccagcctgggcggcagagcaagactctgtctcaaaaaaaaaaaaaaaaaaaaaaaaaaaaaaaaccgatttggaatatccacactgatttcaaaacttagtttcaggctgtagtaatcaagacagtgagtactggaaaaagaacagagaaatatataagtaaaacagaaaagagagtccaggtatagacccacagagtcaattgattttagacaaaggagcagaaacaattcagtagaaaaagaatagtgtttttcatccttatttgttgttttaacacaacacaaccaattgttatgtaaaaaagaaaggcctgacactacacgcaggtcttattagttttcacaataattaactcaaattgtattatagacctaaatgcaaaatgcaaaatcagaaacctactagaagaaaacataggagggaatctgtctgaacttgtagcccacgatgggttgtcaggtatagcactaaaatcactagtgcaacatgaccttacataccaggatgagtttgtagagatagcactaaaatttagaattaccagtattacaaaatgaacctttatacatacgtatttcattcttaccagaacagtggaaacacttgcacaaagctaacgcaattgtcttcatttcacttgatgcacacactctctacctttggctccctgatgagtaagcaagggctgggaacaaaagcaacaatgggttgccctatctgcctttcctgtggaagagaagcaggagccaactccaagagttcccaatggccaaagataaaaccatttcagaaaaaaaaaaattgaattaagtaattttatattttgagattatatcccaaagtaccaaaaacaaaaaacaaaaaaacaaaaaaaaaacccactatgggttcatgctgatgtaaataaataattgaataaataaatagaaacatcttccctgccaagaattccaaataatttacgtagatactttagcctgaatgaggtggagcataacactccactccttcagtgggggccacatttagtacatttagtaactgtttttccaaaaagtatacaatgacaaagggaaaaatatgagtcactttacaatatattttacatcagcagtgatgtcatgtttatagtgtacacacttaaatgtatattattaactgaaagaagccactctaaaaagcctatggagtgtatgactccatttacatgacactctgaaaaaggtaaaaagagatggtaaaaggatccatggttttctgacgtgatgacaacagcactttccctttgtgattttcctcccccaaacccataacctcagactaatcaggagaaaaaaaaaaacgttaaacaaatcctaattcaggggcattttacaaaataaccaagtagtactcctcaaaacggttaaggccgtcaaaaacaagaaaagtttgagaaactgtcatagtctagaggaccagaagaggtgtgatggttgataataagtgtcaacttgattggattgaaggatgcaaagtattgttcctgcgtgcgtctgtgagggtgttgccagaggagattaacatttgaggcagtggactggcagaggcagaccaccctcaatctgggtgggcaccatccaatcggctgctagtgctgctaggaaaagcaggtggaagaaggtggaagagcagacttgctgagtcttccggcctccatctttctcccacgctggatgcttcctgccctcgaacctcagactccaggttcttcagcttttggactcttggacttacaccagtgctttgccaggggctctcaggtcttcggccacacactgaaggctgcactgtcagcttccctccttttgaggctttgtgactccgactgagccactactggcttccttgctcctcaccttgcagatggcctatcatgggacttcaccttgtgaccgtgtgagtcaattctccttaataaactccccttcacatatacatctttctattagtcctgtccctctagagaaccctggctaatacaagaggcatgacaactaaatctaatgtgatgtcttggatggaaccctgggacaggaaaaataaaggaaatcagaaagtattgacttcagttaatattaatgtatgttaacttctttaatattaactgacttagctaatattaaccagtaccaatattggttcattggttgtgacaagtatatcgtactaatgtaagatgtccaataatgagggaaactggggggtgggatatatagaaactttttgtactattttgtgatttttctgtaaatctaaacctattctaaaataagattttttaagagcaaattacaattaaaaaatcactctactgcataacctgtagtgaaggtctgtgcagcatctcaaagaaacacataggatgaagaagccagagacgattttacagacccagtgacccttcttctcacggagacttgaagaattagtaggagtccaatgaggaagaaggcactgaaaggcagaagaaggcacaaaaaggcccctaggcatgtggtggctgggcacccctgataaagtgcagttcatctggcagaactacaagttgagaaagcctcaggccggagaaggatgcaaggctgtgtccttcctgaaagtccttattggcatttgttcctctgagaaggcgaaatctttgcacaggtttaagtgggaaagtggcaaaacaataagagcctcattcatttctgctgtgttccagatacgatgtcagatttttcagcttcgttatctttgatcattacaaaggatccttgtatttacaaggttagagtttgttctttaggagatcattctccaaatctggagactagattgaaaggtagcaaggctggaggctctttgcggaagtaactgacacatcttttcatcacttcttgtctgttggcttttgtcagtgtgcttgaaaataatttcagctgtttcatgtcatggaattagatatgctttgattacagtttctgctttcttgccttcacccaactcactccttagtgatgctctgcaggacgacttttattctttctctataaagaaactgctcctctgaactcaccctgcccaagccctgcctttacattatgtatacgagttcttccagtcaaactggatcacttagtgacttggagcaggtggcactctcctccgtacctctcctttaacatttatgtatatgtcaaaaagcttccttcttgcttttcttcactgggtataattctgtccaattccctgggtccacccaaatacagccctccctcatgagaccttttctgacctcctagagcaatctatccctccaatgagccctaaatgcctgatatcttttactgtagctaattgtgtgctgttattagcctttcctatacttttcataaagatcttgaaagacaggcaggcacgctgcttaaactctgtttgcctggccgtgcacactttacacctggtataagcagaacgtatcatttgaactgaaaataaagtaagaaaaagtaaatttaactttaaaataaaacacttatttcagagtggttctttgatacttataataaatgctcactttgctttgatactggatatgactaaagtttactttatttggacggatatattacctttgactgctgaattaaaagaatcaatgccttgatttaagctgtgcagctaacagtagctctgagaataaacaagaggaaaatacagccatgtatctcatgcatgagagatgcatcttcggtgatttcatcattgtgcgaacttcatggagtatacttacacaaacctagatggcacagcctactacacacctagactatatggtatagcctattgctccaaggctacaaagctgtgcagcatgtgactgtaccgaatactgtaggcaactgtaacacaatggtatttgcatatctcaacatatctaaacatagaaaatgcaatgcattactctataccattatgatagctacagtatcactaggcactaggaaactttcagctccattataatctcatgggaccattgtcatacatgctgtcctttgctgaccgaaacgttgttatgggatatatgactatatataatttttatgtaagaattttacatttattttttattttaaaaaggacacttcaccataacatcttgataatttattaaattgcaaatacataagatgataaaaaatttcaaatgtcatcttctctatttttaattaatgcctagtgagagcataaacattatttcaacctaccagtccatattttaaaatacaagttcacgcttaaatacatttggagtgaaaaatgtctaaaacatcctaggcatggtggctcacgcctgtaatcccagcactttgggaggctgaggtgggtggttcacctgaggtcaggagtttgagaccagcctggccaacatggtgaaacctcatctctactaaaaatacaaaaattagccaggtgtggtggcgtgtgcctgcagtcccagcctctatggaggctgtggcttgagcctgggaggtgaagattgcagtgagccgagatcacatcacagccctcctgcctgggtgaaagagtgagtgagactccatcccccaacaccaaaaaaaaaaaagtctaaaatattgatttgcttttcttcttcttcctcttcttcttctttttttttttttttttgttgttgttgttgttggggttttttttgagacagggtcttgctttgtcacccaggctggagttcagtggtacaatcatggctcacttcagtctcaacctcctgggctcaagccatcctctcacctcagcctcccaagtagctgggtctacaggggcacagcaccatgcccagctaatttttgtattttttgtagacatagggtttcaccatgtcacaggctggtcttgaagtcctgagctcaagtgatcttcccgcctcagccttccaaagtgctaggattacaggcgtgagccactgtgcctgggctgttctttttttttttttttttttttcccagaagtctttgaatccaactttaaaagccaagtgaaaacctcagaaaacaaatgaagcctgagatgagactcatggaacttgattccttacccgacctatttagaagacattccttaacctatgtacagtcacttaattctgcccatgaaaagcaatgttgcatttcctcacagctgaaaatacttttaaaagaaagtaactataataaattctgaaagtggaaacttaatttataaaagcaatgaagcttgagacctaactttgtgggaaaacaatgcaggtatcttttttcacattaaaaatgttactaatgaactttagtctgattacaaagctatctgaaggaaatagcatgccaagtgcaattatgaatataggtaagttggataccagaatctgttttaattaagtaaaattatgaaagtgggataaaaggacaaaagctctgaaaaacaaatggttgattccagaaatttttattcagataatgaataagacagctaattatttggatcatttagttattgattaaaatggtaaaagtaataaaaattatctgtaaagtaatgtatataaatatagccaattagaaaaaaaaagagcaaagttgctggaagaaataatggcatcaaaaaaattaaaatatcaccatttccttcagctaaagattatgcaatggtagaaaaacatactataacagagaaatgagtttcatatcaatattttacttccttttttaatctcctctgccatctcctcctcatcagataatccaaagtgatgtcatgcaggggtgacagtttgtacatatggatgaataacatcaatgtatccaccttatataaaataatctattatcagggagctcaatttagctttattggggtctttagaaatttactattaatatgtgcatgtttattttcacttacttcaaatgaaaattgctttttcaaactattgagatgccaaaatataccagatatagaccagaaatgtgtagcaatttgctacctattgtcatactctagctaactttaaatttctaacaacccctgtgaggtctacaatggcaatgcgcaatggggaatgcaaaatggcttaaatggcatttggcattgaactggtacctttctgaggacaacagtttatagggggaagaacagtttcaaggacattaagaggcagcagagagttgcaaattcagaagttttatcaacattgattctgagattccacattctatctttaattgatgattatattgtccaaaacttttcactttatgcaagctcagagagaaaaagagagaagaaagtgagtaagggagggaagaaggcagagaggaaggaagggaggaaggaaaataaaaagagagagaagaaagagagagagagaagaaaagaatctgcccttaattttgctaccttcctaagtgcgaccttattgcaatttgctccccttccttttgagttcatgcctcatgaaagagtattacacacgtatgttccttactttcaactcccaaccccttccttagctcaccgtacttgtcttcttccggcagaagtctactgaatctgttctctcaaaggtcaccaatgacttcctagtagaaaagttctaccacttccccactctctcccagtcttctctgcttaagctctggtgaatctcccttcctggagccctctatgtggctgctgtcacgctctgtctactctgctatctttctctccggctcctgacctagttttccctaccttctgactcctgctctctatggttaaaagtctcttaaaaatctatctctgctgtagcttcccctttcctttgtttctctctatattctttcttccttggcaagctcatctaatttaaaaggtctgcttaccaaatgtgtacctcagtcatcatttattcaatgtaggagaacaaaacccactagacaaggtgccagctctgtctataggaagtcagtagtctatttaataggtgaaactggcaaatcaacagacacttaactacacagtctaataatttcaacagggaaaaaatgcagtgtgttctggaaaaacattaaaggaagatccaatctaatcttgggagctcagggagatttcctggaggagttgatatttaattcaagttctaagtaaaaagacaggagtatgaagcaagagaaggttccaagcaaagaaagcagcatatgcaaattattgtgattagggatataatgtcatttgagaaaccactatcagttgggtggcttgaagacacagcatgggttgaaaagtgatctgagcagatgcaatgatataaatatggctatatcaaaaagggttttaaatataagctaaaacgcttgtttgaacattatcctgaggaaaatggggggatctattagttattgaacttcagaagagacatgattagatctgagttttggaaagatcattatagatgcagtgaaatgaattgactggtgtgggaaaagaggaaaaggaatatgaggtagaaaacagtggcagttcctagtgagatgtgttgatggttggaatgaggagtgagatagtgggagtagagagaggtggacagatctgatatttaggaggcaaagtctgcacagatttggggatagaagaatttcgtccatttagatttgttcagtctatgagatgcccatgaaacgtccaagtagagatctatagcagacaagacagttggccaggagctcagaagagagtccagaggtatatttgtagtggttatcataccaacaatgggcaaaataaggaagtgcataaactgtgaagagccaagaaataagaaatctcatgcctgggtctccaaaaccctgaaagttaagaggcaaatagagaaatctgtgaaaggtactaagatggagggtgatgaagttatggcacaacaaagaagagagtaatggaagctaaaaaggagtgaaaaatgctgcagtgaggccaaattgaggactgagaagtaatcattgaattttgcaacaagaaaaatatcagtgatcacagcaaataaggtttcagtgtataagtgggggatacacaccagattccagtgaactgagaaataaacttgagagagaggaattaagagacagtaaatgcagctgagtttgtgaaaataggagagacataggagaatagctagcgtggaccatgaatcaatgtaagagtgtattatgatgggagagaactgtggtgagtaagcctatacagatatggctggttaagatataaaagtgaaatataagaatgaaatgttgggcatggtggcccacgcctgtaatcccagcactttgggaggccgaagcgggtggatcacttgaagccaggagtttggggctgcagtgagctgtgattgtgccactgtacttcagcctaggttatagagtgagaccctgtctcaaaatgaaaataaaaataaaaagggatgaaacaacactgaggtggtgagagaggatggggtaagaagcacagggaagctcaacacagacagcaagagaagcaagaatgggtgcacacagagtcaaagtgtatttgtaaagcagagcgagttaaaacattagagacatttcctccttgctttctatttaccctgaaagattatggtctgatattgagaatgactgagaatgtagcatgccagtagaggaagtggagaaagctttgaataatcatcccactaaataggagatcgatccgattacagaaaggattgccaggaagtcaggaaggcctgattgaggttgggaaccatgacatcttggtagcaataatttataggattgagtgacttttcaacagcgacgtgcagaatttcagatagacacgggaatacaacaagattgatccaggatcagaaactctcttggtggatgcactgggaaaccaagactggaggaagttgagagcatttgtgagttgtagtgtctgatcgtttttgctgttggtgtaatgatttctttaatgtcactcttgcctgtaagaggggcagtgatgtgtttattaatcatcactgtacctccagtgcaaggatggggacattttgtgtgtgcattaacaatttattaaacgcatcacagtcctacctgcaaacctgatttatttggttactattttatcaccctatcatattgcagagattttttaccttgtgaccaaccaaaagtgtattttattcgaacttaaggcaaaacattttgacatcagagatgaagagacatcaaatctattttttaaagaggtcatgaaaagaacatccctttgtctttcccgacactccatttatattacatacattttcctttcggacacttgttctgttctgttctcttgggtaagtgtcatgtgtggtttaaactcagggctcttccttctttgtggaactttatcagatacgttgatggtgactaattagatgtttcaacttcaaacaagttaatgtttcaacttcaagttgaaaagattattgcattgaactgtactctttacctttgcttctctcaagaaaatgtttatggccctattttcttattctcatatgtttgcttcttaactgtttaatgatgtcactgcctctcaatcaactctctcctaggcctctactgtcctcattaattgcagaatataattccacagaagcccctttatgatgctggagaattttcacataatttgtatgatagagtctaagtaatacctatgtttctgtcccactctttactttgaaattttgcacctccctgccagtttgcttgcatctttttctctgactttgcatgcttgaaatcgattatttggtaaaatgcctcaccttccaggtacagaagtgtccccaaccacacaacattatttgacttttagtagtagttccttaagacatgtccccagtatttccttacagcaagtgctcacgtaaagcagacgaatatttgacaaaatctgcaggagacacaggtggagagtgaacgaggctcacaagtggctgccatcagcccttccttcccggcagcagtgtggaggggccgtcagctgccagacacttcacactccactgtttgctcccgtttctcttgtaaagggctgggtgggacagcaggggtgtgatgacatgattcccagtgacagaaatcttggctcctgttggctctaagctggacagacaagaaactggataaaaattcttttaataatttgtttccgtttacagtaccacgtcagtgaccacaaatttattaggctgctcttggacatctgttagtaaatcgggcacattcatcaaatgtgaggccccagatgggagctggaaagcattaataaaatgcagccaatgttcacgaaaaggcaaggcagtggaaatttacctattgtagagggaggaggtgctctctgtgcttaatagctcttcgtcgtatacccgactgagcagaaatatctcagtggagcaattctgggatttatgtgatgcaaccacctaccatctttgtcttatctcttacttttcacaggcatgaacctgtcattctagaaacactaacctactcattctccctaaactatataaaaaaaaagtctggatatgctatttttctaagctggaagtaaatgatccgaccttgaattgtgattaaaaaaagattatttgcaggatgtcatgacactttacaatggcttaaatttttgaaaaacttaggaaaaaaaaatcaaagtataaccgaaagcagttgtttcagttaatatgacattattttaggtttagagataaatttccagcagaagaatttgtctctttatgatttgtatgaattcttgctatggccttgctgttcctctgcttgggttttctctttatgatttgtacgaattcttgttatggccttgctgttcctttgcttgagttttccagaacgccacaccatttcagtccacaaataatggtttgtttctaagaggagctactatttgctcataaaactcattttctatggaataaaagcagcctgtttaggctgattcagaacctgtagaacattttcctgtagttgggcaaccgctctccttgcttttacttagagaaaaaattgattaatcgaaacctatggataatagctttgggaagtttcattttctatttgtaactaaacattttctatgtcatgaagggtcaagggaacctagggtttttcactttaaggtaaacctccagttacagcttaaactatgaacgtggaaatgtctcctatattgttaagtaaaatatgcaagataaaacaatctatttttttaatgttaatattctctgttaagtgcattcaattcaacaatgtttactggttacccaacatgtgtgaaacactatgtaggggttagggacaacacaaagaacaaagtccttctacttataaagctcatattctagtgaatatgtggctcagacttcgggaaatgtcctaagtcagaccatgatgtgtcagtgtgggacagcccatgcccctgtcaacaggggtggtgtttgtcatgtcaagatatccttggaagtggtcaatcttaaattgttcttgaggtcaatctgacagtcggatatgagactttagaaagcgtggctaagagtaaaatgaagaaactgtttactctttttcttccactaggagtcacttgagcccagactctgggcctaaatatacctacaagattttagtgatattggccactgtcctgagacatgagaagagcctcagagaagtagcttctaaaagacacaaggatagatctgggctgggaaagggtcgtagttaccctgtgtgctgtgtttttcttcttctatccctggagctcaacaaaaccttgtgaaaagttagagtctgagagatcacggaggaagtctgtgaagtggtacaggctgcgtaataccccgggcacaagcagtgcccttggctagggtcaaagtgattgtgccaagaagtgggggggggggggaaaaggctgtagcaagagtatgggcttcacaggccgctgagggcaaagagacatgagatactggttcacgagaggcccgagaaaatgaccacatatggggagtaggaaagacactgagtggggctcgttccaatgataaagccagagtgggctcaggccttcaaagaagactggacagacagatgtgctagaattttagctatggctatctcagggagcttttcgtgagtgctttttattttcttctttttatttttttcatgtttcccaaattcgaaattacaaaaagcaaattagagttattgcttttaaagaatccaaaatgttttaagaaaaatgtatacattataagtaactacatgtgacatttgactcctgtccctaggcaggggctgctgaaacatctaccaaccaatatccatatccaaacatccaatatccaaacaaccaatatccaatatcccaggaagacttggcagatcagttcgtgagggccaagggttcactgatggtgctgccaaaagtaagaataaagatggggtgcacccatcacttctcacacaggaagcccatgactatccacacatacccgtgttcatggatgaaccccagcagaggaagaggtgaatgtcatgtttgctaaaacaaatgagtaagcctcaggcctttgaaaaccagacactccctcttcctacgggcattcagtagaagcaaaatgctactgatgcctggcagatcccttccaaaatttggtttaaatcaaaacagcagttattacccgaaaataacacaaatcacaatctgagcatgtgcctcctgtgaaatggagataatcagaattcaacatggtgcgtataatgtactgtaatgggcctcaaagcccaggtattagtgagcacggcaggaagcaggaattctggataattcaagaggccccaatcacttgaatttaatataactgcaaaattaaaaaaaaaaagcattttagtctcattagacttgcagcctccctcacttaaaggggaattttcaaaatttgaaaatcgtatcagatgttacaattgaggtttttagactcattatttttaaaagggtgaccttttactgtacagcaggaacctgtcttgtgtggtttgagacaaatgacaatgaagagatggatatgttcctaggatcatatttaggctataaaacatctatcagtgcccttatcacactttttgtactgctgtagttagcatctcctatcattattagctgtgataaaagaaaatgtttcatgaaatatgacatagaaatagaataagcagcattgttctcaactgaaatacaggagggggaaaacctaactcattcctcatctgggaaataagaaataccgcattatctttaataaaagataaagggacctgacttttcagacagctcttacacaactatctatggccgcttctgggtaacagatataatcgtacatttctctgtcattttctgagtggctaccctgatgaataggcacatccttagatgatatcttctgctctaggccttattagctttatccagtgctttttacttttcttttcttttcttttcgtctattcttcttcccttcttcctttttaaggaaagttgcttatgtcttatttctttgccaaaggaaattcaagtcggcttataaaaggaacacatatatgcagaaaggaaagtgaggctctaaaaagaagaagaaagcaaagaggccagccagctactggaagaatcagacaatgccacaggacaattgtgcatcgtccatttggtctgtgtagccatgttcatttttgttttttctagtggacagtgtagaaatatcaagctctgctgtaataggagatgttcctgtgtgtaattaaacacatctccaaatgtccattgaaccctggcctcattatgtttgttcaagttctacaagataaaagacagaaattctaattagatttccagctgccttttgtattttccttaatagctgacaactctaataaacaatatatatttaaaaaaccaatcagataaaaatgagagaggtcacaaaactctgggactggcatttatagatgcatgtgctgtccagcaaaaaccaaaaatggaattaggacagacagatcacctgctggtctctaacaaacgtactgtgttggcatgatgccgacacaccaggtatgaatcccagctctgctcctcggttctgctgggagtctcaggggcttcatctgtgaagtgaaggtgacatccctcgcctggagcagtgttcatgcttttaaatcaaatgtatctgggtttgaatactggttatctctcctattcgcttcatgatctgagacttacatttttaaatatttcttcaaattttctttcttttctcttggagttcagaataatatatatcaagttctcaacatgatgttcagcacatagttgatgctcagtaaatgtgagctttcttgcccccttcctacttacaagaactaaatgaaaggacaacatccagcatggtacctggggagacccaattgattaatgctcatgtgtgatagttcttttttgctggaactgcaatatagtgatagaggtgggaagtgaaggcagccagaaactcaaacctgaaaaagcctttatcaacgggaaagatggtctgaaataatggcagacatcctgggggaaataccccctactttggcaatgaaaacttcaacgtatggccttcatgaagacctttcagtacattctaggtttggggactttgttgtgcagagcaattggataattatacaagtcaatggaaacaacagtcactcgttgcattacagaatgcagtatttaaatgcaaacgcaacaccaaaaacaaataaggtggggagtaaaagaaaagagtgtggctagcttctaggttaaataagacagttggtcccaacaggttggatgtgacgggactgcactggatggcactgatcactttgaatggcagacatcacagagcaacatgtgcagacttctcactttctgtacactagagcattcccaagaggcaagaggccaccaaaagagagattcttggtgttgttaaatgtgtaaaatatgccaggcagagtggcttacacctgtaatcccagcactttgggaggccatggcaggtggattactcgagatcaggagttcaagaccagcctggccaacatggtgaaaccccatctctactaaaatacaaaaattagcgtggtggtgtgcccttgtaatcccagctacacagggagctgagacaggagaattccttgaacccggggggcagaggttgcagtgagctgatattgcaccgctgcactccagcctgcatgatacagggagattccgtctcaaaacaaaataaaataaataaataaaataaaaataaatgtacaagataccataattttggtggctctgctgtagactgaatgtctgtatcacccccaaattcatacgggaggtgattaggtaatgagggcacagcccttatgaatggaattagtgcttttataaaagaggctccagagagctcgctctccccttctaccatgtgaggccacagcgagaagacagccatccatgaaccagaacgcagaccctcagcagacacaaaggccaccagcaccttgaccttggacttcccagtttcccaaactgtgagaaataaatctttctgttgtttgagccactcagtctattgcattctgttatagcaccctgaatgaacatagatagggtaccaacagaatataggcaaaaataaattcctcccttctaaagaaaagctcctaatacgctgaaatgaatacacaaagaaaactatagttcttgctcatctcacatgaaataagtagaactacatataagattccctgtgtacacaactaggaagctccagctgcagtagccagggtgtgggatgagagcaggtacccaaagatatgaggactttgtttgttccttaagcattatttataatataaaatgcacgtttgcaagatgaatgtttgggtaatatctattatcttgaaactaggtcaaatcaatcaatcttgttagatttatacttaatggctccaaactatgacttcttgcatattatcatcagagtgttaaatatatctcagaaacctagaatgtttttatatagtggtctactagcactggaacgataataaagcggtcatttttattgatctcctatggacatgacagcttgctcagtggacaataaaatatatattttgtaggtttataggtttgtaagggtcttaatggttatttgcaagggatattttaaatgcttctaccgcttccctctactgaagcaagattgttgtttgaaacaatttgaagagcatacagaaaagatctgtttttattgacctgtaatatacgagttgaaatacataggaaattgctctaacaaaatggagtatccagaatgcaacaggtaaatataacatcaaatccaaggaaatacattactttattccaaaagacattatgtaatgtacctttgggtcagttgggtccatgcctctcttatggttgcccgccatttatgcaaaagcagaatccaggtctgaaatagttgttcaaaaaggtgcaggacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcattagtgggtgcagcgcaccagcatggcacatgtatacatatgtaactaacctgcacaatgtgcacatgtaccctaaaacttaaagtataataaaaaaaaaaaaaacaaaaaaaaaaacccaaaaaggtgcaggagtctggtgcagtggcttatacctgtaatcccagcaccttgagaggccaaggcagggagatcccttgagaccagagtttgaggccagcctgggcaacaaccccgcctctcaaaaaaaaaaaaaaaaaaaaaattaaaatcaactaactaaatgaataaatatcagctgagtgtggtgatacatgcctgtggtcccagctattcaggaagcttaagcgggaggatcacctgggcctgggaggtcaagggtgcagcgggccgtgattgtgccactgcactccagcctggacaacaggagaaagactccaattaaaaaaaaaaaaaggagcaggcacacagggtacaggttgtacctactgtgcttttatttcaaggtttttgtgtgactttagatattcacaagtttctctcctgttaattttctggttgtaaattgatgagatatctgcctggctacttcatgatattgatatgataatcaagtaaaataatttaattaaggctgggggccatggctcacgcctgtattccagcgctttgggaggctgaggagggcagatcacctgaggtcaggagtttgagaccaacttggccaacatggtgaaaccctgtctctactaaaaatacaaaaattagcggggcgtggtggctaatcccagctactcaggaggctgaggcaggagaatcacttgaacccgggaggctgaggttacagtgagccgagatcacgccactgcactctagcctgggtgacagagcaagactgactctcaaagaaaaaaaaaaatctaattaaatgatttggaaaagcataaaacactttataagtccaaaacattatcaaagataacagagacattcttttttttggagatggagtctcgctctgttgcccaggctggagtgcagtggtgccatctcagctcactgcaagctccgccttctgggttcacgccattctcctgcctcagcctcctgagtagctgggactacaggggcccaccaccgcgcccggctaatttttttttctattttcagtagagacggggtttcaccgtggtctcgatctcctgaccttgtgatccatccgcctcggcctcccaaagtgctgggattacaggcgtgagccactgcgcccggccagagacattctttactttctcagttctgatgcaccctcatgttcctagggctgtaatttcattggcagtttaactaaattcgtggaatacaaaggccatttgtaatggagttttattaaattaattaacaagatttagagcactttcttcttcagaagacttgtggcaggcttgggaggcagatgacagactctataatggtgtgcacaatggattgatttaattcattcggtgataattaagttacttgatccagttgtttgatggtgtgtaagcaaaacatctggttgatttgcctgaatcttgattttcactggtatttttacaacagatattgcttctagaggaagaaactttgcaggtatttgtcattaagtttttatcctagataaattatatttatccttaatcttattcttctatctgcattttaagccattttgtttacactgggttttgtttagataaaaaacaattcatttaaaatttctttctgttcacgttctcacatccatttaagagagcacaaactgaatcatcagttaccataaatccgatgccacttcagtgaattcccatcagtcaaaaaaacaagtgattattgagaattgattgaccgtggcacttcatttgatggctggagagggtatgtgtcctctgccattatgttgcttagattcaactgaagtgatgagaccaacatacataaaataaaaaatataagataattaaactaagcaacagataaagtagtatcaaatggaaatattctttcagctcatggcaaagaaaagccaatgggggctgaattatggaagaaaggctcatggaataggctgtatttgaagactagtataaaagttgtatgcatttctaaaaaattcaattcagttaaatgtgcttgcacatattcagagttttaaaaatttggcctacataaaaatacaattaagattctggcccacttgcatgttgattcttttaagtatcacaaaacatggtattaaaagcacttttcagaggaagggaaaaaaaaaaaaccagagaaattaatttgcccaatgcctgtaaccagtaagtgcttgaaacaggattgaagctcaagcatgtctgcaaagctcatgaccctcttcaatgccaggattcctctcaaggaatgctgaaaactcaagaagcatgggatgatggagagaaggaaaaaagatggagcaaatagctgccactcaaagaacacagaaatgcggccgggtgcggtggctcacacctgtaatcccagcattttgggaggccgaggcaggcggatcatgaagtcaagagatcgagaccatcctggccaacatggtgaaaccccatctctactaaaaatataaaaattagctgggcgtgctggtgtgcgcctgtagtctcagctactcaggaggctgaggcaggagaatagcttgaacctgggaggcagaggttgcagcaagccaagatcatgccacttcactccagcctgggcaacagagcaagacttcgtctaaacaaacaaacaaacaaacaaacaaaaaaacacagaaatgcataacgttccttgatacccaggagtgacagcaagactcatttcaaatcttagcctactcattagattgagggtcttaaagtactattctccctggtcagcatcactagatgagcttagtcaggatgactcttacagtgagaggcagcaaggggcacaaatgagcaaggtcatgtcaaggaattactgatatctgtcaataattttgtgaaggatccagactttcttgaagctttttattttgataaatttgctcaaaatattatccataattaatatgacatgatattagtcataaagcatgtttactaagaaaacaataaatctgttctggaagataaattttgcaaactcaacccgaaggatagtaggacttatcacagaagggcaggtttaaaaggcagaggaaacacgaacgtggaagaacgttgccagtaatggccccaatttgctcacacagtcctgcgtctgtgcattgtatagtccttccttacagtggctttggacttgtccaggggatttgtcttagtggatgaggcaatagcaaatgtgacacaaacagaaactcacgttgtgcttgtaaccctgagaataccattgtaagaagccagtgctagaggctgaagggcaagagaatgaaaaatatttagctgacagcttaccaagtgccagatatgccaaaaatctaagggagcaatggagttactttcatgtaactgagagtaaaatagcaaaatagcacagggctttcagaagcacagcacagtttcctactttgaggtctgattagttgctgtgcccccagagtgagcctggctaaagcaaagagtgtcaatagctaggaaggggctctgccaatgggaacatgtaacaacatggaagcaatggggtggactgtcaacagaagacattagtggtggatgctatgcttcttaatgggtgctgtgatgaataactttatacgtcaacctggctaggacactgtaccctgatatttggccaaacaccagtctagatgttgttgtgaaggtatttttggatgagattaatatttgaattagtagactttgagtaaagcagattactcttcgtaatgtgggtgggcttcatcccatcagctgaaggccttaagagaaaagaaacagattttctccaaggaagagggaattctgccaccagacctccttaaacatgaattcatgcctaggtctccagcctgctgtcctgctctatgaatttcagaagtaccagttctcaaaattgtgtgagcaaattcctcaaaatctctatctatctatctatctatctatctatctatctatctatctatcatcgatctatcatctattatccatctatctatcatctatctatattttctatcatctacctatcatttatctatcatctatctatctaccatccatcatctatctgtctatctctttatcatctatcatccatctattatctttctatcatccatctatcatctatctatctatatatctatatcttctatcatctatcatttatctatcatctatcatttatctatcatctatcatttatctctatcatttatctatctatcatctatcatttatctatttatatctatccatcatctatcatctatctatccatctgtacacacacacacacacacacacacacacacacacacacacacacacacattgctttgtcctgtttctctggagaaccttgatgagtactaaatttcaacaatgtagacgtatgttcaccaaggactaaattcttccttccaatccccctgcccttatccaatgattgctgcacattaattttcctccctatgaaatcaaagtagccattttatttaatctttccgccacagtccaattgtaagactaatgcaatttattctgtgttttgcatttgcatgtgaattatatatatatacacacatatgtgtgtgtgtgtatttatataacacaaacacacacacgtaaatacatatcttttagattcttactgatatgattgaaaggtacaaatcaaaatataaacttttgacatgatggcaacatgaagtttaactatcaatgccacaaacaaataattgacacaaataaaaatctgcattggcactataaattagggcagcacgtggtctgaaagtctaaccaatattccatatataagaccagattgcaacattctcctgagacagcaccacagtactaagtagagaagactctaggagattactcataaaaccctcaatgccggagtggaaacagcagaatatatgtgagaaggcggcacaacactttgaatcccattcactgtagtacatcaacagtaccaaaaacagctgcagtggggctgcactaatcaaaccactgcaaatatggacagcttctctccccgcagtggagggcaaacaccacagaagaaatcagccatggccatgtcttggaggcagcttggcaatggacaatgttgaatataggacagaaatgtgttccaacgaagtaagtccatcacactcagtgacaacatgatatcatggtgacatcctgaggcaaggattactcccaggtccagctcgctccccaccatacttagtctgtcaaaaagctaacttattaatgcaaatttacattaaccagaatgccaactccagctgcaaagtggagacgatcccactgacatatacatacattaagtaatctaaggagaatccatccaccctgtcaataactgaagatcagttccatgtagagtccttcatgccagagacaaagtaaatgagaaaaattcacaaaacaaattcacaaatatttctaagacatgcaatggcataaagattataatagtatctatatatacctaaaatactcaacttaaatggcatgatgtaataaagcaatcaatgaaacataacttacaagagaattttatgcttagagtctatgattagaagagaactttctaaaggaaggtagaaatagagaactagaaaaaaataagaaaatgatgaaaagttaaacatgcgataatagatatattctctattagcatctgtaaagggctgaatcggcagtgaagagaattagaattaatgttatgatgtagaaacttaaaaacttaatctggaagagagaagggagagagaaagctaaaaaatgaattttaaaacagagaaaataataatcgagatgtagaaaagagtgaagcatatcagtaaatgttgtttcaaaacaggaaatgagaacgaataagcaggcatatagttagttacaattattataaaaaatacaaaaatacctacaattgccaatcaacattttctgaactattatgtaagagatgtggtaataactgctttacactgtatgtaatacttattaaaccctcaggaaagcactaagtagtagatgttattattatatgcattttataaatgtagaaaatgagcttaaataacaaaacagaaaaaaattttcttcaactaggaaaaacctgaatcaacagacttaaatcagtcaccaaatttgtaaatacatcacagaacaagcaacgaaatggcaatggcccatttatattttgaatttcaaggaaagaaaaggcattacaggtatctaggcaggataaaaaatcagttttaaaaaacagcatatgcacaggcaacaaaacattctgccaaataattaaaggctttgaacaactacatataatcctaataaactgctgggaaaagtattgtagttttccaataagttagttaagatttcttttaaaaaaagatagtgtagcaaagagatgacacattaaattagcatatataaatcaatcattttcatatatgtaaacaataaaaagtatatataggaagaaaagacccacatataataataacacataataaaataaccgaaataagcttagtaagaaaagtgcaaagtctatattttaaaaactttaaagcactcctgaaagaccacatatcaaaattgaagacatgaaaagatagagtatattcttggttagaagacaactctgtaactgagcttgggattacaataaggagtaggtttgagaagtggaaaaatcggggttccattttggttgtgttgagtttgacgtttcggggagaggccttaggcactggagaagtgagtgtggagcactgtggagaggtcagcatgaaagttatgaattggagcattctcaacatatgtcacttagcaacagcgtgtagatgcagaaaggagaggaacctaggacagaaacctgaaccttccaacatttatggattagctgagagtgaaaagccaccacagaagactgagaccaaaccaaatggccagtgaaaaggatggaagagtatgagtgtgaaattctggaagcaaaggacaatcaatttgttcaaagagagaatattcattctgtattcccagtgcctggcccatggtaagaactcaataaatatttgttagatgaatgaaagtgtgaaagaagaaatggaattttcctagaaagatatattttataaaagtgtactcacaaagcagaagaaaaacattttagactaattccatatatgtgtattatacatatatgtaaactaaaaaaaatccaaaattttaacaaaaagttcaaatccatctgtattctaaaataataacaaaatatgactacatgtctaatggtaccaaaatctctgataaaatattcagccaaatgtgtcctggattgctgtaatagaaatgagttattaagtgctcattgataaaatactgaacactaagtctgcaaataatatagactcattggtcttaagtatggtcctgaagatcattcagccttctcctcctgtcttcaaatgggccatcagaacctgctcccatacccagaattagtctcttcttccatcttgccacaaaaccctctttcagcaaattattgacttctagaacatcaaaccatccctagagatcttcaaacgaccacttggctaccagagagcacacaagacagaaactaggcatgggtttctttcttattttaaaacatcttcagggagtttttgatagagttaaaactagacttggcattataaccacttagtctcccttcatgaccagtttcaaaaggcatgattggtttcatataggcagccaccaaagtaactttcataatatcagctacattattaaccacatcaaattgggatcagaatagccaccagattgattcattttccatgtgcacaatctgttacatattcagaacaatcattaatgtttcttaactcttcttgaaaccagtacagagccttggattttgtctagggtgaattacttcattcaaaaaaacaaaccaacaaatcagaaactaatttttcagcctgtcataaatatgactacagaacatgtatgttccttcctggatacatttgacttcatcttgtcataacagcttctaatgaatcttaaaaacttcctcaaagtgttcagcaagcaaataaaatcagttttccatgcacattatagctaaaacaagatcctacctgtaaattataaacaatgattgtttcttactagcttatgatatctgtgaagatttttcctgtttcttagatttttactgaactacaccttcaggttttttttgtttgtttgtttgtttgtttcgagacagagtcacgctctgtcacccaggctggagtgcagtggtgtgattttggctcactgcaacctccgcctcctgggttcaagtgattcttctgtctcagcctcccaagtaactgggactacatgtgtgtgccaccacacccagctaatttttgtatttttagtagaggcagggtttttcaccgtattggccaggctggtctcgaactcctgagctcgtgatccacccacctcagcctcccaaagtgctgggattataggcatgagtcaccgcgcctgacccagtctttaccttacagaaataatactcttttaaatctacttcacctctgatccttaatagtctttgccaatcagtagtttcctgattagccatgactgtgtcaatctattttttagcactgggattatttgtctggtcctatagttttaaaaaaacaggcatgccactgaagtgaggctgaaatgtgaacttggtaagactgtagcttcccttcctattaattatctcccctttcacctggtgataatatgatgctggcaatagctgctttgtctttacctaattgttttaataccacttaatcttcaacaatgagtattttaaaagctcatgtagcaaatgagctgggggtgtacacaggcctttatggacagaatttgagctgcatcttttgatggtattgctttataaagctagcttaaaatgagaaaaaattaaaaccttgcatcttcgtatactgttaattctaaaccattttaaggcaataattaccagaggcaggaaccacagctatgccgagttcctctctatcgatagaagggtgtgttacataggttggcatatcactgaccttttctgcagtcactgtaatgccagcttttcataactattgttttctgttttctcagaatcttctctgaacaatatgcatcttattttctttcagtgatgtgaattgtttgccacgtgtgaaaggttttacatattttaaaaaagccactaaatgtagctgggcatggtggctcacatctgtattcccagcactttgggaggccaagtgggtggatcacctgaggtcagaagttcgagaccagcctggccaacatggtgaaaccccgactctactaaaaatacaaaaaaattagcctgatgtggtggcacgcgcccataatcccagctactcgggaggctgaggcagaagaattgcttgaacctaggaggcagaggttgcagtgagccgagattgcaccactgcactccagcctgggcaacaagagtgaaactctgcctcaaaaaaaaaaaaaaaaaaaaaaaaaagtcattaaatgctttgcatatgtaggatcttgttccaggcaatgcaaagtgtgaactcataaaaattgttcccttactttggaaattagttttctgctacagaatagacacaatgtccaacatggtgaacaggtttatgacttaaatagagcgtttctctctctctcacacacacacaccatgtaggcacgagaaaaaaaatcagaattacaaataaaatactgatttcaaactgtatttaaagatgtagttaaggcaaaattataagttaatgagatgtatgtgtcttatagaaggaaagttcattaattcataatcacttgccataaattatatgtacaattattttatggacatgtatacagctgatccagtctaacgatcaccgatgacctgaatcaaataatatggcagaattaaggatgtgaaaaattgtacaaatatgctaactttcagtgaaatatgttttgactaccataaaatttatataaatgttaaaagcacagttcaaactgaattataatttttcaggaggtttgcttgcgtgccatattaaaatatccctgatgaaacatatttcttaaaaccactaagaaaaaagttcttgcaatgggaaaatgatttatttacctggatcttctatagttaagttctttatcaaccattgaacaatgtctgaacctagaaaaagaaaaaagaaaaacacaaacagatgtgaacattttgtttatacatattaactttaagaattctccacctttggtgctcatattagaaggaacttttctaattgttacaatgacagattaaggatctaccccagatggaatgctgaaaacacaaagtatggatacttagctgtccatcaataaaccaaggtgtaaactagtaaattattaaatatgaaatatgtaaatggaaataaaatttactgtactagtagaaagtgatttgtttactaaataagtgtttattaagcatctcctatatttcaggtacaagtcttagcacagcataaccagtattttataaggtagttcctgtctcatttttggttgtacccacctcatccttgtatcccctctcaagtcaaaccaaatttgtttttggttttcgaaccctcttacgtatttcaagtctctgtgtctccacagcagtactctccctgaccgaaatgtcttcccactatttttaagacactcaagattcactgatatgacagaacttgccttggcccttcccctcgtccactgagttcacagtactgtccatgaaacctcattggaacccatgcagtcttttattgtcgtgttgatcacacaccattgccccagctgtttatttgatgaatgccccaaagtaagaaccttgaagcagggtgtcatattcatctttgattatttggagcatagtaagtgcttaacaatgtgtgatgaatacaaagtatgagcaaatatgtttctacttcacacagaagagacaagagaggtctgcagaaaacaatgtttgagctagattttgaaggatgtatttttatctatgaataagagagaaatttagttgctgaaggggcctacgtaaaaactaaaaggtggaaaagcagtcaacagaaataatttactgcacactgtctatatgtaagtgctgggaataatagaaaattgaaagtaataatggagtgcacagtatattcagcaggtcttgaattctaggctaaagaattaaattttctttttcccataaggaaagcagagaaagagacatgcaatatttttgagcagaagaatgacattatcaaagtaagtttgaggagtatgactggcaatatatatgaaatgccttgtagtcaaaaagaaggcaaggcagtcgacatgtctactagttgcaatccaaggatgaagggaaaaggtcttagttcagtgtacaaaggaatttcttaaaaaattacagacttctttcaggactttacgactaattaggtataaaggttataagtaggagagattaaaaaagaagtcaaggtttctagcccggaagcatagatgaatagaatgatgaaaataagagcagaaatgggagatttagcaactgatttgcttgagacattcatttgtatttaaaattggttttctgcataactcttttctacacaaaataggaaaaatatgtatgtgaattgtttgcatacatagtaaactgtgttatgcctgcgtgaattgaatcaaacttcagtgtgaaccaagattccatttcagcctctcctggaggctggctagagttgctgtctacccacctcggagatttggcaaattaattacattaacattggcaaaataattctagctgcttgaattaaaccagttcaaaatcaatttaagaataaatttgattactaaacttgacaataaagtcccaaaagttatgagaacattcatactcaatgtcaatttcagcatgcatgcatttaaaaaaataactccaagtattgacttgaacttgtgttccttttacagctgccatggatttaaatcatttgggaagacagactcatccagatcctaaaggaagttttactaaaacagctctaagggtcaaatggaaaggagatcattctccagaaggcagttgaccgtgtcccggtgttgtgttcaaccttatagtcttaggttatctggaagcacgatcttcccattgaaaaagaaaaggagaactcagcttttcacatatacatgtagtgatccttgaccaatgtcgattcccagatacacaaatcttccgcacaagccccaagcaccctgctcatttttcagagttgagcatctatttgtggaacatatgtgagcagccactggaaattttccattcttttgaagacagccaaacattcattccaggactatacatattttttattgtgaaaaatgacttgaaaaatgctcttagagactaagtttttaaaaatattctgttctgttacgctttctttccttttctttttttttctgggcagaaagaaatacaaagaagcctaatttaaaagtatgtttaattcagagaataggaaactttctttcttagcctacttttgagtatttctgtcacaagtgtattctcagttcagctctgaaggagtcaatttaattggacttgaccaactgctagtgccacttagcagatgctgtagtagtttttttattgtgtgatcgccccagcatatttatggttttaggttatggatttttaaattgttaaattcttacccagactcaccatgttaacctatgctccatctgtaagagtaagacctcaactccttgaagagataggtagagagagaaagaggaaaaaaatccagtatcttattggaaccagaagactgaaagagaaacgtgctcctatagagtcatcttgagaagcatgactcaaatttaaaatggagcattacagtccagagaagtgtagtaggaatgccacctttacagcaattttccagctttatattaaataaataaataaataaataaataaataaataaataaataaatggctgggtctgctgaagtttttcacatataatgtatatgtagaaaattgtagcattctatttaccttgattttggagccctcaaagtaacctgtggaattttttgaaatcacactttcactgtagcctatggaaagtttatacaggcatatgtcacttttagagttgcagagctttgtgctccgtctgctcagcagaagcagtagaggttttattactgtcgaatcctagcagtatattatttaaaatgaaaacaagcaaaaacaaacaagcagaattcttcctcatcacactgctcatagttttctacctgctatactgtttcttccttccatgattttgctaatgctcttctatcttcatctctttttcctgtggtgaatcccaactgaggccataaagttcaattcaaacattatctactccaggaagcctgttgtgcccacccctcaacaaaagattgaatgaataaatagcaagactcccctccccaaattctattttcacagagtttaaaaagaatagtatccttcatgcaaagaatattctactggcatgtaatttaaacaccactattattttttttttttttttttttttttttttttgagacggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctaaacaccactattattaaacatgatgttaaattgatcttaaacttcaacattattttttcacccatgccacggatctgaacggcaaacgagcttccttacctgtgccccctgcagagtgcaaaggcctggaccaggctctgtcctaagcctgtattacttccattacggtccacgtctgcacccctccccaggattagagcacatcctcagctacaagtgtcacctacagctatccacaaactaaatctgaattagaggtgcacaaaaatattaagcattcatgaaaaaaattgcaaaatatttgtaaatataagatatgaggactctgtaagcaagcaaaatagaacacatttgatttgcatcctttacaaaactcaagtattttcataattttcagctaaagacattagtgaaaacttgagctcttaatcaccatagaaggtgcgcaaattattcctgaggcaaagacgctgacctttgcaatgtttctctttcagggaaatggaaaagctctttgtactgcccaaatacctttgctgaagcctcagaaccacatagacacagtgctgacaatacaaatatttttatttagtgaatatcataaataatccttaatccatgatttttgatgttataactattcttctttttttttttttttcctttgaagacagggtctcactcaggctgcaagacagtgcaacaatcacctcatcgcagcctcaacttcctgggctcaagcaattccccctgtcccagcctcccaagtagctgggattacaggtgtgagccaccatgcccggcaattttttttaattattattttttggaggatggggtctcgctatgttgcccagacttgtcttgaaatcctggccttaagtgatcctcctgcttcagcctcccaaagcactgagattacatggcatgagccaccaggctcagccaactattcttagaacctctcactaaatagaagactttctatatactaaaaatcatttttccaacattattctttgttccttgaagtaggcacaataaatgtttattatcatcaaatagcatgtaataaacatctattgcgtttctgtagaagtttggctgaggatctgcactttaaggaacaagaaagaaagaatgtctagcgaagcaaattaactgatctgtcagtcccttgagagaagaaacgacatcatactcatcacgtttccaccattctcttcaaagtgcttcaacacagatcatcgttaaatgtttactgaaggcatgagtcactatttatggacatctactctatacagaaaagactccaaatgctgaaaaagtcagctctaatggtgactccatctagtatgttatgacaccacagtgtatctctcattatcataatttaaaaagttcttcatgcaattataattttaactcaatttaatttaaaacacggcagaatttctttaaattaaactcaattgaatttctttaatttttaaattaaactcagtttaaaacactgcagaatttctgtaatttaaaacactgcagaatttcagtttaagttaaaacactgcagactttctgtttgagaaatgaagtgatttgcttaaagctagcatattacccttttgtaaagctgaattaatgaactaaatttctccacaatctttccaataagtaattgctaatatctaagaataacattttgtttatttgagtacttgtgtcctgtccagagccttaaatatgattgcacagccattgtcacatctgagggttcaacaaagcaaccttcaaccaaaggagcaggagagatgaactccagcccagctacagactatgttctctaaccccttgatctaagaaatctcagcaatggcaaaaatctggatatcaccaattaatggccggtgtcctagttctgtctgcctttggccaaaagcgggtactgaaaaaagagaaaagcagccactggcttccaggaactggctgggcactcacagctatgtcttggtgcttccttggtaaatatgaacaatttcttagaagaacattaacaccggacaaggccactctagaaccctcataggtcaagataaaaacaagaccactctgtaatcagatctgaacacaaacaaaacatgaacatgggctgagccataaaatatcaaattccatcctggataacatgagcgactgctgcttctttatcaatgccatatttagtcttgtctaatctgtcctcctgtagaaaaaatgtattaagatacccaatcaggccggccacggtggctcacgcttgtaatcccagcatgttggggggccgaggcaggtggatcatgaggtcaggagatggagaccatcctggccaacatggtgacaccctgtctctactaaaaaaaaaaaaaaattagctgggcatgatgttgcgtgcctgtaatcccagctactcgggaggctgaggcaggagaatcaaaccagggagctcgaggttgcagtaaactgagatggcgccactgcactccagcctggcgacagagtgagacactgtctcaaaaaaaaaaaagataccagataatggaattgtccctacttcctgacagcacccaatctagagcaaaggcccacttcctcagatcctctccatgactaccaatgccaaaatcctgtaatagattcttcctaaaaccctattactgagacaccccatggttcccgatggcgtgcattctccctaccctcaagaaagaataaagttgacttgttcgactataggcgtgttcctggtggttttgggctagaggcatcgacatttttttaatttaaaaaaattgctaatatctattaagattaatataacaacaacaacaaaatttaagttacttcatcagggcgcttttggttgtaaagagtgatctttgagggaagtataaaaacataaacttatcaaagaaggaatttgcaaaaaggtacccagaactaaagggaaaggatgtatttaggcctcaaggactcatggaggcagagactgtcatccttgctcctttctggacatcttcatttctctctaggaaacaacctttgctattttccatccacaaagtgggtcatgaaggctcacagctcctgggttaaaatctctgccactgaagacggcaagacatttgaggctgaaatcttttagtcctaagtcttaattcctgatgaagggtctcagctgcagggaggtgcccattcctgtatcagccaactgtggcaagaaaagatggatcactgtgcataaaaatggtcatgctggcgagaggtatcgatggaggcattttccagaaagaatgagtgctttgcagacataacaatgggtgtaaactacagcttccttccagtttgtaaagcttttatgtttcatcataaaaaaaaatgcagaaaagagaggaaaagtggaattcaaaagcaaaatgtcaaattttgaatgaaacgaatatgttattctgccttgctatgaatataaatgtgttttgttctatgaacttattatagtcccgtaaagcagagtaggaatacattgtttttgtgtatgtgaatgaaaccacactttatgtgcactaaaacagctactcaaagaaacttcgtgatgtgtatatgattttgtgtttttatgagtgggcatatttttaagtaaataattcactttctaaaatgaataacatgtaattgagtattgttacttctggatttttatacatcaggtatatctagagaaaattattcagttttcatagaattaaaaagattaacttctgctcacagtttgaaactggatcaaacttatgatataaagcccttcttccaatattccatagctaataacacctatgaaatctcaaaggtcaatggaaacaaaataatcaaaacagatatgtttcctttcagtaaacctcagatacatttgaagcatttgcctacgagactttaaaaatgttgttcagcagtcatttaaatgcatttgcagatgtcatggcaaaaagcaaattatctggttgattacattttctttctaggttgttgctctttagagttctctgccccttgccctaagagcagagtcacagaaaatgttgggttttgttgatataacttgaatcttcaaatcaacaggatagaagcccgatattcactgtaattactactactgtgttctgaggataggaaaagtaaaaatatatttccctaccctctggcaaggtacaatgaaaacaaattagagttctgtggtagagctccttggctgttccttgagcagacattttctcaagatcatggggatttaactagatttttaatctttgttgtgtaagttccagaaatcataaaaatatctcttcagacgcaaagcaggcattttgtctctcttcaaagcccaagaagctttaaacctaggcagcaaaaacagcaaggcagcaaagatgacaataatgaggagataaaaggtaatggagaccaccctcaggattatttcctgccctctactggagctcaggaggattccttatcaaccagagaagcttttcccaagtcgcattcagagaaacatcacgtctgcctcttgtgtgggatggtgacagtaagtgtgggaaatgcggagttaagagaaggaaggaaaatagggttccttgatgtgcagcctttattttgataaagcaagttgtagaaaaatcaagagaagactaagtccgcagtgtttccttaggatggggatattggatccctttttaaagaccattttatatttttatgttttagttctatggttctttagactcaaagaaaataaaacaagtaataagtgtgtaaaatgttcagatataactatgaattttgggtcagctaccatattggaacacattagaataaattatttattaatcgattaatcaattccatatgctagctggtaggcataaagaaaatcctagtggatcattcttgccctcaacacatatatttttttccagctacacacaggccatgtctaactgtctaactgcctctatgaaggacataggagataaagaaaatgtttattgatcgataaattaaaaacttgctcttgactggataggcacagacctcatcaatctagtccagacacagttgctgtatctgttgacaggtagagataatactttttattctttattagcagagagtaccagcattggtcaagaggtggatgaggcagaaggtacaagtagatcaaagaggattccaattccggaaatttcccagttcattaaagattgacaaaatgaatgcacttatgcatagtcaaaactacagctcaggccgggcgcgttggctcatgcctgtaatcccagcactttggaaggctgagatgggtggatcatgaggccaggagttcaagaccagtgtggccaagatgctgaacctcgtctctactataaatatgaaaaaaattagccaggcgtggtggcgtgcgcctgtagtcccagctactcaggaagctgaggcaggagaatcacttgaacctgggaggcagaggttgcagtgagccaagatcacgccactgcactccagcctgggcgacagagcaagactccgtctcacaaaataaacaaaaacaaaaacaaaaacagaactacagctaaggccaagtgcttttgtgccaatcctaattattttggcactgaacgtgctctatatagtgctatgtatagaccaaggcccagattgaaaagagtgaatctttttaaaaataaccctgaatatttcctgctgtgacaaaatattgaaaataccaattaatgatgccatttttggggttctatttaaaatgttttctattattgaagatgtaatttcaataccatgaggtattgaatgatcacgaggtcaggagttcaagaccaacctggccaaggtgctgaaaccttgtctctactaaaaatacaaaaaaaaaaaaaaatattagccgggcatggtggcgtgcacctgtaggcccagctactcaggaacctgaggcaggagaatcacttgaacccaggaggcagaggttgtagcgagtcgagattgcatgactgcattccagcctgggtgaaagagtgaaactccatctcaaaaattaaaatgaaatttaaaaagaaagaaagagggagagcgagaggaggaaggaaagaaacagaaggaaggaaggaaggagggagggagggagggagggaaggaaggaaggaaggaaggaggaaaggaaaggaaaggaggaaggaagggagggaaagaaagaaggaaagaaagaaagaggaaagaaggagagaaaagaaaggaaggaaggaaagaaggagaaagaaagagaggaaagaaagaaagaaagaaaaagaaagaaagagagagagagagaaagaaagagccaaactattttccagagggcctgagccattttacattcctaccagcgatgtaggagtgattcagtttcttcccatccttgctaacattagtgttcctattttttagttcaacctttctgatagtatgtgttgattttcatttgtgtctgcctggtggctaatggtattgaacatgttttcatatgcttttttggtgtaggtacatccttttctgtgaaacgtctcttcatgtcttttgaccattttctaattaattttttttgctattgttttttcagttctttttatattctacatactagtcctctcttggatatgtggtttacagataatttcttttactctgtaccttgttgttccaccctcttcacaaggtctttttcagaaaaaaaaaaagtttttaatttggatgaggtccaatttatcaactttttatagattatagtattaaatctaagaactctttgcctagaccaagatatccaataatttctcctactattttcctaaattttttttgttttaattttccattttgtattagtgtttgtataagttgtgagacttaggtggaacttcctttttgcccgtgaatgtccaatagctctagcaccatttcttgacaaagctatctttcctcagttgaattgcttttccatgtttgtcaaaaatccattgtgtctatttgtgtggatctatttctggattctctattctgttttattgatctacatgtctatccttctaccaacaccacacagttctgtttaccacagttatataatgtcttgaatatataatataaacataaaataaattcctcccacattatttttctttcaaaattgttttacctgttctacttcatttgctttacctataaatcttagaattatctctatatctacaaaaaaatcttgctggggttttgaaaggaatttcattaaacttgtgtatcaatttggggagaactggcttttatacaaggttattcttcatggatttgaagtatgtctctccatttatttacatcttcttttatttctttcaccagcattttgcagttttcagcatacaagtcctgaacaaactttatttgattaacacctatttaatttttgggcaattttaaacagtattgtgtttttgatttcagcatccacatgttcactgttagtatataaaaatgtaatttacttttgtatatttattgcatatcctgtaatctttctggactcgattcttagttctagaaggtttttttgcagatattttgggatttaacaggtaaatataataccatctgcaaagaggggaagctttaatttcttcctttctgatctgtgtatctcttatttccttttcttgctttattgccctgactagaaatttcaacattatgttaaataaatcctcaccttgttctcaattttagaggaaaacattcactcttttacaactacatataaagtaaacttattattattactattattatttgagactgtgtctccctctattgtccatgcttggctaattttttaaatttttgtagaaatagtgtctcactatgttgtccagccaatgatctcaaactcctggtctccaagtgatccttgcacctcagcctcccaaagtgctgagattaaaggcatgaaccacagcacctggcctaaagtttttgtagatgttctttatcaagttgaggaatttctcttccattcctgttttttgaaagtttttattatgaataagttttgaattttgtctactagcttttctatattggctaatatgatcatgtgatttttctattttatccagttaatttgctggattacagggttaatttttgaatatttaaccagcctgcatctctgaaataaacccacttggttatggtgtataattatttttatatattgctaaattctatttgttatattttgctaaggagttttacatcttaatgaaggatactggtttgttgtgttcttttctctacgttatttttctagttttgacatcagggtaataatagcttcataaaatgaattgagagatattctctcctcttctgttttctggaagagactgtgtataattgaatttttttaaagtctggtagacttttccagtgaaaccatgaacctggagattttgtttttagagatttctaaattatgaatttaattttcttaatagtcattgattgcgctattcaaattatccatttcatacagggtgagttgtaatagtctgtggtttttgagacactgatcagttttgtataagatgtcaaattatgtgtttaagtttatggtattcttttatcctttagatgtctgcaggttttgtagtcatttcccctgcttcattcccgaaaatggcaatttgtgtcttttctttttttttttttgtcttgttacagaactgtcaatttatcaatttttataaagaaccagctctttgtttcattggtttttaaattatttgaatgttttcaattccattgatttatgctctttattattttcttacgcttgcttgctttgggtttattttgctcttcttctatgttctagagtttggagtttagatgattgatttggaaattttcatcttttctaatgtatacatttatgttataaatatttctctcagccctgctttagcagtgttccacaaattgacatgttacattttatttttattgttttttttttattttccagaagatccttcaatgatattatttaaagtgtgttgtttaatttccaaatgtttggagattttccttttagttttttctcattgatttctaatttgattccattatgatcagagaacatacttggtataatgtctgttttttaaaacttattatgatgtgtttaatggcccaaaatatggtcttagggaatgtttcatgggaacttgagaccatgaaaagcaaaacaccatgctttttgctgttagttggaatatcctgtaatcaggtcaagctgattgatcatgttgttcaggtcatctacatccttactgatttttctgcctgcttgatctatggatctatcagttactgataaaggagtgttaaagtctcagctctaataatggaatagtctagttcttctttcagttctatccatttgcctcatgtattctgaatctctcttgttagatacatacacatttaagtttgctacgtcttcttggaaaaatgagctcctcattattatctaatgaccccctttattgcttccacttttccttgtggtgacgtctgcttcatatgaaattaatatacctattccaggtttcctttaatcaattttgcacaacacatcttttttctattcttttacttacaacctgactatgttgttatatttgaagcaagtttcttggggatagcatgtagttgagccatgattttatccactctgctggcctctgtcttttaaatagtatatttaagtaattacttgtattaaatgtaattaccgatatgtgatggtatatttaatgtaattactgatagggcttaagtatgccattttattttttgtgggttttttttcttgttcctgccttccagtggattgcattaatattttttaaaatccatttcaattttctaagtttgtttgtttgtttgcttgtttttacagtcttgctttgtcacccagtctggaatgcagtggcatgaaaatggttcactgcagcctcagcctcctgggcttaagtgatcctcccagctcagcctcctgaagagggaacacagatacatgctactatgcccgactatgtttttattattattatcattattattattattgctgttattatttagagacagggtcttgttatgttgcccaggctggtctcaaactcctgggctcaagtaattttcctatttcagcctcccaaactgctaagtatgattacaggtgtcagccaccgcacctagctctaaatatttttgaatgcattattgtgcagctctttttagttgatgataaaattatattcacacaacttattatagccttccggtgtaatcactttaccaatttgagtaaagtgaagtatggaaccctatgtctcttcatgttcctttactctccccaatttttaatgttttttagctaattcctctatgtacatttagaatcatatcagacgttgttacatttttttcttcaacaatcaaaacaatcaaaaaaattcagaaggatgggtgcagtggctcacacctgtaatctcagcactttgggggaccgaggtgggcagatcatttgaggtcaggagttcgagaccagcctgaccaacatggggaaaccccatctctactaaaaatacaaaaattagtcgagaagggggcacatgcctgtaatcccagctactcaggaggctgaggcaggagaatcacgtgaatccaggagacagaggttgcagtgagcggagatcgtgccactgcactccagcctgggcaacagagcaagactttgtctcaggaaaaaacaaaattttcagaaaatcagagaagataagtctattgtatttcttacatgtttgcttaccacgttttgttcttatctgatattccaaggttccttttcttatcgtttcccttttatttagaaaattccttttaatcattctgttagagttcgtcagctggtgacaaattctctcagttttccttcatctgagaatgttttcatttccccgttatgcctcaggaaaaatgtttgctgggcagaggattacggattgacagttctttcttttcagcaggaaaggaaaaattttgtggcactttcttctggcatccacggtttttctcatgagaacgctgctgtggtttgaatcatttttctcttctagttaatgtgtcatttttccctgactgctttcaagatgtttgttttgtggttgtctgcagttttcaaatgtttattaagtggcttggtatgcatttcgttgggcttatttatcctatttgggcttctctcagcttcttcaactgaaggtttatatctttgctatgcttgtgatgtttttaagccattatttcttcaagtactttttttttttaagttcagctttttattgaacacattataaaagaggtttcgtcaaaaagaccaaagcccatgtcaccatcagacttctcggattcttctttctttgcttccactttcttctcctcagctggagcagcagcagcagaggcgggcagaagctcctgctggtacagatagagccagctgctggaccaggtccaccagcccctacattgcagaggaggctccccatgttgactttggccaggcctttgcaaacaagccaggccaaaagggttcaacatttacaccggctgctttaatgagggcattgatcttattctccgtgacggtcacctcatcatcgtgcggaatgagggccaggtagatgcaggcgagctgggagacgaaggccatggcacgggtgagtgtggggctggcgctgccggacgcggatggaccgagcaccttggtggcagctgaggaaaggttcttcaagcacttttttagtccccttatctttttcctatcctttcataactccaatggcaccaatgttagatcttttgttataaacccacaaaagatctccatcccagaggccgtgctcctttttgtcagtctgttttctctccgctgttcagattaggtaatttctgttgttctgtcttctatttcactgacttagtggtttcttccatcttatcgattttgccattgagcccatccactgagttttcctttttgatgttgtccttttcagtcctaaagtttccatttttttataacttctatttctttgctgagaatttcagtttatttcctgaggccttctagtttgtaatatgcttaaagcatattattattattattattaaataatttttatcatagatcaggggtgtccaatcttttttggcttccctggccacactggaagaagaattacacataaaatacactaacactaatgatagctgatgagatttttaagaatcacaaaaaaaacaaccaacctcataatgtcttaagaaagtttacgaattgcttttgggccatattcaaagatgtcctgggccacaagttggacaagtttgtcatggatacttcaaaatctttgtaagctaatctattaactctgtcatctcaatcttgaccactattgatatatatattttttccatttagttagaggtcttcctggttcttggtacgatgagtattttgttgttgttgttgttaatacagcgtctcactctgtcacccaggctggagtgcagtggtgtgatcttgtctcagtgcaacatctacctcccaggctcaaatgattctcgtgtctcagcctaccaagtagctgggactacaagcatgtgccaccacgctcggctaattttttttttttcccagtagagacggggtttcgccatgtcggccaggctgttcccaaactcttggcctcaaacaatccacccacctcggcctatcaaagtgctgcgactacaggcgtgagccactgagcctggcctgatgaatgttttttaaaattgaaagctggacatctttgtattttgttatgcgattctgggttgtcgttggcttttgatgacaccactcctccggaagagggaaatgctgtttcatgaccacctgctgagggtagaaatttgacactgcagtgagggtggcctggtcaccactgtttgatggcagaagtctcgatgctcccttaggcttcttctgacaccactccagggtggagaagtggggtgttattactaccaggttggtgtgggatatccagtctcctctcgtgatcttcactgaaatgtggatgggggaaaggaggtctcattcctgacaagaagcagaccagtggtgactagggatggggcggggtgagggaaaatgaagaaaaatgggtttcaaaaaggcacaaggaaacttttggggagaataaaaatttctactattttgattatggctgtggttttagggatatattcatgtgtccaaatgcatcaaaattttatactttacagctatccaggttgtgtattaattatcccttaataggtataaaactcaaaacatctgaaaacaaagaaggaaatattttaagtctccttactcatgtcttcaatgtgaattaggttgtaagatggtaagactttctttttttcagcactgaatggtccagaactgtactgttcaatatgttagccactagccatatgtagctaattaattcctcatttatttcttttcttttcttttcttttcttttttttatacagagtctccctctgtcacctaggctggagtttaatggcgcaatctcagctcactgcaaacctctgcctcctgggtttaagtgattctcatgcctcagcctcccgagtagctgggattacaggtgcgtgccaccacacccagctaattttttttttttttttttttttagtagaaacagtgtttcaccatgttggccaggctggtctcgaactcctgacctcaggtgatccacctgcctcagccttccaaagtgttggggttacaggtgtgagccaccgtgcctgactagttcctcattttcactagctacacttcaagtgctcattacccacatgcagctagtgaccaccttactggacactgcagatatagaacccttacatcattaagaaactcttggacagcattggttcaggtattacaatattatgggaataattatctggatatgtgtgtgtgttcatgtgtgtgtgtgttttcataggctaatttttactttttcaaaatgaaattatgaatgtgaaagtgaatagtacaggacctaacacaatatagctatacaacaacaataaaaatgttagcatctcttccatccagtttggaaaatcttttatttgaaataagagtaagaagtcaattgagagaattccaaaaggtgccccaaagcaaaaacaaaagattgaggtttaaatgaactgtacggtataaaaaaggcaacaattttaaaagtaagatagtaaggataaatagtaaaatagtaaggctttctaattaagatacaaaacctagcagccataaaacaaatggctgataaatatgaattcacataaatttaaaaatttctatacagaaaagaagaaaaggcactataaacaaaataaaaataaataaataaatgactggtatacccagacaacaaaacatcattgagttctaaaaagaaatgaactaccaagccatgaggagtcatggcagaaccttaagtgcatattactaagtgaaagaagtcaatctgaaaaggccacacactgtatgactccaacaatgcgactttgtggaaaaggcaaaactatggagagagtaaaaagatcactggttgtcaggggtggaagagatgaacaggtagagcatagaggattgttagggcactgaaatgactctatatgatattccagtagtggattcttgtcattataacccatagaatgcacaacaccaatgataaaccctaatgtatactatggcccctgtgtgataatgatgaaccctgtgtgataatgacgcgtcagtgcgataatgatggcccctgtgcgataatgatgcatcagtggaggttcactgaaccgtaacaaatgtactactctggttgggacttgttggtagtggaaaagactgaggtatatgagagtaagaggtatacaggaaatctctttacctttctttcattttcctctgaacctaaaactcctctgaaaagcatagtcttaaaaaaataggcccggcgggatggctcatgctggtaatcccagcactttgggaggccgaggcgggtggatcacctgaggtcaggagtttcagaccagcctgaccaagatggtgaaaccccatctctactaaaaatgcaaaaaaaaaaattagccgagcttggtggctcatgcctataatcccagctacttgggaggctgaggcatgggaatggcttgaacccgggaggcgtaggttgcactgagccaagatcgagcctttgcactccagcctgggcagcaagagtgaaactctgtctcaaaaaaaaaaaaaaaatggtaccacactgtgaagacatttttgcaatcaactgaaaatggaaagtgtattcttccatgttgtctccccagcactcatcattttgctgtcacattttatatttactgatattagattttatgtatctttgttttaattgcccacttagacacagttcatgagagcagtgattttatttgtcttgcttatgcctgtatcttcagtgtccaaagtagtgcttggcatatgataagtggttggtgaatgaatggaaaaactttgagaaattgacaaagagaccagaaaaccaatagcaaagcaggcagaaatgtaaacaggatgttcacgtaaaagtcaaatacaaatgattcatattaaatgatgaataatctcattcatacttcaataaattctaattaaaacatatgaatacaagttttcactcaatacattcgtaacatgaaaacaaaaaatttataatacaccactttgaagaagagataggcagcaagagttttcatacacttgttagtttctttgtaggatacttttacaatacttataaatttatagttattacttttataactcagcacatgcactattttaaaaatttacactattggtatactcgcaaataaatgtgcacaaagatatatactcacacacatacacaaagatacttattttatcattgcttataatgacaacaaaaaaagtgctgtgccagccgggcgcagtggctcacgcctgtaatcccagcactttgggaggccaaggcaggcggatcatgagttcaggagatcaagaccatcctggctagcacagcgaaaccctgtctctactaaaaatacaaaaaattagccgggcgtcgtggcaggtgcctgtagtcccagctactcgggaggctgaggcaggagaatggcgtgaacccaggaggcagagcttgcagtgaaccgagatcgcgccactgcactccagcctgggtgacagagcgagactccgtctcaaaaaaaaaaaaaaaaaaaaaagtactgtgccaatacaatggatatcatgctattctgatgatgtgagcacttccctaagtgccaaccttactatcagaagaggacttggttgggaaggataatggaattccatcaagtgttttatcttcactaaggattttgagtttgcatcaaaacctaattactgcaaaaaagcatcaggacccatttccaaaccctcatgaaggggctctcccactcctgtatctgcctccagcaaagcactactgggatccactcaccagattatttatttatttattttttgagatggagtctcgctctgtcaccaggctggagtgcagtagcacaatctcggctcactgcaacctccgcctcctgggttcaagtgattctcctgcctcagcctcccaagtagctgggattacaggcatgtgccaccatgcccagccaattttgcatttttagtagaaacagggtttcaccatgttggtcaggctggtctcggcctcccaaagtgctaggattacaggcctgagccaccgtgcccggccactcacctgattattaaaccagattcatttaggactctgctgggcactgcgagggaataacataacagaagcatcatttctacccagaaggacttcaccgcctactaaggcaagctgtgtatagaggagaaagttaaatcattctgactactgcctttaatccaagactaaggcctgaaatcctgaagaatttacaaaatgcttagacctccattataaacttgcagttgccatccccagcctttcttactgctgcttggtaattcattttccaccaatttgttctctccttttgttcattccacaataatgagtatacatcgtgtaataatggggatactggcactgtggagagacatggtaaaaagaatggaggggtcactcttaagaaacctatttgaacagtatctgaagtgaggaaacagataaatagatcatataggcatgaaggaaaagcctctcctttgccctctgaaggttcattgaaaatcattgacaagaggcagattaataggagaaaaagcacacgaacttaatgtgtatatggaagccttctggatgaagacccaaagatatagaggaaattgtccatttttatgcttcgagtcaacaaagtctggaatatgactggacagaaagggaatgatctaatgctactagactgagtggggaagcccagcaacgcctgtccctctagattcttctggcctctctgagcagcattccttccttctgggtatggggcagagctctctctggactgggggtcttaggacctacagtccaacaaggcaggtcagataacttctttatgactacttttacggctggctttgaggagaaggggttctgatttccatgacccgcctcgggccagagggattctagtctctggggagaatggaacaggtcaggagaaggtcagagaaaaagtttgcttctgaggctgcttcagggtattgcattcttagtcccaacaattccaacgtggtaagtgctaggacagacttaagaacagccgcctacaggctcacatacatgaggtgcccaacacagactgagagagaaggaaagggaggaaacactcaggaacttgagtttatggtcagcttcctcccccattctttatggtgactgttccaatctttcaccatggttcaatttctcaatcacttctatgaagttgctcaaaacaaaagcaatatacagaagtttaactaaaaggtatagccctatttgacagagggataatttatacatacagttttgcacagattatatgcacagaattttagtccaaaacttgcaaagttctgacaaatgtatgcaccacgtcgattaaggtataaaacatttccattgtggtaaaaatttaaatgccctcctgatctttcacaccaagatcaccccatgccctgacaaaaaaaaactaggattctcatttctgtcaccacgttttagttttgcttttatgaaatgaaatctcacactatgcacttgctagcgtctggcttctttttatttactttttattttttgaaatggagtctcacactgtcgcccaggctggattgcagtggtgtgatctcggctcgctgcaactctgcctcccaggttcaagcaattctcctgcctcagcctcccgagtagctgggattacaggcatccatcaccacacccacctaattttttgtatttttagtagagatggggtttcacttacgttggccaggctggtctcaaactcctgacctcgtgatccacccgccttggcctcccaaagtgctgagattacaggcgtgagccaccgcgcccggccacgtctggcatcttttgctcaacatactgcttttgattgtcatccatgtcattacctgtattcgtgttccaagttgctgagtcacttccactgtatgaatctactacaatttgtatatagaccttcaaattttttccagtttatggctcttataaaaaatgctatgaacattcttgcacagagcttattgtagacatatattttcgtttattttggtaaatcccttccctctgcctttggtagacatataacgtagtattctgagtcttaaaagttagaaggttaggataaaaaaaaacccagtggtaaaactgtatcaataattctcaatctgatttttaagtggcctcagttataatcttcccttgtctctcacttcaattagaaaatgaaggttagcaaatattaatgccatcaatatacagcctccatacacatttatctgtctttatagctcctttctcctgttttctgttggactttgaggaaaaggtttctgttttcctgtccaaggcaaatccctcttcatcttattttctaccatctcctcaggagctttactgtactttgccctcaagtctttttcatattaaaaaaatgtctatatcaagctcgctagacaagaacatggcacacacagtctggcaaacaagaaatatatataaataatcctacaaacagttacataaagtgaaaagttctgtaaaggaaaactagagggaacaatgaaagattaaaacaacagatcctgatttagtttggaagctcaagagacttctctgaacacttggatagaaaacgttgaaactacagatgagagagaattataaataaggaaagtacttcaggagataggacagaattagaatcaaagtacagttgatgcttgaacaacacaggtttgaactacacgggttcccttataggtggactttcttccacctctgccacgaaagatagcaagaccaacccctcctcttcatcctcctcctcagcctactcaacctgaaaataataatgaagccctttatgatgatcagctcctacttaatgcataggaaatgcactttctctttcttcttcttcttcttattatttttgagatggagtcttgctctgttgttcaggctggagtgcagtggtgtgatcttggctcactgcaacccacgtttcctgggatcaagcgattctcctgtctcagcctcctgagtagttgggattatagacacatgccaccatgcccagctattttttgtatttttagtagagacagggtttcaccatgttggccaggccagtcttgaactcctgacctcaagtgatccacccatctcagcatcccaaagtgctgggattacaggtgtgagccactgcgcccagccttctttctttagattttcttaacactattttcttttctctagcttactttattataagaacacattatcgtaagaacacagtggtactttactaccacttcaagtatgttgaatgctcttttattcttggatatataataatagggcataatatatataatgtacaaatatatgttcatcaactatttatgttattagtaaagcttttggtcaacaataggtcattagtagttaagtttttggggaagtcaaaagttacagatgggtttttgactgcatgggagttggtgcccctaaactctacgttgctcaagactcaacggtgtaaggaatttgatttaggtagaaacagagtcaaaaccctttttctgagatagaaagaaagaatttgactagaaagtgaaatcagtttaaaagcgtggtatgagtatgtgtattccttatttttcctatgaaccagaaggcctgacaatcttttgagggagctgaggatgatacttgaaatttgaaggaagtggtgagaagttagaagtgctactataagaaatgagagaggctgctggcaaggaattagtaaaaggtttgctgagaggtcctgagggcccaggtgagggtggaaagcacctgtgattaaggcgctgcatcttgtacctgcaacacccaactgtgcgggcacatgcgcacagggacaacaggtggttttaaggtgtgtctggcaaaggccctggaggctattcaatgggaggaggaagtaagaaaattgttaaaagaatgaggacatttaaaagtcttgaagcgaaaataaagttaggcaaattctgccttttctgcctccacacctcaaatatacagatatgggacctgtatgcaaagatccgtccctactttatatggcaacaaaagacaaacaaacaaacaaacaaaacaaacaaaaaaacaataacaaaaactgtccttcaaaaaagaccaagtttcttttaaggccaaaaatctaaaaaaaaattctaaagagactgagcctgtaaaagagtttctatatatagcaaagattcagcaactgagataaaactctattttttctcctcttaaaaaaatggagatgccagaacattacctagacatgaacttctcacatttcaatgtgcgtataaatcacgttgttaaaatcttgttcagatgcagattctgattcagtaaacctgggttgggagcctgagattctgctttttaacaagctcccgggtaatgttgctgctgctggtcctcattgagtagcaaggatttagatcacctgaggagtgtaaatcaactctgagtgactcaatggggcttctgtgtttgaaaattgtaaaaataaataattcaaaaccaaagctgttgaaactgtaaatttttttcagccttaatggaatgtggccgtgtgcagaggctcacatctgtaaacccagcactttgggaggctgaggtgggcccatcacttgaggccaggaggtcgagaccagcatggtcaacatggtgaaacccatctctactaaaaatacaaaaattagctgggcatggtcgcacatgtttgtaatcccacctacttagtacgttgaggcaggagaattgcttgaacctgggaggcagaggttacagtgagccgagattgtaccattgcactccagcctgggcaacagagcaagactctgtctccaaaaaaaaaaaaaaaaaaaaaaaagaaatgtgattatgacattcagtcataagacagacagctataacctaggcagctgtaacctttgtttctctgattatagattggcctttactttacttacattgtttcgtaaaatgtaataaaggattaaagggcaccagagaagaccccttgcctcttcattgttggatcttcattatagattaacttcccttttacttcttttatacaaagacctcatgactatcacacagtctgaaacattaaatatacccttctaaactggaaaagggaaataaaacaagctgtaactaatcaaattgctgtaactcataaaccagccttgtatggaaaatattataatccggttaaatttctttgttttctgcctgtataagcaagaccttaacttttcagcttgggagcactgaccccattcctttggaatctgggttacttacatgaccattctcagctttgcacatgaataaacacttttaacctggattctgactctttcatttatttcaggttgacagaatgtaggaagagaatctggcagatctcagataaacagcaaaaggaagagagaaggtcctttgggtccctgtggtgaaggagtctatagtgacctgaattatgaaactgccccatagccttggaggttagagttcaaataggaggtaccattcagatttcccagccattactgagttgaaaactggtggcatcaactggcaccctgtagataaactgacacacgactgtaaacccagaaattggaagtgaacacttctctcactgttatacttgaatgggcatgttagaaggcatactgcaaattgttggaaggagagtcaacaatgagggacaaactagaaagtggaagaaataggtcagatgaaagttcaataacaaagcattaagttgagatggtatttggggtagtacctagtaagacgacttaagaaacatggatgaagctggaaaccatcattctcagtaaactatcacaaggacagaaaaccaaacaccgcatgttctcactcataggtgggagttgaacaatgagaacacatggacacagggaggggaacatcatacaccggggcctgtcagcgggtgtggggctgggggagggatggcattaggagaaacacctaatgtaaatgactagttgacgggtgcagaaaaccaacatggcatatgtatacctatgtaacaaacctgcacgttgtgcacatgtaccctacaacttaaagtataattaaaaaaaagaaaagaaacatggtatgactttctgggcttgtgtatctgaaggaaatggctctgaagtgatggctgtgctggtgctgtgaatgaacacctgatcatggtaccagtccacagtctggatgcttgtggtagagccaaagaattagaatttctctatggattgacgtttccaacataatacacatggatttaaacagttaaggcaaaagtgtttagcaacatatgctttcatgtcactaacctaaatccaccaggaaaaaaccccaagtggatcaagaactctgctctgtgatgatctctccctgacacattcagcacacagaaaggaatcattgctgatcgtttgtaacatgccaagaatgaaactgcattttgggatactttattttgctctcctccttagaggccaagagagaaattaaattaaagtccatagatcaaaagcataacttctcagctaaaaatgcagctacacattagttaacattcagaagaccaggccctttgcggttttgtgactttcaagttaatgtcttctcagccaatgcactaatttcctgctgatcctatcaatgggtcgcgtctgggaatcacagcacctacaatgtcaacagggagaatatgcagatgtctctggtggaagaggtgataagctccatcaaagtcttgatcctctcatcagaaaggctatcaccatttttcgtcccacatgggttttcccctctgtcaatatggccccgtgcctggtaaatctgcataatgagatggttttcataaatcacgtgcaatcaacacacagatttttttggacctctaaccaagactatatgtgttttaactagactgaatacataactctagtgaaataaaaagaaagtttgtctcaagcagagaaaagtcttcaaaagatggctgcaggagtatgcttccccagggagctaatctgtctgggttaggataagaaataaaatgattttgtttttcacatttttaaaaaagttcttgtggttgcaatatccaacaaaatgtactgttgactgcctcaaatggacagtgcatattcttccaggatgggcttggggactgaaaggcagaaggacatacgtgccccttccttcctggcagcaggggaggaaacggcctcatagaatggcagagagcaaagtagagcagcctcatgaaagaggccatggatgctgacatgcttgctggagaagatgaaagagatccagaaagttcctgtggccccttgagtgttagaaatgaaaaccaagtaaaaagtaagaattaagttgtctgctgggggctctccacagtgtggattgagggacctttagatgatggtgtcaaaggcattcgaaccagagtgactccatcttgagtaagggctagggaaaaaatgaggctgggacttgttgggctgtgttctcacaaagttaggtattcctagcctctaggtgcttactgttaagaaaacagattgataacatttactaaacagacccagacttaggagtgtcctgatatccccataccttgagaacagaagcattcttaattttgctttaaaggtaataatatcgattcttacaaaacatagtaattaagaaaattaatcctatatcacaaacccatgtagcacaacacatgatcttttgatatatatatatatctatctataaactagtattgtacctaaggtggatgcattcctccccttacttttggcaacgccctactctgtctatggagtagctgttctttattaataaagctgttctttcttaataaacttgcttttgctttgcgctgtggtcttgccctgaattctttcttatgtgagatccaagaaccctttcttggggtctggactgggacccctttctggtaacatcactagccagttatagacaacagtagtaatggggtggtgtggaggaagggagaccttacattgactatacccagagaacagaccgtgagctatatcaatgcaggaatattgaagagtgaatgcaaatagggcagagggcaacacgcagatacacaataggacatgacatctcaatgaagataggtgagaccggaggaccaaatgaggaccagaagccagggaaaagtccaaggtccctcatgcaaaggcacgagggcacacaacctacttgccttacaccagagtgctgtgcaagaaaaggaaggcagagggaaagtagatctgggaagaaactttccccagatgacagtaagtcaccagacagtggcaggataaccaggaagtgttcagttatacataataggcaagattaaaccacatttccaaaatctctcattatcccccttcctgacccttcatcagtcaataaaatagggctcatgaggacattcgggtcagttatacagtgaaggggaccaaaatatgtcacccaaatatacttctttggcatatttcaagatggctattccgaaaggctgcagacagaaatagtcttgcaaagctgccttttgtgctgcgagatttgcatctgtagagaaaatctacattggtgaaataaacacccaggctctctctgagtcccccttaaccagctctaggaaagattaactcacagtaaaaggagactaaaagtctgggacttttaaaggtctagcagagaaacttttaccactggctactaactgttctttctaatggctgggctgctacccgtgaggtttcatctgcataacaagatagcctttgcttgcaatgcattcctctctcactcttacataacctgtgatgctacctcctcccagaagccctaagcccctactcttctgtaacttcaggctggtataaaaatgtcagccatctgacccctcctttttttttttttttttttttttttgtgaaacggagtcccactctgttgcccaggctggaatgcagtggtgtgatctcggctcaccgcaacctccacctcccgggttcaagcgattctcgtgcctcagccttcccagtagctaggattacaggtgtgcaccaccatgctcaactaatatttgtattttttctagagatggggtttcaccctgttggccaggctggtcttgaactcctgaccccaagtgatctgcccaccttagcctcccaaagtgctgggattacaggcatgagccaccgcacctggccctgatccctgcttcgagtctcacactttgtgtatggctcctgtgtccacatgaatgttcacacatttgaatacctttttcttcctgtgactatgtcttttcttccaaaggtgtcccagctaagaacttgcgagggttaagaaaataaattatgtattttttctccccttcaacagaaataaaaagatgtaccctctgctagtgtcgtggtgttgttgtggtcaattttaaacaagctgcactagggatctgaaagggcccctcctccatttcatagctcagaaagcttgactgttgccttcactctgctggtgagaaaattagctcagcaaatatgtctcttcccactcaggcaaagcaaaaagaaatgacccctgtcaaggaatttaaaaagctgttacctaaaaggggcacaatgaggacattacctatctccattgtcttagtgttaggctacataattaaaatgactccaccatatcatgttcgtaaaagacataatgacaggaggggacagagcaaggtaatgtcgctcccaagagtcagcatattaatggggcctttcagtttgataatgtaattaaccttcttaaatcctactctcagtaaaattccaaggagcagaagctacaagaataatgtccttttcaagtaaccttactagcatcagggcattcacttgagaaatggtggtgatggtcaattcctgataaaagactttaaaacactgtttctaaaaaggtctgagctgccaaatatcagattcacatgaccaagcctatgttttcatcttcttctcttgatgaaaataatttctcctttctttcacaacctttcattttctacattttattgaatttgaagtcttgaaatgcaaagactagagagtcccatggtcgattctataaaatccaaatcatctccttcattggatgctttatgtctacaaccagccttcaatacataaaacatgagactgtccaacaaccaggtggcattggttagatagtatctctatgtatttacaatattattcttttatgcaatgttacttaaaggccaaattttaaacattaatagttcagacagcacttcaccagttttaaatccactggactgaggcactcaatgttacttgtctacaggtatctacagaactaaacttttgcaagctctctccagtcatttcgactgtggcccaatgatgtcacaggactgttgagacaacagaaatcactggatcagtcatgtaactaaccagtcattccctaaacatggaaactgctcaactcatttattatcatcctttgaatatgtattatgttccaggaagcaccatgatccttaccaagagggaagtaaaatatttccataaatatctacagttaaaagtttccatataagtggtagaaacaactatgaaaatcttgaggacgaatacatcattcctggatctggtgatcggaaaaggcatttcagctggccatgaagaataggttggtttccgtcagactgagagacgagactcttacatagagaaaaggattctccatcacttacatcaaaggaaaaatttttcatgggattgacaagtcatccagttcagcctagatacagggaaatagcgtgaggtaacactaaaaaagttgccaggtttcagaaaaccccttcagtctccagtgtgtttatgggcattgaatcacaaattgaaaaattctcccatttcatattcacaattaaggtacttctaaatctaaagttgcacagtttcaaaaagctttagttttcatctccaggctgtcaaagaaagtccaagatcttctaagataatcctttggaagctgagaaatagctataacttccaatgacagatttttattgtacccgaaatttcaagtttcattatgttcatctgtcgtgtactttctgggctaattgttctgctgtagcttagaacaaaaaatataatgcagaaactattcaataaaacctctcattttcacagttagggttcttaccattttttcttggttgctaatgttttcaatttggccatttgtttaaatttgcaatttgttagtaatttgcgtaacttaaacatctaatatataaacctttaacctattgaccattatagcttcatttcatagaagcatttataaacaaagtacatactagaagctgaatttgctcccccaaaagtttacagtcttgtgcattttagagtaaatgattggtcttgtactgattgatggtaacaaataaatgtcaacctcaattttgtattccaattttaacaaaattttggtacattgcttttaccattactatcaagtgaatttatgtaagttaatctaagaaatggcaatgatattttaggataatttcatttagatattttattcttttaaaaactaagtatattctctttccagtgatcaatataagataatatctattataagaatcaagtcagatcaaagtaaggcattgacttttttctgatctcccacattttagttgcctaaattgaatatttaccaagttctgtggcttgcactgcagaactgcactacattaagataactcccattaaacaaattcactttagtgtgtaatttaatcaagctatttgttcagtttgcaaccaggtcttaatttattgtttaattcagaggttactagaaaaatgctcacctaaaaataattaacctagaatctggcaaacttaccttataagaatattggcagaaatcctgtgtggggtgtgaggtacgatgggataacatggatgtgaaaaattatgaagatttggagcctgcctcacaccaaaccaggtttaaattccttagaaaaaattttacataaaaactcatgtctgggtgcggtggctcacgcctgtaatcctagcactttgggaggccaaggtggtctgattatgaggtcaagagaacaagaccatcctggccaacatcgtgagaccctgtctctactaaaaatacaaaaattagctgggtgtggcggcatgcacctgtagtctcagctatttgggaggctgaggcagaagaatcacttgaacccaggaggcggaggttgcagtgagccaagattgtgccactgcactctaacctggtgaaagagtgagactcaatctcaaaaaaacacaaaaaacaaaaatcaacaacaacaaaaaccaaccaaacaaacaaaaaaaaaaccccataacaacgtgagaacaaaagaaaacaagtaccagaaaagtgaccgtgtaatctatatcaatttagggagagacctgggactagagtactaatgtctctactgtaatacttctgtcatgtagcatttatcagagtctaaatttgaagtgggtttttttggagacagcatattgtggtctaattttttagtgcaatctgccaatctctacctttatgtggcatgcttatactattcacatttaaattgattattgctatattcagataaaaatctatcatctgtccacttgttttctactcattgcatttgttgtgcattttcctcttcttttactgccttccattgatttacctgagcattttatatgattctattttatctcctcttttggtgtataatttatgctgatttttataactttttaaggagttgccatagatcaacaatagatatttttaaatgatctaaatctatcctcaaataactctgtactcgtttattacaagtgcaggtacctaataacaaagacttcctaattcctcccttcccttgcagcattgctgtcattcagttcacccgatacattgctactactattgctttaaatgaagttatattttagattaattaagtggattgcttgaggttaggagtctgagaccagcctggtcaacacggtgaaaccccgtctctactaaaatacaaaaattagctgggcgtggtggcgcacgcctgtaattccagctaccagggaggctgaggcaggagaattgcttgaactcaggaggtggagttgcagtgagacaagatcacaccactgcactctagcctgggtgacagagcaacactctgtctcaaaaaaaaaaaaaaaaaaagtgagaaaaagaaaatatttaactttaccttcaattatgccttttttttatgttgcttctttgtgtatatacgagtttagtctttatttctctgtcacctttgaaacatgttagccagacatagaattataggttggcagatttttctttgaatacttcaaagatttttctccattctcttcttgattgcatagtttctggtgaaaagtcttctgtaattcttatggatgttcttctatagtttaagtgatttctatccccctctggttttctgcaagattttatccttttcttgatatgttatactgtagcttgaataggataagcctaaggtttttggttttgttttgctgttaatcctatttacccttttggtattttatgttgtctatttttttcatcagaggctttaacatggtaatcatagttattttaagtttcctgtctgttaattccaacatctgtttcatatgttagtcgggttctgatgactgctttgtctctctatttctttctttatttttttgaggtggagtctcactctgttgcccaggctggggtgcagtggcatgatctcagctcactgcaacttccatctctcaggttcaagtgattctcctaccttagcctctggagtagctgggattacaggcatgcaccaccatgcccagctaatttttttttttttttttttttttgtatttttagtagacacggtgttttatcacgtggccaggctggtctcaaactcctgactcaagtgatctgcccgcctcggcctaccaaagtgctggcattacaggcatgagccaccataccctgcctcgccttgtctctttagactgtgttttttcctcatgttttcgcatgccttgtaattttttgttgaaagccaggtatatcatatcaggtaaaagggactcaggtaaatatacctttagtatgagattacctttatttatctggctagcagttgggtcatgtctaatgtttgttgcagctatagataccagaggctttaaattcctctagtgtttgttttgtttttgtttttgtttctatttttttgtcttttttcttgatttgggggatattcttggtacaagtcttcaagaatgtgtcttgcaggtctttcagctgtaatacattgttactatactggaggcttattggtgtgacggtaaggtggagcggaggtggggggcattctataaacttctgcataagtctcatttagtgagactttttcttggggctgtggccttcacaggtgtttctgtccctccctcctcaaggggtagaggtttttcctctactttccctacttccattcatcgcttcagtgttctcaatccatttcctggatgtcatataccctgataattaggatttttcctttttctttaggtgagatatgctcaagtggggcagaattccacttcacaagctgggataaggtttcaaaattgccctcaggaaaatttattcccctggggactaggcctttgttaggcacaaagtataggacacattctctttcctttcccctgcgaaggccatgaggggatttttctcagagcctaaccatgaaaatctggtgctgtttttaaagggaaagcctacaatatgtgaggctatcccatgaccagggcccccaggagtgactcactctaatgctggtctgccctcagtttccagaaattcatcacatttactatttaaatgttcctgctaacttacggtgtctagcatcttcatttaaatgttcttactaacttatggtgtctagcatcttctgctccaagtaaacaattctttctgtactgtatctctctgaaggagtctgttgctgcagacttttttctttttttagaagaattataactttattttatttatttatttttttaaattatactttaagttctagggtacatgtgcgcaacatgcaggtttgttgcataggtatacatgtgccatgttggtttgctgcatccatcaacctgtcacctacattaggtatttctcctaatgctatccctcccccagctccccaccccgcaacaggccccagtgtgtgatggtcccctccctgtgtccatgtgttctcattgttcaactcccacttatgagtgaaaacatgcggtgtttggttttctgtccttgtgatagtttgctgagaatgatggtttccagcttcatccatgtccctgaaaaggacatgaactcatccttgttttatggctgcatactattctatggtatatatgtgccacattttctttatccagtctattattgatggacatttgggtcggttccaagtctttgctattgtgaatagtgccacaataaacatgcatgtgcatgtgtctatagtgttgctacagatttgaaaatgatatgttgacctatgacttcagttctctgatgggtagaagaaaagtcattgaattttggtttgtccagatttttcttgctgtaacaaagatttccaagtgatgacttaaaaagagtgatgacttcaaaagagtgatgacttctaagttctttgcatattggaaataaaagtggaagtctcagctcttctaatctgtgagaatgttagcaagttactaaatctctatgtgcattagtttttatcatctgaaaaaatgggtataagatgccttacctaatgaagttgctacaggggataacttctaaaaaacatctactgcaaagtctggtatgaagtaggggctcagtcagtgctatttgtctaataaaacacgcatgtattcatttcctagggctgtcataaaaattattgcaaacttggtggattaataaacaggagtttattctctcagaattctggagtctagtagtccaaaatcaagatgttgacagggtcatactcccttcaaaagctcttgggaataccctccttgccttttccagcttctagtggctgcagacattccctatggctacataactcccatctctgcctcagtcttcacatggctttctctgtcttctccttctaagatttatggcccacccagataatctaggaagatctcatcttgagatccttaacttaattccatctgcaaagatagaattttccaaataggtcacattcacaggttctcaaaattaggacatgaacatatttttttcttttttgagggaaagaccattcaatcttctataatgtattagttaagtcagctgttgactgaaccaaactatcagtttggccaaacaattaatcttaaagttccatataaacttctatattgccctagaagaatagagagtagtgttttaatttctttgtccaatagaatagattccacaatacaaccatcagtgccagacagtcaagaaaacatgatctactgtatcaacttactgtttttccttcaaggggatcacaatattttatccacaaaagcaatttgggatcattcctttgaatagagaggaagcaaataatatggttcttatgttgtaaatgggaaattaagacagaagggtaatccagttaatgtttatggtttaattaaaaatgctgacagaaagactcacgacattggtagaacttcttattagtgttgtcaacatagctgtactgcctcatcttcttattttctttctcaaatttcaatctccagaaccaaagaagctctattttgcatgcatcagtaacaatgagcaatttacacttagcgatcctcctctgtcacacaacagcagctgtctgtgagtcctcattctactgtgagaagcaggtttgctgttttattcctctcttattcagtgcatatgcaaggggtggggtggagggctgggtacagaggacagcaaggagacaataatttatcatttccaaacaaacaacaaaggttgtttcaaaaatccagcttactgtttttattttcagtctgtaattcattttcaaaatgtttggacataaccctttggctttgcttctgagcatttacatgacatttagacagtgaacacatctccgattggtgcacagctatgggcatatggcacagcttactggaaacacggattcacaagaatacgtatccagtttcagaataagaaccaagtatttgctgactgagtgtcatgtggactgttttaaactccctatccataactttcaaacctactctggggggcggtcaaggggaggaggtggaagggtagactgttggctggaatctaatgcctttcctttactattaaaaatctatgtgaaaacattcctaatgggtatggtaatataccactttcgtaccttataaaaacctatttacttagtttactcagtttacaagctgagatttgaagcactaaccactcggggtcctatcttgatagccctggcttacttaccaatataggagaatgtgttctgttcaacctgagaaaaatggtgggagaggaccagcagttgaacacctggcccatctaaagtgaggatggtaagaatgataaaggaaggtgaccagttgcctcctgggttctctgatcactgcatgtttagctgtgcggttaagacagcagatttaaacgcaatacagggtcctacgatgacaatattatctgccattgattgaaaactgattatatacaagggggttactattcaaaacctcattattccttataatagccctattaggtaggccttttcaatctcacatcatgtattaaaaccacctttgcaaaaattataactgataaaattattacagtgaaagaggtctgacctaaccaacttggtcttgcttttaacctccaagctgtccttgttcattcctgggtgtagagtgaactaactttgggagcaacgcagtttagagtttaactttgaaacataaaataacagtcctttcccgcaaccaaccctcttcttgcctttgttagactgcctttgcagtactaacaaattagccagaagactagaaattatagtttaggagtcactgttgtaaaacctgagattagtgtttgagatactttgcagagtctacattctaatgcaccagctgatgccacccagatctataaactgcctcatctggtcttatggcccccatccaggaactgactcagcgcaagaagacagctttgactccctatgatctcatctttgacctgtccaatcagcactcccgactttctgacaccctacccaccaaattatccttaaaaaccctgatccctgagttttcaggaaaattgattagaatattaactccatctccaacatggcgtggccagcatcgtgacacttaagctcttcctttactgtaatgccatggtcttagtgagctgattttgtttgtgcagtgggcaggaagaacccattgggtagttgcaatatgatcaaagtgaggcttaaaaggttaggtaacttgctggtggcctcactaaacctcactaactccatgctccctaccatggagataccactactaataattaataataactaataacaactattgttgttaaaatgatactgggtaaaatcatgtaaaataacaactatgagatatagttgttataatgattaaataggtaaaattgtgtagaataacaactacagatatagttgttatagttaaatgaataaaatcatgtaaaatttacaatcgtgtaaaataacaactatgagatatagttgtcataatgattaaatgggtaaaatcgtgtaaaatgctgaccaaaacagccttaacattttcctcagtttgactaaactttagttcagcttcttctggactcaggcccctgaactcccttgttttagagcgcttactttagaaaactcgtagatgtacattttctctctgctcctttaggtgtaaatctttttaaaagcctcttgccagttttgtaacccagcactgtccttctcaaggacctgagaaccattcctttgaaaagtcatcatcaatgaagacagtgcttcccagtctcccagggagggcacaggcttaaattgtcctagttgtaaaactacctcctgtcacaaagatatgagaaaattaactttgttttgggatcacgccaattggcaaacatggatgccctgtgatacgccccactccagttcttgaaactctaaaaactctaccatcctttattccttgagctctgtcttaattctgatttatcttccctaatgcaatagccttaaataacatcttccttgcctgtttacattgtcgagtgccatttttgtttttacaatgcttttcatattgattgattgattgattgattgatcaagatgtagtttcactcttgttgcccaggctgcagtgcaatggcgcgatcttggctcactgcaacctcagcctcctgggttcaagagattctcctgcctccacctcccgagtagttgggattacaggcatgcgccaccatgcccggctaattttgtatttttagtagagaggggtttctccatgttggtcaggttggtctcgaactcctgactcaggtgtggtcgacctcctgcctgccttggcctcccaaaattgttgggattacaggcatgagccaacacatccggctgacaatgctttttaataactgtttcaaagatgagaaaacagaagaacaaagaaataagctaatttatccaggactgtaacccaggccacctagctttggcggtcatgtctgaatcatcatacttcaaagggaaataatatattcacacagtgataaggaggcatgtgaagcctagcaccttcacttaacaggtgctcaaaagctggaagctgtgataatggagaggaaggaggaaaacaggactcaggacaagcagatctattttggatccaggcaatacctcttagtaatcctgtatccttgggagatcacagtaatagtacctgagatttgtgcttatgctatttccctgcagctgaatggaagtacaagtgttctcattgcctaggtgggttttgcacccactcttgattatccagcaggaagcacaaacatctttgaaggatgatgagctagtataccagtgacattctggaataatatctcattatattattattaagggcaagaaagaaatgtgaattgactcttttaaagacaatcaaatcaaatataaatgtcattaaatagacttaaggacgccgaatggaagaataaattatggagcagaaagtcaaggttagtcacagaaactaacaaacatagggagaacaaaggaaattgtggagagagatgtatattgatgctcaaaaagacactgcagatcattgatttgaaatgcttatgtattaatattaactggggataattcaggcctgttttgtattgtacccagattagaaaagcagatgtgattctcccacccctttatcaagaacgagagtaagtcaaagagattgctgattgcaaattaaaatgttaatttctatccattttaatttttgataaattcttattgagagctactaattttagaaactttcaagtaccgtaatagctttcagtctattgagtccctgggaatttgcctttggggccaattgctttctgcctccattatgaagaaatattaaatgctatcaggaagcgcaaaagccacccttggtagagagacaaatttcaatttatgaaaggcaaagtattttaggttatgtaatatgctctccagtgcaaacaaggagttgaggatactagctttcaaggaaagtacaaaatacacaatggtgttgaacaggacaggtcagtggttagcagaagtagtggcagcaacatcagtagaggggtagtgtggtaattagatagtgctatctaagctttactgaatgcttattaagttcttatcacagatccatgggctttatatgtattaggcattttaatccttacaaaaattattttagatattatcattatctctggtctacagccagggaatataaaacaaagagaagttcagtcatttgtccaaggtcacagagctgagaagctgagatctgaagccacattgtgaccaccacctccagattcaagctctaactacttggcatgcctactgcctaggggctgtgcagggagcttttcatattccacattgctgagaactgatgaaactaaatatgggggagggaagattgtctttttgctttatctatgcctcaagaaccacagagatgaaacatgtacaaaaatgggaaattctagaagctttttttttttaatgaaggatattacagttcataagaacaaagctatcacaggaatcattttcaatggattcagttacctgatgaaggtactgaagggaaatgcagaatccaaattatctaacagataattcacaaaatatgattgacagtggactcactttctggaagttagagcaggctggtgctaaactgaatcataatggaatgatatattccctcaggtgaaatacagtctaaatcttcatgctgttcgtgcagcacatagcattaatagaacatagtaatgtggacatactttctaaagcagcaatacaaatgtatattggcaaattgtctctttaatatattgtttaacttctccatagcactcaacacaatgtgtataattaactgagcaattatttatttagtgcctgcttccagcactggaatacaagctctgcatggtcagcaactacacatttttcttattatattttgccttcccagtgtctagtggtgtgcctcacacacagagggaactcggtaacatttgttgactgaataaatgtaaggtattttctacataatgcagacttgttaatttattctgctattaataatttattgccgggtgcggtgactcctgcctgtatttccagaactttgggaagccgaggcgggtggatcacctgaggtcaggggttagagaccagcctggtccaacatggtgaaaccctgtctctactaaaaatacaaaaattagccagacatggttgcacatgcctgtaattccagctactcgggaggctgaggcacaagaatcgcttgaacctgggaggcggacgttgcagtgagccgagatcgcgccactgcactccagtctgtgtgacagagtgagactctgtctcaaaaaaaaaaaaattattgagtgctgtttatctgccaggcactacactgggcactggacagctaacagtgagccaggcaggaagggccatgctctgggggtacttacattacagtaagagagagacacaaccttgagcaatgcataaataaaatcattctagatattgttaagtactgtgtgaaaatcaaagagtctggtgagtgagagggactacttggtgagcggggtttggggcatccaatgttaaactaagtgggcttagaggatctctctgagtgatcataagacatccatgatgtcttcaaaggaatcaaaggaaagggttttgtacgcgtaagaaatggtaagaggagaggtactgaggctagaatgagcttggcatgttttaagaaaaaacaaggttccagcctcagcaacataaaaagaccccatctctaccagaaattaaaaaaaaaaaaaaaaattagccaggcggggtggtacgtgcctgtagttccagatgctcaggaggctgaggcaggaagatcacttgagcccagaagttccagtctgcagttagctatgattatgtcattgtactccagcctgggtggcagaatgagaccctgtctcaaacaaatacaaaagaaaagaagaaaaaaaaaaagaaggttcatgtggagtgtggtggcagggagtggggagggaaactggaggagaaacttgggaagtgagcagagattctgtaataagatcctgtaataagatcctataataagaaagattcataataagaaattcgttttaattctaactgcagtaggaagttggtgagtgatcttaagtaggggaataatgtgatgtgatttgcatttttaaaagatgactttggctgctgtgtggagaatggcttgaggaagaagaatgaaagccaggagacccactgctgcccagggtgcgtggtatatgtactccaggggaaagatgctggtggcttagcctagcgtgatgaaaagggagatgagaatgagcctggttttgagattcttctagtgacagaaccaataggacttgatgatgggtgaagcgagggaaagagagacagatggaggagagcctaggtttgtatttttacaactgcatgagaggaggagccggcagttgagaaggagaagtatggaggaaaaacaggtggagagaatgggaatcaagaattgggttttgtggaacttaaatttgaaacacatattagataaccaagtagaaatgtctagtgtgtaggagaatatagaaatactgaagtaactagcatctagatggcatttgaagctacaggattatactacctgtgacaggaaatatgtgatttattaatttagtgcaagtgtaggctagctggctcgttttgaattaagatgagaggaaatagctttaccttgtggaaccactggagagaaacgtgtatcagctctatgagcatgattactgggcatcagccatgttgagtgctggacttcagaaaatgaagatcgggacagcagaggaccaagaagccagtgatgttcactaagcaggcaccagccttccctccctttcaacgtttggatgttgtagttacataaattcctggccacatagactcaaccatagagttctcaagaggatgccgatggatagagttttgaattggattgggaatccaaatcaaaagtacaagaaatctgcttgtgaattgaatttacctgacagtgtcaacattaagttgtctgctaggaaagagtttggaactcatattcagtttgtagaaatacatacaattatagcttgtgcctatccaaagctttactgttgcaatggtattatgcagtgagggaggacacagaggtagagacaagacgcacagtacacagccccaggccactgggttcacttcatcattagtttttgttggagaaagagactgagatgccggtgaaacagggaggaggagagccaggagagcacgggatgaaagaagcccatcaaagaacgtgtttcagctgaaagatgctgctgaagaggcaggcaagatgcaggcagagcaatggagatcagcgagggcccagggaggcgcagggactggagctgagggcacagacacccttaggataagttgaaaagcaaaggacaagtcgagacacaaaataatcagcaacaatattcttatgcttgagaggatcaccatctgggtagtgaggcaggatgagctacatcataatgacataaatcataaaaccgatgcgacgatgactaccaaggccacctgttgacacagaagacccaaagggaatgcgaactggggcagccagaaagggcttcaaaagatactgtgttcctatttcgaagaaactaagaataagatgaatggtgagaggaagaaaggatgttccagccaagagattggaccaacgtgggcaggcgggagaaatcaatacgattgaagaggcgaaaatcaaagggacaaagagatttctggaggctggctcggtagggttgtaggttgaggctgttgatgtaaaaaagaaaaacaaaacaaaaacagaaactagaggaagtcactctataaagcagaacaaatccaagaatttcctgacacaaaattaccatggggggagggggagggaagtagccatctagcaaaatacattacacccactttcttttagcttcaggcacagccaccaatacttattttcagcacccttttataaaaatttaaaaccccatgtaattatattcattcattttaaacataacccctcgaaatctagctttgtatttaaaaagaaaatctgacgtggggtttggaatcatggttatagatgaatttggtgacaagtcaaacattttggaaatgagtttccacacatctgctaaagaaccttttgttgccctttgagcagaatattctgggtgtagtgacatgtgcaaaataagaaatttaatatttttaagccttcaagatgaatgttacaacatctgaacaagaataaatgccatgcttattcaattaccttgcatcccagggtcttatttaccatcagctttctcagcatgccgatctatttactgctaaattgaataattccgcctaaaggagataacatactcttactgacagcttgtccctaaactcccagatttcacaacatcagtacacaaatatacaatatagaaatggttgcttatgtgcattagatctgatgtaaacaacagctgccaaaaagactgaattagcctgatcttatttcatttctcttcttatttcatttcttttcagtgatatttgcctttttaaaaataatcagttgtggcaatacgtgaagcggagaggcacagataacaggcacctccattacaccaatgacggttctgcagtttttcctaaagtctttctagaatgacgcacaacacattatagcttccgtgtttgctcaagattatttgattaaactattacactgagagtaaagattactctttttaggttgtcactttctcactgatgcttggcaatttacttaagggaataagctaggtgtaggtttgcaccccttgctctatcaagacaatggcaaatattgattggtagtaagtaaggcttagacgtggtttcctttttcttttacatcagccgtgggctgttgagatacaataggtgcagccaaaactgactgataaatatggatttctaccctcccacagggcttggaataatgattgagttgctttgttttttccagaacttatagcatatatatatatacatacacacatacatacacacacacactatatacacatatatttataaaatatataaatatatatgtgcaatatatatacacatatacaaacatatatgcatggtatgtatatagatgtacacacacacacacacacacacacacacacatccttctttgatggctccacttcccatccaattgctcaatcccaaatctggaattgccttgacctatctctcttttcctctgttactcaaagaaatcttaaaacttggctcattctcatctctcctgtcgaccattctagtctcagccactatcatctctcccctggactataccactgcaatctgggaaccagtgggtttcctggcttccattcttcctcctcaagcttttctctgtatagcagctgaagtaatcatttaaaaatactcctcttaaaaaaatcctccccacatggtattacacatggaaactgacagtccaaggctgtgatcaggcgatggtaggctcaactgggccagtccaagtgacatccctttgaaaggagcatagggagtgccctgccccaaaacaccccccaacacaaaacattcagcaacttcttttaaaaattatttgtataaatttagggagtacaagtgcagttttgttacatggatatattgcatagtggtgaagccccggcttttagtagaaccatcactcaaattaggtacattgtactcattaagtaatttctcatccttcactccccttcctgcttcctcccacccttccgagtcttcaatgtctatgaattctatagtcttgtcttcacactgttttgctcctacttacaagtgagaacatgtggcatttgacttcctatttctgagttatttcacttaagacaatggcctccagttccatctgtgctgctgtaaaagacattattttattatatatttttatggaccagtagtattctgttgtatatattatagtataccatattttctttctccagtcattccttgatagatgcttaggttgattacatatctttgctgttgtgaattgtgctgtgataaacatacaagtgcaggtatcgtttttatatagtgatttcttttcctttgggtagatgctcagtattgggattgctggatcaaatggtagttttattttttagtactttgaaaaatctccatactgttttccatagaagtactaatttgcatttccacccacattgtataaacgttcctttttctccacatcctcgccaacatctcttatttttttgactttttataatagccattcagactggtgtaagatgatatcttattgtggttttcatttgcatttatctgataattggtgatgtctagcattttttcacatgcttgttggccatttttatgtcttcttttgaaaaatgtctgtttgtgccctctgcccactttttaatggggttatttgttttctttgtcatcgttgattatttaagttcctcgtagattctagatattagtgctttgtcacatagtttgcaaatactttcttctattcttcaggctgtctgttcactctgttgattatctctttttctatgcagaagtttcttagtttaaatgaatctcatttgtccaaaatagtttttgttacttgtgcttttgaggtctcagtcatgaattctttgcctacggcaatatccagaagagttttccccaggtttacttctagtatttctatagtttcaggtcttacatttaagtctttaatctatcttgaagtgacttttgtatatggtgaaagatagagatccagtttcatcctcttgcatttggcaaccaaattttctagcaccatttattgaatagggtgtcctttctccagtgcataagtttgtcaacttagtctaagatcagttgactgcatgtatgtagctttatttctgggttctctactctgttccattgacctatgtgtctatttttataccagtaccgtgctgttttgattattgtatccttgcagtataatttgaaatcaggtaacagtgatgcctccagctttgttctttttgcttaggattaaatttggctatttgggttcttttttggttccatatgaattttagaattgttttttctaattctgtggaaaataatgttgggattttgataggaattgcattgaatctgtagattgctttgttaagtatggtcatttaaacaatattgattcttccgatctatgagcatgggatagtttttcatttgtttgtgtcatttacttgtgtcaatttctttcatcagtgttttgtaatttccctctcagagatctttcacgtccttcgttacatatattcctatttattttattttgtagttattgtaaatcagattgacttcttcatgggttctcaacttcatcattatttgtgtatacaaatgctactgatttttgcatgttgattttgtgttctgcaactttacttaattcattgatacaatcaaatagtcttttggaggagtctttaggattttataggtataagatcatattgtcagcaagcagagataatttgatttcctcttttccaatttggatgcgttttattttttttctcttgactgactgctctggctaggacttgcagtattgtattgatgaattcttcttacggaaaagtggaagttctgctatatcaaaaagaaaagggggctgggtgcggtagctcacgcctgcaaccccagcactttggaaggctggacagatcatttgaggtcaggagttcgagaccagcctggccaacatggtgaaaccccatctctactaaaaatacaaaaattaactgggcgtgatggtgcacacctgtggtcccacctacccaggaggctgaggcaggagaatctcttgaacccaggaggtggaggttgcagtgagccaagattgccccactgcactccagcctgggtgacagagcgagagtccatctaaaaaaaagctggctgggggagcgggggaggaaagttccataggcaaaaacaataagtctctattatatattcatgatgaaattctcattggtccaaaatgaaatgaaaaatataaaaatgatatattaaaatttttatacaattcattatgagtttttatattttatataaaaatgatattttgaaaatttttatgaggctaaatagggttaatttttaaatatttattttttactgccctttactattcttttttagttttggtgataaaatgtcctttcatttaatatgttatggtgatatcagtttacagttatctttttatgtctttacttggcaaagttaggttaacaactctatgacggtttcctaatatattgtttaaatttatttgttcacaatatccaaacctttgggaatccttaatctagagcacattttaccaaagtgccacctaaattgcagttggaattgcttgcaagaaagaagggtgggagaagtttactgtcgaatatactcaggatgctgagataagaaacttaaaaaaaaaaggaaccttaccacagaacttctcacagccttaaacatgctgatgtagatggtgaatccccaaaatgaagatacagtatacagcatatcccacaattatttgaccaaggaactcttgcacgaagaagcatcttagagacttgtcctggaaagtgttaatctagagactcacaaaatacttcaacaaatattgaatattggctggcaaatagaaatgcataatgacacttctatagaaagaggaatccaagggacataaaagaaattaagatgagaattcagagatttgtgccatgtcatcctcgactacagccttagtattttcaacttactggtttcttagcttggtctgcatatttgtgaaagaataagccccattcatacgcttatattttcccaaatgactttgaaatgtcaagccattgtatgaatttgaaacggcatctttagacctttactgaagttatgttactgttgccggagtaactaacaagtatcacagggcaggggaaggcagaaaaatatcctttcatttatcaagcactgaataaagcaagaggcttagaaatgtgcgatggaacacgatgttacaaagctattgttcctgtacctgtaaataaaaggtaacaaggtccatttgatgacaaagagtcatgagacagctacacagctcctcttcaaaaggaaacaataaaaacttttaaaaataccaaataacattacacttcttgctctaaaagtatgctggttatataacagaatgcaagtagatttataattagcacttgtttatagatgtcttatactgtgtcatgcatggaggggcaaaagaggttctgatggctattcattcagatagaagttatcgaggccataggaagtgagagcgccatcatactaatgttaaatagactgaacaatgggaaatttacaaccagcacaaggatgaatcagttgatgaatatcacattgttgatagaaaacgattttgagagagtggagcaaaacttatttaggaagttagaggcatctctcctattctcttcttccaaccctccacttcttctcgtatttaagattaatagataattagggtagaatggatgctctttaaaagagaaagcactgaacaggagagattgtgaaggttttttcatgctgtggactcaggatgcaagaggggctgtaactctcaggatacaatgagaagaggcatcatcctttctggggtaacatttggcagtatagagctagaatagcaacattaagggtagcaagattaacagcaagaatacagggatcagaaagtctgaagctcgaaaatgctctgaaatcaagtgaagtgatgtaaagggaatatctaagttcatttctataatttctaggccagatagtttgttaaaatatggaagaatgcagggatgcaaaatttctccaggtatataaacagcataaggaagtaaaaaaaaaatatagtactctgagataatttcaaggaaacatctataggaattcggagaagggaacatcatttctggttgggataattatgaaacatttcggaactgggatatagctcaaaatacactcaaaataattatgtggtgggctttctcgatgacatctctcagagtggctgagaattctaaggtgtgtcaaaattctgtactaaaatttatggccaaatcaacttatttgatcaccaatactgccattgccatcagcatcaccattaccaccccaacactgctatcaccatcattactaccaccacttccacccttatcagcaccactatcaccattatctccagcaccaccacctccatcaccatgaccatcattatcatcatcattacagctaacagttatcgaatgcttactgtatgcttaacaccattctaacccctttacatgaataagcaaatgtaagctttcttcaaaattccaggtgaaatgctattttctctggatatgccccacttcgttgaattatcttcccttcaatgaaattttctctttctctgtaaagttctttaatggaaaaatcactttccacattatactatagatgtaagttacttatttcccttctttaaggacagattatgcctgattccacttcaagcctctcaaagtacccagcccactccttactactaattgctcaataaacttatttgtgttaaggaacaaataaaaagataattcctacggatacaatatttttaagattgactctcattttggaatacaaacatgacattgtatacaaagcaagagtttagttaccttcatccatgtcaaactatgtctttaaaattcacagaaaataaaagaaagacaagttacacataaaccttatgtcagttgtgatgcaaaaatatcagatgatcatttacacattgaaagaaacacaagtatagaatagttgcattatcaaatatttctacaaaatattattgatttataacagattttattcataagtcctgccactgctggtataaaggcaaagaaatatcatgtaggaaatatttcggctgcagttgttggttgcttgctgtggtggtggttgttggccttagctacatttattacatccaaaatatagagcagcgccaagatctgtctaagtcccatgcttacacaattagcatgcttctcattctaaaaatacctttgtccagtgctgtttgagaaaccagcagagtttttctaataatcttgttaaattacatgataagtaatccattgcttcaccttacaaagggatagttaggaacaaggattagatggtttgcctaagtatgttgtagtagagactagctgaaactatcttcttggatgcataggctgcatatgcctagcttgccgtgcagttagatggggccacatgactgagtaccagccaatgtaaggtgaacagaaatgtttagtccttctctataaaaaacctccaaggtgtcaacctccagttatttttgcctgttgcactccactaacaagaatggtgattgtgggagctacatacttaagttgaaaggacccacaagatgaaaaaagcttgagcccctgagtcacaacctggaagagaactgactagggacataggtttaagactttatatgagtaagaaatatgcttctgtcataataaatcattatgatttgaggatttatctgttaaagtagctaaggtatattaactaacatggacattattatcttgaagtggaatgttgctctaataaaagccttcaataggcttagtcgttatggagtacacggctaggaaatacgtatcagaagctggtaagatagagatgtgttatttggagacaaaacatttgttaagtctatcatctgcaatacatgttcctacatgtattgaccaactaaatcttcaattagcctctaactctgggagaagtaggtagggaaagttagaatatctgtttgtatgcatatttataacagcataattcacaattgcaaaaatatggaaacaacctaaaatgcccatcaatcaacaaatggaggccgggcccagtggctcatgcctgtaatcccagcactttgggaggccgaggcgggcagatcacaaggtcaggagttcgagagcagcctgaccaacatggtgaaaccccatctctactaaaaatacaaaaaaattagccaggtgtggtggcaggcccttgcaatcccatctaattgggtggctgaggcaggagaatctcctgagcccaggacgtggaggttgcagtgagccgagatcacgccattgcacttcagcctgggcaatagagtgagactccatctcaaaaaaaaaaaaaaaagtggatacagaaaatgtggtatatgtacaccgtggaacactactcagccataaaacagaacgaaataatgacttttgcagcaaattggatggagtcagaggccattattttaagtgaagtaactcaagaatggaaaaccaaatattgtatgttctcacttataagtaagggctaagttatgagcacacaaaagcataagaataatacagtggactttggggacatgggaggaggtgggattgaaggataaaagacagcattttgggtacagtgtatactgctcaggtataatgggtataccaaaatctcagaaatcacaactaaagaacatattaatgtaataaaatgtaataaccacctgcttcccaaaaactattaaaatcttttttaaaaaaatcagtgtgtatttgttacagttggctgctgttggtatgttattgccataaaaatagataaacgaaaaataaagatgttcttaggaaagaattggctacttctctagctgagttagaagtgattggagatcaagccccttgtagggttagaaaatccagactgtttatatatatcaaatagcaaatagtatcttggagtaaaaagatatttcagttgaaagaaatgattcagccctgcaacaaagactcatttaaaaacgttaccttcccactcaagcttgtactttcacaaggccacaacatatccataattatgttgagaaagaagcactgggcaaaagaagcaatgaaagcagatttgacaagtatagttaatagaaagtttgggtataattgctgacatagggagctgactgaaagaacaaacatcagaaattcctaagttcttgagacaattatgctgtcagaaaatccctgagcctggattttgccaaagcagttgacttcttgaactctaagacaacacttaggtctgccaatttgtaccagcctgagaagtgggcaatgaacgtagggtagccagcctgatccactcatgcctgtgatcctagcactttgggaagccaaggtgggaggactgcttaagaccagcctgggcaatacagcgagaacctgtttctacaaaaataaaaaattagtagggcatgcatttgtagtcctagctacccagaaggctgaggcaggagaatcacttgagctcaggagtttaagggtgcagtgagctgtgatcgcaccattgcacttcagcctgggagacagagcaagatcctgttgaaaagaaatagaaagaaaaaaaagaaaaggaaaagaaaaaagaatgaaagtcaggcagctcgtcaaggagagaatgtaccacaatgcccacttccgatgttgtgaccacagagaaggacagacaaaagaatacatctgtgtgtgaagatctaatcaacagatttcccccatttctgaagttgacacattcaggacacctgcccagcaagaatctgtagttgcattggtccagggaatgctgtctgcctcccattcttcacttttcctaattggaatttattagtgtgcttaacctttctctactgtgggatcaaacactgggcatgaggtgtgggttgtgaggagagggtaactaactggtccttctgttcatagataaaccacaaggcgccatatctcgttctgacagatggctgcacatcactggaaggatcttattcgttgaatcagacacagaagcagaatgggatttggggttgtctttggcacatgggtggtttataggtgtgttctatgtgtgagaagaaaaatgaaacagatatatggaaaccagaaggtagatttagaagagattggtcagttgatcactgaactcatttcttttttttttttcccccttggcatgcagcaagacagaatttctcatgctccttcacagttagttgtgatgtacaaccgagtttcaacacttggaagtaagtgaaatgaaatgggctgctttctaggcctggataggaaaatcccctgcccacgattctccatgctctttccccatttagcttgatgcaaacaagccagagaccttgaaggctagctggtgacgatggcagagccataacatggaaggatgtttgatctatgaatcgccacttggagaaccgacttgctgttcaggaacacccgctttggaaattacatgttcaataaataaacctgtgttaagacactaagattcagggactttgctgttagagttgatgggattaccttaaccacacacccacaactggtttaatagaagattgaatgtaaaatgatttcaagtgcccaacggctgaatttcttaatatgctatcctaagtctcatcatgatgatacactaggaatgacagaaatcagtcatatggactctttaagacagtttttccctgcaggaaaactgtgaagagtatcacctgaggtggccacatctcctttagacccctctcagcctttcagcgttttctgtaaataaagtccattcttcagaaaactttcaactaaactttgatgagatagagccaccagaaaagaaaaatcatgtatgctgtaaccactagaccaaggttcttttccaaagaggtttgtcgattttgataaatgtacttctaaatatatttgacatacataggcatcgggtgtttaatgaacagctttttctgctaaacgtcattttttccaaggttctcttacaaggagcttgacatgtgtagatgattatgagaatatatgtagactcactttttacttttctttttatttatttatttatttacttatttatttatttatttaagactgagtttcgctcttgttgcccaggctggagtgcagtggcgcgatctcggctcactgcaacctctgcctcccaggttcaagtgattctcctgcctcagcctcccaagtagctgggattacaccatacccggctaattttgtatttttagtagagacagggttttaccatcttggccgtgctggtcttgaactcccaacctcaggtgatccgcccacctcggcctcccaaggtgctgggattacaggcgggagccactgcacccaggcttctttacttaaaaacaaacaaacaaacaaacgaaaagctttctattctcagaagtgttcttgccctggctattataaattttccctgttctatctaaccaacagaatgtattactcttccctgggaacatgcacgtgcaactccctctcatgtaaaaattgccatattatccaagaagagtgtgtacgggtgcataattcaattaaatatgtagttcagaagcaaaagtaaatataagattgtgctaaggttcatgaattcaaagtttaaatactgagactctcagaaaatgtaaaatgcttttaaatgtatatatttattctgattattaccttttgaaaatgaactgaaaaaagacctacttaggaaacagaaatacttctgagatattgataagcggcttattatttttattgcttcaatttttagttttatgaattactctccaccacaacatattactggaaagttaagttttactgcggtgatctttcactaaagtctaattcattctaatcatttcaaaattcagagtttggtgttccatatttttgtcttccttgtcagttcattttgtatattatttacttgataagctgaggcttgaaaaaaatactcgcaaaagcttgtctgtacttatggccctgggcaggagtacaggcactttctctcatgagtattttacataggaatgatccagagaagagatgtggccctgtctctaccttgacagtaagctccaaatgctgacatttgctgaagtaaaaattctccctgtctagtggcaaaggtgcccccattcctttgaccccaaaactcccacttcccccaatcttcccatgcagatgttgtctgcagaaatgaagccatcaggcatcagaccccaaagcagacttaggtcgcatttacacattttctatcacaagcaggataaagacagactcaagttacccattacatttaggacttggggctcttagcacccaggctcagggttttaactcaggacacttacaatgaactaactcagtactacctttggtagtactacctttgagaactaggttccctgctagactttgaatttcttgaggattgggggcacatcttatttgttgttgtgtccctggaacctaccaagtactagagcatcgtgggctggctgtaaatgtctgtgggatgacttagtaaatgaggaaggcgagacatccttgaccaaccatagtgactaagatactgcagtggaacacctgctgttcctagttaactaagtaaatatggatctcccatagtatatagagaaagaataactctaaggaagaaggggataatggctgcgattccttccaaaagaacgctgtcacatgtgtgggggcgctgtacatatgtatcatctcttaactacaatctatgcatgtagtttgtttacagagatatttcatgcatgctgtagaaaattcaggtcatataaaaagggattataataaagctaaaatcccctaaaagttcaccactcagaagaactctcccatcaacatttgtatggggatcacccaaggtcaatctttctgggtatgtctgtgtttatgcttcctataatttattttgatttatgtttttgctgtatcacttctgcttctcaccctttatgacatgatggagatatgtctcttttttattttactagtagtcacttttataactttaaatagcatattttaacaaagttcttaatatattaagtacagacataaaataatacatacagaaaaaaaggcacataaaagaccaggaatagcttactttctctcatcttcattttattggagcatgcttcaagattatgtcccttggccgggccgggcttggccgggcgtagtggctcacacctgtaatcccagcactttgggaggccagggcaggcagatcacctgtggtcaggagtttgagtctagcttggccaagatggtgaaaccgtgtctctactaaaaatacaaaaattagccgggcatggtagcacatgcctgtaatcccagctacttgggaggctgaggcaggagaatcttttgaacctgggaggcggaggttgcagtgagccgagatcacagtgagccgagattgcaccattgcactccagcctgggtgacaaagcgatactccgtctcaaaaaaaaaaaaaaaaggattatgtccctttatcctagtgtaattattattactttatattgtatggtatacttgctttcttttgtacagccaatatttccaatagatattgtgaataattgtttgctcaaatgactttaatctcattactagtccactcattctacacgagtttttgaaattattatcactttccagttcagtagggtatatctgatctatttcctgagtctttaaaatgttctgaatctttgaatatttattcatatatttctattttctttttatatgagctataacttaactggttatataatacttttgttacactattttgtctcaaattgtgtagctgttgcttcattgtctttgggacacaatgctgctaaggaaaaagtctggatccaggctaatttttttctctatgatattgttgaccctatattgttactttgtatttttgttatttgcatttttcgttgttgtgttcttattttttccccaatattttcaatctatggttggttgaaacccgctaatatggagggtcaactatgatatgatattaatacatatatagatatatcatatataatattatatagttatattttatatattatattagttatattttatatattataatattatatagttatattttatataatacatattataatacatagttatatttatataatattatgttatatctatatatagatatgagaaaaagcaaaaaacaagaacaattaaaaaatataaatacaaaaacccagtagagtataacaactatttatgtagtatttacattgtgttaggcattataagtaatctagagatgttttaatgtataagggaggatgtgtgtaggttatccacatatattatgccattttataaaaaggacttgagcatccacggatattggtatcgaccagggtcctagaaccaatcctgtgcagatactgagggatgatgtatattcttttgcatgtatgcttgtagaaatatttctaaatccttgcatttcaacaacctactacaatctttgtgctacttgctttgtgatacacatgcttagaacatcttgcctcatcttgatctgcagatttgggtttgaattaatttctttctttttgttttttttgttttttttttttttggtttgagatggagtcttactctgttgcccagggtggagtgcagtggcatgatctgggctcactgcaaccccgcctcctgggttcaagcgattcttgtgcctcagcctcccaaatagctgggattacaagtgcacacaaccacgcccgcctaatttttgtatttttagaaacggggtttcaccaaattggccaggctggtctcaaactcccgacctcaagtgatctgcccgccttggcctctcaaagtgttgggaatacaggcatgagctaccgtgccctgccctgaattcattcgtttgtttgtttggtttttaagacaaagtctcattttgtttccctggctggagtgcagtggcacaatcatagctcactgtaacctcaaattcctaggctcaggcaatcctcccatctcatccttttgagtaagtgagactacaggttatgccaccatgctcagctaattttaaaatttatttattttttttgtagagatagagtctcgctatattgctaaggttgatcttgaactactggcctcaagcagtcttcccacctcagccacccaaggttctgggagtacaggtggtaagccaccacacctgacttgtttctgttgttgttttgatattatcttcaggtataacaatgatccataagcttgatatttatttcgtgcctccatatctataatcttctcccttattaaataagttaacacaagaatttagagcaatgctttacacagaatatatgttcaaaatataaattattataactgattaattgttttaactcttttttccctaaactctggctgattttctcagtcttctccttcctatcactgactcagctctgtagtgctgattctgtacttcgagtttctaaagagcttttaatttccatgatggcaattactttctcttcagtttctttccttaatatggctagctgcccttaaagtgaattcacttaaattatcgtctcatctttgatctcttcattcagaacagtagatgatataccttaaattttattaaattcctccatgttggaaaacacttgtctaaaattttcttctaattccttgagtgtgctttcctccaaaatgtgttcctgaattaatcttctgcatgctagactttttttcttttaccctttggctaccttctcttttgcataaatttaacataggcaagatattttatgtctaggtgtctttgtatttacttacttatttatttatttatttttgagacagagtctcactgtgtcgcccaggctggagtgcagtggtgcgatcttggctcactgcaacctccgcctcccagattcaagagattctcctgcctcagcctctcaagtagctgggattacaggtgcccacaaccatgccaggctaatttttgtatttttagtggagacagggttttactatgttggccaggctggtcttgaattcctgatctcatgtgatcctcctgtctcagcctcccaaactgctgggattacaggcatgagccaccgcgcctggcctgtctaggtatcactgaacagtgaacgctattctacgcaggcttgccttttgcccaaacataaaatgggtggattctcattgcaactcctccttgttttcctgtaccttgcttgaaaaatctcatttgaaaaggaccaggaagtctccctgtggtttctattctctttaaagtatttcaagagagaggttttcagggaaggcaaaggggccctggagttctattcaggggattcctctcttctctcccctccatcagttggtctgaatccccagtaatatgggccagcttcacacaattgaaggtgtgccctggtctatggaaagtacctttggcatttagactttttttctctttggagtagggctgttatgcttcctgtgagatccttgtggtttatgagtttagggtttttttgtttgtttgttttgtttttcatatttcctaccaagcattttgttttctgctgagatttggggtagatccatttttcaaaaaatttcaactttatttcaggttcagtagtacatgtgcaggtttgttacgtgggtatattgcataacactgaggtttggggtacaaatgatcccatcaaccagggagtaaacacaatacctaatgggtagtttttcagccctgacccccccccccttttctagtcatccccaatgtctgttgttcccatctttatgtccatgtgtacttaatgtatagctcccacttccagaaaaccaaatactacatgttctcacttataactgagtagagccattgatcctcaaagatttgtctgtttccttagttagccaaaggggaaaagtggccaaacttttgatatcattcaagtgaaggccttgaaaaaccatttgtcttcagtggggaaaaagaactgcaagtgggttattctacatcttttcttcaacggccgacacctccattcttggtcttaacaaattttgaggataccagtcagcgatgatgagtatctgaatatatgtgactctctcatgggcaggaaaacaccctactaatctttgtacacttggtgcccaggtgctatgcatacagataaattctcccttaaagggtaatttgaatgccatatatatcatctgtagacagatgatttttctgcttgtccttagccacttaggttttgtctcttcttcttcaatctggcaatttcctatatatgaaatgtacaccagccagtagtgcaatttcaattcataaatgttacgttctactgcccatagatccccaaatgagctcatgaggaacttagagtgaagcgaaatgccagtggacctcctccaaaggcttgttcctccaacagcagcaaattttgtgagcagtccatgaaccccaagtctgagagatcagtctcagatctatctaattgcagggggctgtagagacttaaagcctgtatttattatcttaattaccttttggccagggcaaaaggagatgttatatagacaaccagttgctttgaggtttgcactgaatccacgtatctccgtagttgctcccaaccaatgatgaagcacagcccagtgactaaaatgggctatttctgggaaacataggatgctcccatggtgattttagcttcatagtttccccacagccttgctgaagttttcctggagctgtgcacaaatctaaaatacttgatccaactccctttcttttcctctttctttgtctttcccggcttcctggtatctttctttccctcccacctttcttctctctctcacttggggttagaactgaaggattacctgttaaacacgtttaaacatgcttttatgataatacagttcaaatgcttcccatatctacattataacctttattatactctctaatgtacttcagcattatgaaatacaacataacatacttcaacagggaacttgactttcaaatgtcactattagtacttactaaattgaaaggaaatgttctcctatcagcaagtaaacacgatacacttgaatattcatgccattgcaaccatgcactattcaaatcttctctgtcaaataattgtttacaatccttttttttttttttttttttttttgagatggactcttgctctgttgcccaggctggagtgcagtggcgtgatctcagctcactgcaacctccgcctcccaggttcaagcaattctcctgtctcagcccccctagtagctgggattacaagcgtgcaccaccacgcctggctaatttttgtatttttagtagagatggggtttcaccatgttagtcaggctgatcttgaactcctgacctcaggcaacccacctgccccagcctcccaaagtgctgggattataggagtgagccactgcacctggcctgtttacaattcttaattgcctgtcagtggtgtagatgtgtatgtatgtatggcggggtcacgggcattattaccaagtttaaaaggaaagagtctaaaaatagttcccatgactcaggaggaaagtgtccctgtgttgtcaccttatttccactttagatccgtctatgttcgtaaccctgggacaggatcaatgatctgtaaaccaggctcagcctccccctggtgagcctaatgaggcacagaaataaaatataaaagtaagttcaataccaaatcttataccctcctaagaaatagtaagagttggaaaaaataaatactcttttataaagagtgaaatgaatctgttttcttcatatctcccccacccctaacctttagtagaagccagcataaatctggggagagaagccctccatgagtgctgggccttccagcctctcacccacaggccatggtgtcactgtgactatagttttactaataatactatatggcggctcatttttctattcaaactctctggaagatattaaataagtctgttttatttaatagataaatcagggctgcgatgttctcaccaaccaattaagaagcccagggaaaatactgacactctccttctgaggttcctctgtgcctcctgaggatggcatatgtaaagttttctgtttccctggtcttttcatcccattcttatgcatcatatgagctttctagggttgtcatgacaatgtgccaccaactgggtggcttaaaacaacagacatttattgtctcatggttctggaagctacaggtctgagactgatgtgttaacgggaccacactgcctctgaaatctgcaagggcgatctccctgcctcttcctagattcattgggtttgctgacaattgttgacactcctcggcttgcagctgcggcacttcagtgtctcccttcattgtcacacagtgttctcccctcttctgtctgtgtcttcatctcctgtttgaataaggacacctagcttattgtattatgatccaccccggtgatctcatcttaacttcgttacatcttcaaagaccctatttccaagcaaggccacactcacaagtactagggggtagatctttaacatatcttttttggggaccagttcaacccataacactaagattgaaaacctggcaacatcgacttaaatatatttgagtgtgttagtgcaaacctggttttggtgccttttacattcaactggacattactggtgttatctcatacccctctttacagagttctgagttgtcttcgtgaattcttatttacaacatagatgcattagacacacacacaaaaactttattttgtttgaaaatccttgacctttggaatacatttaaagatgaaaagaactatgtagtcaactcaaatctctagagaccctgtagtcctcatccttttgttaaactttcctcatgactttgctacagtgggtagtcaggagaaagggctttcccctacctttaatcacaattgtctgtggacaacttttgtaatatatcccaatgttgtaggagtctcagcttgaccataaagaagatgctaatgggtatgttggacgaactgttggtgcagacccaccaggaactaagggatcttcctgtaagaagttcttgcaaggaaagatggaatttggcataatggacttctacagatatcaggctttggtcatgtaaaagctgaggagctgctgaacatctcaataagtttaatgtatctggtttgtctccaggcccttgggacagacgcatgaaatctgtggtagtcaggatgggtcacactgtactaacccaaaaaggttacagctattttataaacaccaagagatgcttgacaagacaataaaacatagaaagtactattatttgagtgccctcggtacttttctcacacctggccaagacctacactttgtagggccttttctagcttcctctagttatagccttctccagaggttaaaagttctacatagctaaggggctgtgtccaccaagcatctttgcccccaattctcgcacacactgttagaatccagaaatttccttccctaaagaacgtgatcccattatcaagaatctccaggtcccttccccaggttttttatcctgaagatagatggcacagccagtatgtgtagatcaggctcaaggggtgcctgaggggtggctattagtggggatggtgtgaatagagcttgggcatgcagactggagcatccatacacttatccaagaggctgctgggcacacaaggaaaatcctcaggtggaaagggaaacaggagtaggctagaggctggggttaggtactggaggctggctctcccaggtcactatgttccatcatgggacactgaggagtccaagaattccaaatatgaatgtggtctttcttgtaattatgaaggtaggcttgtcaaagagggaagatagtacatatattattgaacattttcttagcttgattcataactttgaagtacaagtgacccttgaaccacatgggtttgaactgcacaggtctgcttatccctggattttctcccacctctgccactcctgagacagcaacaccaacgcctcctcctcctctttctcttcctcctcctccacagcctactcaacatgaaaatgaaaaggattaaaactgttatgatgatccacttctacttaatggatagtaagtatatcttctcttccttatgactttcttaattttattttttctagtttactttattgggagaatatagtatatgatacatataacatataaaatacgtgtcaatcaaatgtttatatgattggtaaggcttctggtcaacagtaagttattagcagccaagcttttggggagtcaaaatttatttgcagatttttgatggtgagggagattggcacttctaacccccacattgttcaaaggtcaactgtaaaatcctaggttatgagggtctctacttgtactcttgccctacaaatgttaggggtgggtctgggtgcctgtccatcaaagtatatttccagaggccaggtgggagggaggcagtagctgcagatccaaggaagcacagagaaaaatagtagataagcagccaagatgagacagtggaagctcaatgaagttatgtcacttatctgtctgaaaccttaattctgccttgtcatggaaactggcatattcacaggttctggagataaggaaacagacattttggagggctgttattctctctgctacaggctttaatcacctgcaacttggttataaaaactcgtttagatgctttatcaggtagcagtgattcaaatgaattacactctgtagttaccttgaaaggaacccctgaaaaagggattgcagaagccaaccaatatagcaaagcacagacttcacgtcctagctttttgccttgacttctttatttggtcaaagaatctctctctctttctctctctccccgcaccccccaacccaccccatcactcctcttctcctctgcctttcctctccttctcttgcttaacaactgattcacactgtttaaataacttccgtgggtagagagaacttgaagtacaaaaactaaatagattttctaagtcacacaaaaaatctgagaaccaagatgcatgcatttgcttgcatcaacagataacggctaacttgcattgagtgtttctctgtctgagatactatactaagcacttgacatgtgttatcttattcactccttctaactgccttattcagtaggtgctataattattactatctcatttcacagatgaaaacactgaagcttgaagaggttaaagaacttgtccacaaccgtacacgtatcatgtggcgcagtcagtcctcaaacccagcctctatagttttgcactgagccccttcaccaccatgactgtatctaggaatccttgctaagcttccccagagatgtgaacaccttccataaacatgttatatacagcagacatgaccacagcttgttcaaatcagtagaacattttccaagagcctaacatgtattgggtcccgtgttcaatgctagggatacaaatataagtaacaaaatgcccatgcccttcagaacctcagcttcctggggaaaatggaaataggaaatgtcaacgcagcaagtgaagtgctatggtagaaggcattacagaagcccagcagaaggctgcaagcgatcaaggttgttaaggagaaaagaaacaggctaggaggggaggattaaaacatttgaggtggacgttaacagatgaatacaaataagccagatgaagagggtagggaaggtatttccagtcagggataagagcaacgtgaaggccgagcagtatgggaaggcacggcccatgcacagtgtcatgtacctatttacaccacacactactactctgaactctttgccataatacactctggaatgctgtatgccttagcttgaccttctctatttctataaaaagcgaaatcactcctccctctgatgacccatgtcaaggttgaaaaaccatctactgtatttcaaaattttctgagttgatttggccttaaggattctctaataagcctgatataattcttaacaattcccccccaaagtattgaactaatagctattccctgacgcaaagcaattttctcggaggaaatgatcttagaatttttctgcatagcgtggatgctttttttttttgacagaacactgatttctgaaaatgaatagaaagcagctgtatagctgagcttaaatgtagcccaatcatgtcatccgtgtgccagaacaagataatttttccaccctaattcccatcatcctctgcttgatttgaaagacacctacatatacttgactaagttctgggtgcttcaaaaatgtatactgtttcttcctaaaggaatatgaatttggaaggggaatcccttatcctaaagcaatcacactgaaaatatctcttgacatacatttagactttcaggaataaaatgaagattgatgtcacagtgaagtggttcaccagaatccagtaaaacttggggctaaggaaactttgcaatcaaaaaagcctatccagctcttcttgttcttagatgtccctcctcatttcttggccatgctaaacaaaatctcaactgttatctcaaatatctgaacagaggttattctgaacagacacccatgctgtagggcaagcaggcccttacaggccttgcactctttatcgtggccttgtagatctttgcttaatttgctttagtaaatattctaaatactgaccctcaaagtaggagacttttcctagagtttctcctgtggagggggaaagtcataaagctaattttggcaatttgaaaacaaaattttcatcactatcaacgaagaatatagcaaattttaataatatgacactgtgtcatttgaccacctgttaactctagatggcaaatatatttaaatgattctactttcatagatcttacttagcaataaggtgctcactattatcatcgtaagatttttggtgcaaaaagtatatactagacatctgatatggtttggctgtgtccccacccaaatctcatcttgaattgtagctcccgtaattcccacatgttgtgggagaagcccggtgggagataactgaatcaaggggggcagtttctcccaaactgttctcatggtagtgaataagtctcacaagatctgatgattttaaaaggggttttctttttgcttcgttctcattctttcttgtccgctaccatgtaagacatgtctttcaccttctgccgtgattgtgaggcctcctcagccatgtggaactagagtcccttaaacctctttttctttataaattatccagtctcgggtacgtctttatcagcagtgtaagaatgcactaatataacatctattcttctgtggtcagaagcgctctatgacctatgggtgtcacacccaataaatatgcatgaattaatggcctgacagtaataaaataagtagaatagagtccttgatctcactagatttatgatgaagttaaggaaagaacatataacactgagaattcataaacaaccccagaacagtattaaagacaactacgtgttaaactatgatagttcagcagaggagaagaccagtgtgcaacagaagagtcagagggagctacactgagagatggctttgtccaaaatgcaaatctcataacacagaaggcagccaaactcctgcgtacctccttcctcctcagacagactttaaatactttaaaggctggagtttcccagggtttgattctcatttctcttttcatctccatctccactgtctcctcaggtgatgttatccagctccatggagctcatagaatgaatgattctcagttaatgtcatggatactaatctcccatttgagcacctgatataaagatccaaccacttacttgacaactcaacttccatatgtaataggtaattcaaacgtataacatgtccaaaatagaacttttataccctacttcctgacctgctacttcctcaatcaaccacacatctattaagagtgccaatattcactcaggtgcttggaccaaatcccaagaatcaaccttgactcttctattttctttcttgcccatatctgatttgtcagcaaatccaatcatgtcttatcctttccactgtttccacctttgtataagccaacatcctctttctcctgaccaacaagtagagttatcttcctaaaacttatatcactactctacttaaaacactccagtggtcttccagtggtttttcaatgctaatggaataaaatccaaactttctaactatggtctgaaagaccccagtctagtaaatcaagaactattaatcatgcagtttggtaaatcatgacaacattaaaaaaatagagtggaataaaaatgccacagtgcaccatatgtagtaagggaaagtattttgtgatgctttttaattttaaatattaaggtataaaagataggaaaaaccaacaccactcaacacaggactactgacaccagattctccagcagacatcagttggatgtcctttcaattcggacactatctacccggtggtagcctcagatcccacaggttaacggctcagcccacaagactgcctcccaattctgatggtaatcacaagcatcaggttgtgacttgggcttctgactaatgggctataaattggagttcctacaacattcttcttaggtttgattaacttgctagcacagctcacagaattcagggaaacactttcacttatggtcattcattattataaaggatattacaaaggatacagatgaacagcctgaggtaagagatgcatagggtgacacagaattcagggaaacactttcacttatggtcatttattataaaggatattacaaaggatacagatgaacagcctgaggtaagagatgcatagggtgagacaggcaggaaggggcatggagcttccgtggcctccccaagcatgccaccatccagaaacctctgcatattcagctatccaggagctacccaatcattttggatttttatggaggcatcattacatgggcttgattgattacatcccccataagtggggagtggagatgaaagttctaactctttaattacttcttcagtttccctggaaaccagcccccatcctgaggctacccaggagcccccagccaccagtcatttcctttgcatacaaaaagacacttgtcactttggagattccaagagttttaggagctatgtgctagaaaacaagaggaatgccaaatgtatttatcttattataaatcaccatattaagttaggctatgtgtgtatttgtttgcaacacaaaacatttttcttaatatgagttacattcaaaaaatgtttgcaagcccctgacctgtatgatctggcccatgactacctctctgatcttttctaaaaccacactataccttgttcactgtgctacaacctcactaacattcactctagccctcaggcaggcaagctcacccctgcctcaggacctttgcatacattattctctctacttggaataatttatccttagacattttgtatgtatgcttctttcttaccattcatatctcaattcaagtattacctcctgctaggcatcttatctctaaagtaacaccttccgtactgttcatctcaccacagctatcttatcaccctgtttcagcttcttcttagcactgtacccatctcatctcattcatttacgtttttgtgtgtgcctttattttctacgtatttctcttagaatgtaaacctccacgagttcagggaccacatttctctggtttactactctatctttagtgcaaagaataatgtttatcacacaacaggtgctcagtaagtatttgttgaatgaataaagaaaactgaagacataattcccctctgttaaggtataatgggaaacctttggtctctcctgggcttctcagggccccgtgtagaaaagtcaaggctgtagaattagtattcaaaactcctccctttggctttgtgttcagtccaagagaccattcatttcagcacattaaactgttaattatggagtctggcttctcctttctttatgtggaaagaataaatagttattactaaatagtcatttaataggcagtggtttctttcagggcaaccattattaaaattgcacaaacatgtacataaataaagccatttacttaaaattaggacagactgacttaatggattccacttttcttactgtcctgggtactacctgcttggaatacacagtccttttttgtccttcctctcactttatttcctagctcttgccaatatgtacaccgttgatatatgactatttattcatggtaatttatttccaagactttttttttttctggggttactgatttagttaatagtatttaaaacacaaagtaattttttttggctggggagagatagccaaattgataattttatattatgtatgtcgtatgagtatggctttccctgaattttcactgcagatagacagacagaacattggtaagaaataggaacaccagactagaagtcagttatttaacgttccagtcccacctctcaccttaaccagctgaaatatttggataagtcatttaaattccctgagccttgggtttctcatttgtacaataagagggccagtttaggctttaaaaattcctgttatgtattcagacttattacattcaaagaactattataaattatcagttaatctttgcaaaaaacttacaaagtcggtactattatttctcctattttacatatgaggagaatgaggcagagagaataaataatacacattttaagtggtggagatggtttgaatctaggtagtctaaagccagaattcaaactcttattcttcttactgtaggatctctgttcctatttatctctgagagttaaatttatagctgggcatggtggctcatgtctgtaatcccagcactttgggaggccgaggtgggtggatcccttgaggtcaggagttcgagaccagcctaatatggtgaaaccccgtctctactaaaaatacaaagaaattagctaggcacagtggcatgcgcctgtagtcccagctacagtgagccgggatcacaccgctgcactccagcctgggcgacaaagcgagactctatctcaaaaatagtaataataatttaaaaaagagttaaatttataggttgtgaatccttggatctcatgttgttatagtaggtagatagtcaggcatgagtaggggaggtgaggcttcccctcatcccactaggaatgtcaggcaaccatcaggtgatggtcatgcagttgtcacgctgcctctctaaaataataattggtcgcagccagcaccaggaaaggcaggttccatatagatagaaaaagcacctgaaactggttatcatcagtctcctgatgagatctcaggatttgggcaaatgggctcaaacatgtgcattaagaggcaaaatggcagagtttcactggtatgtccatctgggggcgttccaccagtaaagggaagaatgagtcaggtgagcataagtacaactctagtaaacacactgcccatgctcacctcccaagtgctagcaggccattgtgtatgtgcgcagctcaccccaagggaagaagcaagggaaaagggatgtaagacaccagaaacatgccagcatagaaaaccctaagtccaaggtcaaatagggcacttgtcctctgagatgccctcttggccctcttccaagggtactttgctttctttgaattcatttgctttatttgaattctttcttctgaagagggaagaatcgaggttgctgaaaacccgtaaggattcacagccggtaacttgggtacccgccacagctaacatattttgttgccatgtgactccaataacttcaacctatagcaatgttagcttgtctgtatcttatttcaccagcaggctggaaactacttaagtgtaaagacgatgttcatctttgaataacctgagacaattagctccaggccttgcatgcagtaggcattcaatatttacttttaaaatgatgaggagttgggatggattcatgcaacaattttgacattaaccaggtgaaatctaaggtcctttctgagagtgtgtgattcaggcattgactgaatactcttcttgaaggagttggctgtgtctgcacagattcacctctgatttgctcctcaacttaatgcaatctggttttcagccccactgatgccactgaatctctgcttgccaaagtcaacaacacacttcgaaaggcatttcttgtcctaacctattgcatctcctgagaacatctaatattgttaactatcccctcttccttaaagcgctcatttcccttgaactggataacacagtgctgctgacttctctccatccacctctcagggtgctatgctttgtcttcattttaggatctgctttccttacctagatctacaatgttgggatctcccaagggtctgtcactggtccttctcttctcgctttccacactatactccttgggctttcccacacatatgctaaggatttttgaatctatagctccagcccagatctttctgttgagcttcagacttggtatagtggtaaaaagtgataacttactttaaaatacttccatatgaacagtatatatatgtagagtatattagtcagcatttgaaatatctaaatctggaatccacactctaggaatggataggaatttgcagtacctaatcagggatccatattcagagatggcttcaaaactgcttcatactgtgttaatagtctctcccagaaggccaaattagacagcaattttagacataatttttcgtttgtggatgagtgatacatgaactatatgtttggctataggaagggggtgtaaagacccaggaagcccagcagcctatgcctttgaagcaccactcagcgcctggcttcctgattctgtgtctctctcttcacaaagaactctgctacctgtggttgattggtcccaccacacgcaaagctcaaggctcactgtatcttgaacatctattggatagcaccttacacatcaagttcaacaggtccaaaatggaactgatcctctttgcacaaaattgatcctccttctatgttcttttatacagtaaatggatctacactcactcaatgggccaagccagaaatctggacattagtcttaacttctcccattctcatcatatccacagtcagtcaattaccaaattccatcaacatcatcacctaagtcattctcaaattcacccatttctctcccactccacaggcacctcccaaacctagggcaccagttcctctctcctgtccccagctggaccccttctactctattctttatacatcagccagagtgactcaggaaatggaaatctgtagtttaattaatatattgtagttacttataggaaaaaaaaggctgatagagaaaatatctaacaactattaaatagtataggtagcaacaagtcaaaagaaatgccaaaccacttacagtgaaaaatagttagaaaacaacacgttaaacaagccaggttattgctgcaattatcctaactttgttatgttgtagattgggcatatcactgttaacctttgtttcctctatgccaagtaatgcttgacagacagcaggctcttactgaaaaaaatgaaagaacatgaatgggaaaacattcaatcaatcaaccttttttttctccccccaacttccactcccagttttcctcttaaggaaggagtatgcctcaaaccaagaaactgagaagtttccctaaatcctattgattggtaccctggacttggaagcaactgacttcttgattttctaccagggtttagttaactccacatagtatactctatgagacgtatcattgctataaggttaatgatagttatagggcccagtcaaacatctcacagggcctatattctgtgtcacttagcagtatgatgcatcttggcccagggatttgcaaccttggcctgggaatttccaggagacaagactacctcagcacagatgcagttctcataaaccttaaaacaaagcttagcgttacaagaatagcttaaactccctttgtgaaagaaacaccttgtaactgacccagaaggaatacaggtataaggaaaggggaagaatccccaaaactctaagaatggtctctggatggaaactctcctggtcaatgggtcacctgcccctcaggctgtgccaggcccatgccaccacctgctcccgctacctgtcttttaagggttctgccagaataaactgcgtgagcatcagatgctgcctaagactcagctttgatgggaatcaaaccaatggaaagaagtttcccctagaaaagctggttacctagagtcacccaagacccccaagactgacagtccagctcaacaaatgttcattgacaatctttagcaattataatgatgaatgagtcataccctctttctcttgtaaaggtcactgtattttggtggaaataaacatgcgtttgagtcatttaagtaaataaatgttgaagctgtgttatccaacaggcagagtaaactcatatttaggatatcagcatagcaggacactgaggacatcaagaaaaatttagaagagttcgacagaattgatataaaaaaccaaagcaatcaccaatggacaagttcagagctttacgatctccttacccttatgttataatttaatatgatttttattatgtggggttacacaatagtttggtctccccaataaaagggacctcttaaatcttaatctattcctaataagtgctaaaatagatacataaatagggtgcttgggagcacgcaggaggacaattaaataggctaaggcaggggagagtagggaacaggcgaggagaaggcagcgtcaaaaggagggatgcctgagctaagtctaaaggggcaaattaaccaggtgaaggtttgggaagctaggagaggtatactgttcctctggtgggacccactcacccctctgagctagacctcccaatacttcctgctagcctagaccatcatctgttagctccctattatctattacatctgccccattgaaccttgactctgtgaaattctgagtctgtacctcccaagaggtctacctagctgcaagctccatgcttggtcgtatctcaacactcaagaatcacaacatatttattccattccaataaggctaatttgctcatggtttctatttttgtttttccttcagtgatcacctacacttctgttagtcattaaacaaatggcagctggcatcatcgccaactttcaaaaccttattcaaaagtgatcttctataggaaatctttcgagtggttagatacccacatggaaagggcttccttctcatgaaaagcaaccaatgcactttgtttagcattgtgtattcataaatatttatccattaaaaacaggcatctgtatggcaagtcccacaaggatgatttaaccaagactgcaaactcctcagctgaccacatcccatctctctttgcttcacatcatcctgctagcccctcaaatgcttggccggccaacaaccatactgtacagtcaaaaagattcatcaagtcctcacttagtttttattcaaccttattccatcacaatttctcaccaacatcagattaccggtgaaaatttgatcagagagactgaggtaagagagactcaaattatttaaatctctcaatggaagttaatagttttgaagaattagagcatttcatatgggagcaatgtcaaaataggtgacctagaactgaagtagttttccccagactctgcagttactgaattgactccccaggctgctcatattttccggctatttctgaaaagaaaaatatacaaatgcaatacccctttttttccccaaaggtctttgcttccctataaatactaaagtgtgctccttaacccacttatcctgtgagatgcctaaaaatggcctcttggatgaaataacttcaggaaacaccgtagagtatagccctggtttgaaaattcactatgaacactaacgtgttaaagaccctattacttctgtaaatagcctagttttacttcgttaactcttcctttcacaagtgtatttgggcacagatcaagtttccccttcccgcaatattatcaacaccactccatacaaaggagagttggaaacagccatgttactcctccactgaattcacacacacacggatataagtcttgtgtagtctgaggtgttcatttcaaccctggatagtaattcaaagtagcaaacagctttttgatgtttgctttgtttggttgcagaaaataagctcagggtagacagttcttcaatgacagttctttacttgcataaagctagtatggattatcccaacttttataatgacagtagttaccactgggatgcaaaagaagcaaaaagaaaaataggagttctaaggggcaggagtattagcattgcactataatgctgcagtctaagcaggcattccattactgggtcgatggtgaatacgaagtggaggttcaatcactacacacacttactcaatagtctcctctaaaaaaggcagtaaatgtcttgtttttggctcagatgaaggcctatcaaccgtcagaagtgcaggcttccacacagagattcagagcagcactacagccgctcagcatgtgaatcccaagaggcaggtgatttagtcaataggccccagagcagctattttaaacacagggcctgttctctttaaaggtacaggatttatttatttgtgggccatttaaaatttcctgctttcaccggcttttgatctggactcaggtattatatcttgtcctattttccaacatgtaacaattccttacaattataatattcacccatccatccatttggctaacattattgacaacctattatgtaccaagcactgctctgttttttttttattgcatgtaaaaatgatggtgatattataatgaatgaaataagcatttgtttttgcaatccaagtaaaatttacctgtattgaagaatgtagaggatcttgtcaggaaactaacgacactgccacatgaaggaaatcaaataaagccgggcgcggtggctcacgcctgtaatcccagcactttgggaggccaaggtgggcggatcacctgaggctgggagttcgagaccagtctgaccaacatggagaaaccccctctctactaaaaatacaaaattagccgggcatggtggcacatgcctgtaatcccagctacgagggaggctgaggcaggagaatcgcttgaacctgggaggtggaggttgtggtgagccaagatcatgccattgcactccagcctgggcaacaagagtgaaactcagtttcaaaaaaaaaaaaaaaaaaaaaatcaaataagagaaaggtgctgtgctttttgtaggtcagtgtttttcacaagacaccgatattgaaatccctggaagtacctatttaaaatgcagattctgctgggtgtggcagctcccatcggtaatcccagcactttgggaggccgaggtgggaggattgcttgagcccaggaattggagaacagcctgggcaagatagagagacccagtctctaccaaaaaaaaaaaaaaaaaaatcagccaggcatgctcacacctgcagtcccagctacacaggaggttgaagtgggaggatctgcttgagccagggaggtcaaggctgtagtggttgcaccactgcattcatacctggcaacagagcaagaccctgactcaaaaacaacaacaacaaaaaataccaaacatttggccaggtgaggtggctcatgcctgtaatcccagcactttgggaggccaaggcagtaggatggcttgaacccagaagttccagaccagtcgggcaacataagacctcatttaaaaaaaaaagagacaaagaaagaaaaaaaagtcagaatccaggaatctggatttttagcagtactctggatgttctttgtgcatccgtagtgccatatccatccctgtcatgaaggaggagaaaagaggcacacattctctccaatagaaacacctccacattcatgtcttttatttattgggtttcctgtatgacgtcttcaaaaaaaaaggatgcaagaaaaatatcacttcttttaagtgtagcacattagaaagtcacacctatgagactctttagctgcctcatcattgtattttaaatgtggcctcacagagaaaccatggattttagaatcgggaagatacacctccaccacttattagttatgtaaatttaacaagctaatttgtctgtgtgagtcttgattttctcagctataaaatggggacaatagcaaaaaataatgataagataatcagattaaaagatatatcatagagatatatatatattatcttttaatatatattaaaagatatattaaaagatatatctgtaatagagatattacagatatattatagatatagatataatagatatatgacagatatattatagacaaacacctggcaaatgagtgggcttacactgggtactccccaaaatttacccccaccccttccaaattctgccaaattttatagagtagctatataaaaattatttttatgtgttttcttaaatgctcttcttaagacattggcccttatgttgtaggaaacacctcgatgccaggttgaagttcaatacttacgttaacacattatctttctattttatatcaatgggagttatttaaaccaccatatttcttttcagcttaaattatcagaaaatttagatgtgaaattaatgctcaaaataaaaaagtgtttctcctctctatattacttatggttattcttaaaaacaaatcacccatttacttattcaacaaatcattttggccatccaataaatttattgagagggtatatcctcaagaggaagagctaagtcttatgcctgcatgtaatacactttatttattaactgagtgatgatggacaagctatttcttagcctcaaactcctcaaatgttaaattaggctaataatagtatctcgcaagattgttgcggggattacataaatcatgtacttagaacaatacctggcatttggcatgcactatagcaatgttatttagtattatttaccaaagaatagttactgaagatacacagtaaaaaagcatcttaaaaaggtaaaaagagtatataaacttacctaagtggaagttaagtgtagcataaagtatatcttataaatgaataatggagtaaatgaaattcttattcatctcatctaatgcaagaaaactcaactaccaacattatggaattttgatttgatatcactcctaactctattttcactctccctgaaggtgttcctcattttccctccttgagtctgtctatatgcaagaatggatgagcaatcagaaatgtgtgctcactgatatgtggatatagacctctgaagcatctaccccattctaagatggtccctgctcaaagggatcatgctgaagaaaggtgacccttccagctcaggtttgctctgatctccgtagcataagcaacacaaataaagaaactatagtcataggactttcgttaaatgcttagttgaagatctcaatttctgtttgcttctccttagccatattccaagttcattaccattaaaaataaaacaacatgtaatcttaatatatacaattagcaacactgtgtgctcaacgtgtctttcttaagttcttgcagacttctttcttttctcctaagaaaccccatctctttagatgagcccaactattcacactctttcctctcgctcctcaaattataatcaccgtcacatcaaagacccactaaaaggcactcactgaagcttttaaattaaggtacttgaatgacttagaaataggaatcacaaaacaaatctatttacatgcatttgtgcagaacattcctaaatgttcaggtgacactgacctactaggccctttagctcgctatgtgaggaaataagatagaatcttcaaagaagtttggttgtcaagaagcctctgggaccagtgaaacaaataattaacttatagtggaaagagaggacaagaaatgtttccctctgggcctgaaatacagtgtgctctactttgcataagttaacatcgggaggtttgaattttccaaagggcttagtggctaattagctgtgtgaagttgcccatagtgtgtccttaagactaaacattcccatttctcataaaaagctgtaatagttacatgaagcaaaagaaattatctctactatgtgtttggggtttgtctttcttgtggcctcctttttacttctattacaacacttacgacacagtactatgaagatcaactctctcttccccactacaatggaagctttcgaagtataaggattgtgtctgacttaactctgtattccatgctcctagcttgacatttagtaggctctgtattccatgctcctagcctgacatttagtaggctctgtattccatgatcctagcttgacatgtagtaggcattcaatcaataatcagtgtttttcagataagtgggctagtatgaagaccaccgagagctatccttccagggctttaaacacctctatactcagctagtagaacattcaagtaaaatacagaaacctactgaataatgagatttttttttttttgagatggagtctcaatctgttgcccaggctggaatgcactggcacgatctcggctcactgcaacctctgcctcccgtgttccagtgattctcctgcctcagcctcctgactagctgggactacaggtgtgtgccaccccagctaattttttatttttaatagagatggggtttcaccatgttggccaggctggtctcgaactcctgacctcaggtgatccacctgcctcggcctcccaaagtgctgggattacaggcatgagccactgcacccggcctacaatgagatattttctaagaataatacctgcaagtagattaattattataggcataattttaatcagaacaataaaaatttatgttttctaactagtttcgggcctaatagtttagatgcataaggaattgctcccatctgaatgtagacagagagtatgtgatgggctgagtccaagaaaatgaaaccataaaaccaaagtcctacatttaaaattttaaaaagcagcaagacagaatggaagacagcgactgaaacacatgagttttcctgctgaccacaagcaccctagcagtcagaagtgggatgaaagctaataacacaatactcagctgcattaattcagtgggtcagtatttttatcagagagagtaaactttactttgcttttgggttctatccataaattgtgtgtgtgtgtgtatatatatatatatatataaaatattgtgtatatataatattacgtgtataatcatgttttaaagacctatatttagttgcactaaataatcaaagctaaggaaatctggatcttgtgaatttcctctagcttcttctccttattctgctctatgatagctcacaaccatagctaaaacatcctgagcatcttctatcagcagtcaggtactacagtaatacattacctatattcactcatttaagatttacaacaactattattactctctttactgcagatgaggaaacagaagcaccataaaactggggaaccagtccaaggtcaaaaagtttatgagtggaggagctgagcttgatcaagggagtgtggcatctgagtctgaatcctgatccctgtctcacatcatcttttctcgagacagacttggaaatggaagacagagggaagcagtgtagtttattttagtcttggtgagtgggagaaagatgtttaaaatatggatgcagcttagacgttgatatagtttggatgttgtccctgcccaaatctcatgatgaaatgtgctctccagtgttggaggcggggcctgttgggaggtgaccggatcatgagggtggatttctcgtgagtggcttagtatcatccccttggtactgttgttgcaataggaagggagttctcatgagatttggttgtttgtttaaaagtgtgtagcacctccccctcctcttgctcctgcttttcacctgtgtgtgtctgttccccttttgccttctgccatgactggaagctccctgaagactccccagaagcagatgcctccatgcttcctctacagcctgcagaaccgtgagccaattaaatctcttttctttacaaattactcagtctcaggtatttctttacagcaagaatgtcctatagagatgtggatacttttttcccccaatcttggccactatcatgtcctttaagttatcagagatatataggtgtgttttcaaaccagtagtgtatttttgtataaataagaaattagcaattgattctcacttattccatttctccagagatacaatgctgacacatcccgaatttaaaagcattttaccacctagtggtgggtaccttgagaaactgccagatactccaatagctcagagcaataaagaagaacgggggaaaatttgctaacataaattttaagtggaaccatttacatcttggtaaatcttccctatatgtcaataaaagaaaaataaaagcattatattaataataatcataatgagaagaaattatacagtgatatcaatttccttggggagggtggatagtagtataacacgcttctcatttatttaatttttcatatgtggctttttgtactactgaaatggtaaaccatccatgagggtgtggctgaaagggatgtttagtttatgtacaaaaatgcaggagaagcacacccctagtccttcactgacatatttccgaaacatcagaaaatattctaatcaaaaccgctgttgattggaacaggataatagaaaattcaattgaaacaaaagtaaatgaaagaagaaaaacaatcggagtctctattaaagaagaatttatatgtcatgaattccttctattttactgggtaccttatttgatcatttaatacttgcaacaatgttgtgagaaaggtattggtatcctcattttactgatgagaaaattgggtttcagatactgtaggtgctcaatgtcacacacaagttaggcaggtttcaaagaggttcagatgacaaagcctctgcctaggatgacacctcatctaagaaggacagcagtcacctgctcacagggaggtgatccacacttgtgctctgatgccaagtgtcaggtggacagaggtgaagagacataacatctggaaacatgagtagaagaaagctcaccaggagcagcagagctggttattttcgtgaaagataaattgatgggttgcttgctgatagcttgcagtgctattccagataggctggtaacccaaataacttgtggaattctccacagctgaggagaaatggaaaaaaaaaaaaaaaagcactagccaagaagtcattcgattatgctaaacaaaatcaattcatttatgacttttcactttcgtaaggtggggaatgagtggtttcttaacgttcatccagcaattgttttctagcctcattgcacgactgctttttaagttcaccttgacctaaaggcaaccttacaaaatgctttgcaaagttgtggaaatgttgcattccacatggttgtgaatagaaagagcttcttgaggccttgattagagctgggtggagctaagcctgaaacagatgatggctacactacactgcaggcccagctgccctgcccatgggcacaacagcaaacccagagacagtgcagggaggctgggaatgggtcaagtttaaattaggcacaggatttggcaagccactacataaaaatacaacagcccaacagaaggccacgtttgggtagccagccgtcgtcaagtgcaatgtgggaggcgccctgtctggaagagaaaatgggaaagaatccaccataagaacatgactcaaagaggtcagtgatgggcataaaaatatgtccattgcttctcagaaatcttgccaagaggactggatttctaataccagcaagcaccaagaaacagaataagaagaactagattgtcctcctttttctgatgtttactaaacctctattttctaactatattggtggcaggtagcattttctataaaaacctagctttctctggtacttttactttttttctgcctctatagaaatttcaccttagtttatagctggaggaacatactcttcatttaattttcctatctgccttgctgggcaggtggttttggactgaactgattacattttaggtaacaggatatttctcagagacagcatgtcttgctgggtattttgggattcatggaaaataaaaagaaaaaatgaaaagaaatccattcacctttcatggcagtgatttagtagacattctgtggtctctattaggaactgacccgaatagaaagctagattagcctaaaaaaataaaaaaatgtagaatctggtttacaaaactccttagtttctgtttttatgccttagagaacatgtatgagttcaaatataattacaaataagtaaaaatatgtcaggcctatgtttaagtgttttttttttttttgtatttactagcagtgatgtttttgtcaaaacatttttattctctgatctttagtcactttactgtaaaatgaagatgaagtcagctctgcttatctcacaagtcttttgaaagactccaataaaacactgtgtagaatcttcgttaagccttaggtgttcagttaattttaaggtataattttactatctctacaaaaaaatttaaaaaaaattagctgggcatggtggtatgtgcctgtagacccagctacttgggaggctgagatgggaggatcccttgggcccaggagttcaaggctgtagtgagctatgatcacactattgcactccagcctgacagatgacagagtgagaccctgtcaaaaaaaaaaaaaaaaaaaaacaagaaagaaagaagaggaaagaatatactatgtgatagttgttaattagaattttattttgtcttattgaaaaatttcttctcactttgaaatttactagagtaagttggaattattagtttttcagaaacagagagagctggaaagccatctttatgacatccctcattacagaccaaccaccaagtgatctaactggtacatataccttgaaagacatctgataaacacagagcacacctgatgagttaagccaggtggaggtaaaagctacatttttcattaaaataccacagtgctggaaatttctaaaagaccttgagtggtgatagttgtaggggatgccctggccaaagtggcctgtggcgttgcatgctcccacaaaagccatgtaggcaagactcaatggcgttggaaccgtgtctgggcagaatgctctgttttcctttctggaacatggcatgatgagcaagctatccacggctgtcgcaggccatttcacatccacctccctatcttgcaggaggctctgtgtcctgccgaaggttgtcatgaggctctttcccatcaacctacctggtaccagtgaggcatggaattttccccctcgcccttcttggatacagctgcggaccgtaaaaccattcagctctagtatgaaattgacttctcaactacagagtggctcactccctgtgatgcgtgttttccggtccctccaggttgatggtgtcctgtggggacagggatgagaccctgaagaagtatatgctgggttactgaagctgaatcaatgcttttctccaggtgtgtgtatttatgcacctgtcttttctcgaggggactccctaagctcccagccaggtaatatgcacacgatagcaccagaggcaggatggagaaaggaggtcaagctctccaagttcagtaatataggcatgtatttacatgccttttctatcccaggtcttgccactgtctggtgttctcaagtcaggagcttctcagtattttcaaataataaacctctgtggcctccctgggaggctgcatggagtaggggaagaccctggagatctagcttcctctagatccattcttacaataaatccatctctttccagccctgttcctcaatctcatttctcatggtgctgagttccatggggcaaactggttcattaatcacaggtatctccatgttgagagctgggttgtagctctatcctttctgctaaggcaattactgctcttccatcacttcccttcctttattccaaaaaaaaccccacatctttcattcattatttccttctgtcctgttctccttgtccttgtggattaccacctttcgaacatttctttattgcagcttctattggtttggggaagaacgggagactaactctactggccagttttccatctgtaatgataaattcccagcacaggtgggtggaatatgcatccttcttgtattcttagtgcatttcacagaacctgactacagaaggtgctcaaaaaaaaatcagtattgaagaggtggctacatacaacaaatgtacactttggctacaaagttagataaactagcttgttcagcaaacattttcagagtatagtattctatactaggacccttgacactggatgccagggcagataaaacacaattcttattctttattgtcagtaatgtggtgaaagtcccttggaatcgggtgaatctgcaaaatttcagtgggaacaagagcatgcaccacccaggcttatgtcctagtctttccagggtctgggagtaagaaaaagatacagaaacctgattacagtcatacagttaataagttaacagacaacaccctgtggaattaattcacctttcaatattcattataaatgccgtcttccttctttgaatctctgcaattgtggcaagccaagtttatgccgtaccttagcgataaaagtagagatgattaactgtctttctgtctttgtctcttcgttcctttttttttttttttgatagagtcttgctttgttgcccaggctggagtgcagtggcacgatctcagctcaccgtaacctccgcctcccaggttcaagtgattctcgtgcctcagactctcgagtagctgagattacaggcatgtgccaccaggcctggctaatttttgtatttttagtagagatggggttttgccatgttggccaggctggcaaactcctgacctgaagtgacccacccatctcagcccctcaaagtgctgggattacaggcttgagccatcatgccctcctgtctcttagtttgttttaattttaagaggaacaatggtgctttgttttggtttatgccacccaaagaaatagaagtatgcaactttaaaagaaaattttcagccaagggtaaaaacataaaaataaaaataaccaaattggtgtcagatgcaaagaatcccttgaaaattggtgaggattgaggaatagagaaggatactgaagagggatctattattcaaaactcaattaccagaaacccaagttaaactaaaggaagtgggaatttaatgtctcagtagctgcaaagcttcaggtacagctggagccaggtattcaaacgcaattgttaggttcttccctcttctgtactggcttcacgttcagacagatttcattctcgtgtttacacctaacagcttagcaatcagtgcagaaatattctctttccccaacagttctagcgaaagtactggccacaagtctctgacttgccaaacctgagtcacattcctcctcctcaccctcactccagaggactgggttgccctgctcaaaccatatgaaccgagagtcaggtcaggttgttacacaaaggaaatccaaggaaatgttgccaggaaaaggggagaaggcttttaagccagtatatgcggtagctacaattagtgtaagataatactggccctggagttttggctgcatcaccacttaaaaaaaaatttaagttttgaattaagccaaattgcttagcacagaaggctggtttggagtgtagctatttttgaattatttactgagcttcccactgcatttgccccccacaactcttagcatccatctcttgctaaaaggccacctgaccagaatgttaagagaaatatccaatagcctctacagaaagagtagaatatttatttttagctttatgatatttgttcttaaatgcttttcagcctggaatgacttcaatgagatttgtacatttaaaggctgccaaaaaaagaagggggaaaagtcgaatattaaagaaaatctcactcacatccaaaagtggaagattctttaaacttttaaagaaaatgttagttctatttttaactcacttttgggttgtctaaggcttaagactaacataagaagaaataggtcgagcaacaaaaacttgaaaaccaaaagattttatacttgggaattaaccttttattaaccctaaccctaacccccttttgacgaggagaaaaagagagagaaaggagacccttctatgtgcaattcagggttcagtcatctcagaattttccatatacaggccctagatcaggggtgtccagtattttggcttccctgagccacattggaagaagaagaattgtcttgggccatacataaatcacactaacactaacgatacctgataagaaaaaaaaatgcaaaaacgtctcatcatgttttaagaaagtttacaaatgtgtgttgggccacattcaaagtcattctgggccacatgcagcctgtgggccatgggttggacaagcttgccctagatgatttttctaaaaggaaatttgttctgaaagacagtagtcagtatacctttacacaatttcatgaagatgtctgggttatgagaattgtcctactaggaagagctaccaaaatagctcatcaccttgaggtactgtggagtgaaagtgaccaggtgctttacatcaagtttacaccaagctttactttccaaactttttaaactgtcagtacaactccttttgaacatatcttctaggttggctcttggagtgatacatccatcaccccattctactccaaattcatttgaaattggcaattttcaggttccaacttgcgatggcttaacactccaggcctccctaagatggcactgaacatagggcagccctcctggaggaccccacagagaggccatggagcatgagagtgagctgtacctggcatgatgtatgcaacgtggcttattctctttgattcaggttttacgtttctcgaatggagcctcttctaggttgctatccatttacctccccatctctctctctctttgccttttcctggttgagtccttcccgggttaacccagccctcctgatggcttcccttcactttgaaatccacagacaggaacaactctacatttaatgataaactgtcttacattcctccctaattagttcaaattgaaagtttgctctcacatttggaattttagtatggctatgataaatacttgtgggctcctcactcggagcaatctctgaacagacgatctgaagctagatatacaacattctcatatagtgttcagtgtgaatcaatatcaaagtttaaattcccagtgatattaatgaaagaggtgagaatttgttgctcatatcaataagaattagacctaaaatcacactagtgatctttggacttaatttagtgttcattcatttagatacaaactgagtgtatagtttctgtttaaaggaagagtattttgtccgtgatcaccggtgcacccaatggccaattgatttctgtttacattctgataattctttgcttatcagatcatttcacatgagaatcaagccctctgcaataagcagtgggaaaaattttagtcggtgagaaactccaacgcctcaaaagaaagagtgtaactttcaaaactgtcatttttgttctcatggtaaaaatctgactttgtgtcaatcattccccaaatcttcagttgaggaaagaggtcatgctctacattaattacagatgacaagctagagacaaaactaaaagtccaaccttataacttcgcttttctgcctctccctggtcaaaacaaaccctcttataccaactattcttttttatcacttgagtgctatgtacagggtaaaagtaggattacctcagaataataatttcacacataatttttgtaagaaaagggttcatgataatacttttaaaaataaacagctagcccaaatattcctccataacaaaatgtgacaaaaggaagttagaacaaaatcttaatttacacagaaagtaaaactgtttccctgtaaacaagctgggctgtcatgaaaatggataagggttcacagaaatttgacccaaagaataaagaatgaacggatgacacaaaaatggctaactggataaaaatatgttctgtgtgattaataataagtctccaaatcacagtacttggagagaagggatgggcatactactgtggaattctggatgtgtcaagatctggcctgggttctgggaacactggatctctttgttcctctctctgctgttcagggacagtggaaggggaggaaaaagggatcgtggtccagtgtacgtggctcagggactgggcctctggaagccacagggaccagcgatagtcacacttcttcagccctccagcgattgctctctgtttctgttctgttttcacactgttatccttcagcacagctctgtgcgctgtttgcctctcctccactggtggctgctctctgctaaataagcatgccacttgttcactgggtaaagtgaaaaagacgttgcttgtaaaataattgagtctccaaaaaaagaaaaagaaagcgtctggatcactatccgtgtcacccctaccctgagaagtctcttaccggggtgacttttcttcaaagaaagcattttccaaactaagtgcagaatgaagcaaaaaacaggaaagaactcagattattttatgacgtcacatgatgctgaattacagggtggaaagaaacagaaacacagaccactgacttattggagagagagagatatatataccatgtatacgtaatattatatgtcatataaaatatatttaattacatataatatatatttatagatctccatggcctgtgcttctatggaatcaaattgttgtgtatgcatctatgggcatatacagaaatattatatattaatatataaataatatatatgttgtttagatggagagagatcagaggagcactgaccatggaaatatagataatatacaatatatataaaaacatataacatatttttcctgtgatatgtgcttctggtctctgtgtgtgtgtgtgtgtgtgtgtgtgtgtgtgtgtgtgtgtgtggcataaactgatactacaaaagcacagatcaccaaaatagtatatataaaatatatatacagcatattatgtattatataatatgtggtctgtggtcctagatatctatacacacataatgcacacacacacgtaagttatgtgtgtgtgtgtgtgtatatacacatacatatacatatcctaatctggtagcacttttgttgttgttgtttagattcagggggtacatgtgcaggtgatctgtattatttattcttccttgttccatatatattagattaaccaagatttaaatatcagctctattactaacagtaacacctggaccaagttatttaacttctgtttacttataagaccataaatatataaattaatacatttaaggaatacttactgaatgctggtagagtatgagcacttaataaatgctagtagttgctgacagcacttatgaccaaaacactttcacaatcatatatgcatcagagccagggctgccgtttaaaatataatgttctcatttgcaacgggagaaatggcacgaaaatccaggcccctctaccaccggtatgtactctttccactactcagacagaggaatacttacatttgaatgagaatatccaatcttctaaaaattaactgtaaaccaaacgacaaaatttaaatggagagtgtttggggggctctggaggaatttgaaacttgtatttaatttcctggctcttcatcctgaaatgcgtctaagctagtaacagacagcaaaaccgagttcctatctctctagtgttccctgctgagataaaagcgatgtgcagcaccggatgccaacagagcaaataattacactgagtgctctttccacagccaatgaatcggaaagtgaaatttttgtggatgcacctgagtgctggggacatcagctgtcctatgagaagtcattaacattttctgaatgtctactgtgtgccaaacactgattactaaagaggacgcaaattgaaatgagagattattcttgtactccaggtgcttaaagccgttattaaggatcatatcacatgtccatcgagaataaaatgtcaggtaagaaaaattccatgaagaagaacagagtgctaggaaaatgcaagaaaaggaatgattaatgccagctagcttggggagggggctatgatgagagaaaggctaaggacagggacagtgagacagggacagttctctctcctagaattattaggaggtaaaaatttggagctcttctacttatgattaaacagaaagaggcatgaggagaaaaccaaatgatgtcatcagaataaaaaggcactgcaaaacagtagattatacatgcaccttgaatgtgctgtctgataaatcagcattttacaaaaacacatccggactagcaattcagaagaaagcaatgttaatgcattaattcaaagagagcaagccatccccaccctcaccccataggcttttatttatttatttatttatttattttagcagcctataatctctaggatttaaaaaaataactcaccaatgaacagaattaaacttctcaggtctgttgctttaaagaatagccaatatttgtgagaaacaatttcaagagaagattactacaaaatgaaaatgtaatatgtctgcatcagttaaatctcccaaaacaaatttgcaatattgcctctgactttgacgattttattctttcagtaacagtccagatggcatccaatgagtattgacatcatcatcataaaaaaaggctaagaaagtcaaaatgggatttatttaggacaaaaattaatatcaatagataatgatcttaaatttaaaggatgaggcatgaaaaaaacaattaataaaccttttatcttcctggaagatttccatttgatatgtatagtcatttgttgtgaggaatagaaaaaaaaaaagacacattaaagagtgtaaaaggctataaggtaccttgagaatgtagaaaataattattatttaatgaaagtgatagctaagaattcaaaaaataccctttggctatctgataagaaaacctatgccgatactatagcaaatctaacataagtaattttttggccttgcaatagattaactacctaggacgtaagaaaatgtctaaatctgggcttaatccaagcctctggaggtggtaataaagtcattaataataatggtaaaaactataataatcttttcagtttttgctcaccttctatgtgttccatacaccagttagaaatactgaattgtccagtgacatcaccataaaaaataaggataaagtccaaatataccatttttttcttgttcatctgttgtgtatgcgttatccagagtcactcttttagaaccatatatatttttaacacatgactggtaacaagttctaccttttaattacataggctaagtaaattactaacatctcttttatgtctgaaagcttccttttcaaggaatgccttcttatggaacctctcaagctctgtgaagtctgcctgaagactggatttaaaaatagcataaaatggtcctaatttaatttatggcctgaggagcccatattcacgtggtttcgaatatgggtaggattgttttctttttctgtccaatatcctcccacctcactcaagaccttacgtggtcttattgatcacgggagcacactggagcggtgactttatgaactaggctatccgtgacccttgggtccctttaatgggccttaactgttagtgctgaacctgccctcccaaaagtcacctttgcattatttttcataaatgtattattttctatgtgggtcaactggatctctcttgataactttctgttcttcacatatctcaatgttctcatctttttttctttcttggcttagatgcccactttttagtacagtctgacataatctgcaagtttgaaaattccagatgcctataaagataacatttaaatgctagctaagataaaactcaacaccagctgggatcccccaaacttccagaaagttgtttgtttatgcctgcactatgtttgctgccttttatgccactccttaacctgccaaaacagtcccaaacactgccatggagaggcctatttggggtagaaatgtattagaggtttggggaaacactaaataaagtacatcgatttcccctttcctcaaagtcaagaaacaaagttacaatcttagtgaagttcaatatttcttcatagactcttggccttgtgcctgcacaatgaatggatcacgtcaggttcccatgtagggatgagagaacaggaagttcattcctatgattcttggagtctttttcagagagtacttaaggataggcaaacagtattctgtaggcacagtgatatatgttgcagaaaaatgtgcattttggtccatcattaatgatttactgttgagtacagtttacaatcttaagtaaaataattcatctccagagatttatttactgcttttggccacacagcaataaaatgatttggttgtactgagaagaatttccctttaccaaggccatcacagggagaaggtatggtgttccaggtaaaggatagcataatagaaccatttcagtcaatcaacacagttggtagtcagagagaaggcttctttgtagatgttgatagacatatttatgtatttggaaagaattttccctttatggaatagagttattcagaagacaaagggtccagctaagtttgggaataagtcgatacacctgagttacttgcacagaaatatctcaaaggaattattgtaattatgtaattattgtaattcccttgagatattgtaagtcaatggaagctgtgaaggttttattttcccaatccaaaatcacctccagtcccaataatattcactccaaatataaaatggcaaattcacatgttcagaaggcactacacagaagcagcaccacaagcgacagctatctaggaaaagaaaacagtccctgagactagaatatatggctacaaagaaaaccaaagctaaaatcaaagcatttagatattgccaattttgtactgttccttcgaacattctggtgaaaataagtcagagcttgtctttcatcttggtcgtatcagatggatccaaccacatttaaaaacaaatcatttctctaattactgtgatggttactagaggctgggaagggtgaggggtgataaagcgaagttggttaacaggtacaaaaatacagtctgatagaaggagtaagttctagtattcaatagtacattatcgaaattacagttaacaataattgttgtgtatttcaaaatagttagaagagaagaattgtaatgttcctgacacaaagaaaagataaatatttaaagtgatggatatcccaattaccctgacttgatcattacccactttatatatgtatcaatatatcacatgtactgccaaaatatgtacaactatgatataagataagataaattatttctctacaaatacaatgagaactttgtcattgcccagcaggatttagctattagaaaaagaattatattaggctgggtgcagtggctcatgcctgtaatcccagcactttgggaggccaaggcacacgggtcacttgaggtcaggagttcaagaccagcctggccaacatggtgaaaccctgtctctactaaaaatacaaaaattagtcaggtgtggtggtacctgcttgtaatcccagctatttgggaggctgaggcagaaggcttgcttgaatctgggaggcaagaggttgtagtgagccaagatcatgacactgcactccagcctgggcgacagagcgagactctgtctcaaaaaaaaaaaaaaaagaaaaagaaaaagaaacaaaacaaaacaaaacaaaacaaaacaagacaaaaaaaaagaaaagaaaagaaagttttatgtcagagcccaagtggttgagattaacattctttactatttctaaccacttcaaggtgctaatttacaataaggaaagagtaacaaccattaggggaatatagactctttcatagcaaggttaattgaagtgtccatttgactatgtgacatctcactttcccctcttgttccgcagctcgattggctatgtagttattatgtgcaagttgcatagttactcagttctgtcagagaggatgtgtgaagaagatgaaaaagaaaggactagctttttgcaaattggtcatgtctcttgcggatctagttaacatttcctgttttctgcaagaattaatttttttcctaatgaactttaagaactaccaatatttttagtatactctttctttcttatttatttgtacattatctgtttgtatccttgaattttctctgggatgttataaaagaaaaatattacaagcataatttctgacacaatgttttataactgttttcaaaagcaatctatttctctcttaatttctatagaacccattttagtcattcctatgatgaatgaaaaaaaactcacaattagttgtcagtttcagaaaggagtctcagaagcatcttagaaccacctaggcggtcttataggcgtcacagaaaaatattccaccttacttattcttatcttcttcaaactgactccaaatataataagcaggcttaagttatataaggttccttaaaagttgttctcaaaaacaattaaatgcagactgtcctcagtaaaacttgcattggcccagtccattttaccaagtttgctccttcttacatgtacgactgcccctgtgacaagtttaagcctacgttaattaatcatctttccataacactgagacatattcatccaaccctgagagggataaggggtaacaggcaagatatattcaaattgtgacatttaaggtcaacttgactttaaaactcatatactgctcagttttcatatacgtggctgaaaacaagtcatcacagagaactggtcacactgttagaggaccaaaatagtaaaatatgaacaattcttccatatttaatgatattaaatataacaggtcctatgtctatgcaattgaagtcaacatgtcactaattagggcttcctttgttatcaaacttgctgagaagatagaacagtgaggaaaaaatagcaggaattgagctgtacagaattaaagacattcttatgaaccttaagacttaaggtcagtcacactcatatgacatttggactattagacaactcttctgacctcaaattttgctcttaccagttggtgataatcctttggtaagagagcatgttaaaagtaaccaaatcagataaggactagaagtcaaatttcaacagaagagggcaatgagactccgtgccttaattatcaacatttttatgatgaagaaccttcctaaactaatgaaaaatacaagacagaaacagatgaaacacagaaatggctgaaaagaactccctattaatttctgaccattttcttccctattaacagtgcttgatgatctggagtgaatacctgcctttttggctcctgccaattagttcaggaagttccatcttcaaacacattcagtgacctgatttaataggggcctttttatttgatcgccgccaacaggcagtcctacagacttttataatcacagtgggctgctttacaggcaagtcaaattccagtttaatgaaaacctacatcattacaaggaattgagaagggaattctggtttcttttctgctatggcttacactggaagcatagtaactttccaatgaatccatgcaggagaatggaattcatccaatagggaaagcctcatttttctctatggtagaatggtagaattaatgaatatcaagaacacgagaacattttgtaacatcctgctggttaagtatgtttcattcctagctaggttaatatggataggctgggggcagtggtggtggatatttccagagatattacctgaagtttaacaaaacattggttttaagcttgtacatcatgaactcggggacagcttctctctcacactctatttatttatttatttttgagacagagtctctctgtcatccagactggactgcagtggcgtgatcttggctcactgcaacctccgcctcccagggtcaagcaattctcctgactcagcctcccgggtagctgggattataggcccgcaccatcatgcccggctaattttttatattttttttagtagatatggggttttgccatgttggccaggctaggctggtctcgaactcctgacctcaggtgatctgcccacctcggcctcccaaagtgctgggattacaggcgtgagccaccacacctggcctccctcatactttcttatgcaccaatcatgacccattttgaaagaggcagagtggtggaaggtttggacttcatgtgctgactggttctctttgttaagactcaaataaaaccactggagtcctatccactgaatgctagatctcaagacatagcacaatgggattcctggttacttacaagcggtctttatggttccccagaacatcttcccttgagcctgcttcccttgctgctccaagtgaactaaggccagaaactaacagcaagcacacaggaactgtgggctctgtgctcccctcggtgtttctgttccatagaggcccatcatctttagcgacttgattttctcattccacacacaactccaacaggtatctcatgtattcattggtttcaaatatgtgtgtgaataaatccctctaaatttcagacctgtatatccaacagtttccagggcatctcatctggttgttctacatacgttgcctgaaagtgaatatagccaaaacatatcatgccttcgtcattctctccatgaagaaagaaaggaagagagaatctcttgtgtttcccaatgtgaaaggcatagtggtgcattcattgtcaaagtcatacatatgggtgacatcactgttggtagggccttctcccttaactcacctgcccccctcacttcccgcaccaccacccctaatcctcccattgagttagtaatgaagtccttcctatgtcctgaaagtctcccgtgcatcctattttttcttaaatctcactggcctgccttgggtcaagccttcatcatctctgctctagactacagccacagtacccagccttgtctcccttttctaccatctgatgtttattctctacatttccccccacccagaggaatatgtttggaaaaaaaaaaagaaaaacaaatactgctatttccctgctcaaaattttcaatggctctttactcttttcaggatgaaatttgaactcctccagattctaactgttgtcttctgccttcctctctggagtcatccctctgcactttccaaacacctcatcctgtgcaaaggtcacgcgacaatatttggagttcccagagctcgccagaccctttcacaccttcgagctgttgcacaggcgctcctcttttccctggctaagtctgactcaggctttacaatgaagctctgacatcaccatctccaagaaaagcctctgaccccaggaacctgagtgaaattccacacactcctgcagccctctgggtttacctctattgtggaaattatctcactttcttgatttgtccttctcctccctagactgtgatcccctcgaggacagacagcatggcttaattctctgtatcgctaggcctgacaaaacgctcacacacagtaggctcctgaacgatgtttaatttattgttaacacataggattccacagatcctgaggtacagcagacttcagatacccacttcaaagaaaacaagggagtaatgcctaggttcttgttcctatgatttatactgtgaataaaataatttcagagaagttcctttattcacttgaacaatatttaaagggcaaaaaaaattaacaaaaggtctttttaaaaatgcaaataatttacatttgttgataaagccatacaatcacaaaagtgaccatatgaatgcaaatattccttctaaaaagtataattattattcacccatctaacaaatattaatgaacccctctgatgttagatgctctttatggtacaggggttagcagagtgggtacatggaagcttcctgtagtttacactatcatctggaaggcgattaatcaaatactacttactgttcatgagtttataattataaaatggagggaaatactctgaaagagaagagtgtggttttataaaaccatataagaggctgggtgcggtggctcaggcctgtaaccccagcactttgggaggccgaggtgggcagatcacttgaggtcagcagtttgagatcagcccaggcaacatggcaaaagcccgtctctactaaaactacaaaaattagctgggcgtggcagtgcatgcctgtaatcccagctactcgggaggctgaggcaggagaatcgcttgaacccagaaggcagaagttgcagtgagctgagatcatgcaactgcactccagcctgagccacagagcaagactccatctctctctctctctctctctctctctctctctatatatatatatatatatacacacacacacatatatatatacacacacacatatatatatacacacatatatatatatacacacacacacatatatatatatacatatatatatagaaactggcttagacctaaggtgagtgggtctcaactgggcataggggaaaaggagggaaagcattttagatggaggaaaaaacagggcagggataaatcttcaagaccagagtggccatggaaaagtcacctctataactagaatcaagagagtgagagaggaagtgataccagatgaggtctgagaggcagggagggactgatccaggatgctgcttaagggtgaagaggatcagaacacgccaccaaaaaacataccattttggcatactgattattctgaggtaaaggcaattgagaaacagaaaatgcatgaagggctctccacctttcccttttctgcctaaaagcaggacataggtaaacgtacccttgccaaaccccaaaaaccagagactaaaatgaaacacagtcagagcccagaaatcatattttaaccatgaacaccccaacaattaccccctgattgacgtaattttcctaaaaatcttaagcccctccaactaaattaatcctccattttgtataacaaatataaaaactaaacttccaccgtaatactaataccttcagcatatccctctgaaaatgtgtatgtttctcctgttaatctgtcttttgttatcttaattagtaagaaccataaacagaccataagagagaacaggagcactttgggaggaagaggtgggcagatcacgaggtcaggagatcgagaccatcctggctaacacagtgaaaccccgtctctactaaaaatacaaaaaattagccgggcgtggtggcaggtgcctgtagtcccagctactcgggaggctgaggcaggagaatcgcttgaacctggcaggcggaagttgcagtgagttgagatggcgcgagttgagactgcgcgactgcactccagcctgggccacagagcaagactccatctctctctctctctctctctctctctctctctctctctctctatatatatatatatatatatatatatatatatactggcttagacctaaggtgagtgggtctcaactgggcataggggaaaaggagggaaagcattttagatggaggaaaaagcagagcagggataagtctccatgaccagagttgccatggaaaagtgacctctatagctagaatcaagagagcaagagaggaagtgataccagatgaggtctgagaggcagggagggactgatccaggatgctgcttaagggtgaagaggatcagcacaccaccaaaaaacataccattttggcatattgattattctgaggtaaaggcaattgagaaacagaaagtgcatgaagggctctccacctttcccttttctgcctaaaagcaggacataggtaaacgtacccttgccaaaccccaaaaaccagagactaaaatgaaatacagtcagagcccagaaatcatattttaaccatgaacaccccaacagttacccctcgattgatgtaattttcctaaaaatctaagaccctccaactaatcctccatttttgtataacaaatataataactaaacttccaccctaatactaataccttcagcatatccctctgaaaatgtgtatgtttctcctgttaatctgtcttttgttatcgtaattagtaagaaccataaacagaccataagagagaacaggagcactttgggaggaagaggtgggcagatcacgaggtcaggagatcgagaccatcccggctaacacggtgaaaccccgtctctactaaaaatacaaaaaaattagccgggcgcctgtagtcccagctactcgggaggctgaggcaggagaatggcgtgaacctgggaggtggagcttgaagtgagccgagatcgcgccactgcactccagcctgggcggcagagtgagactccatctcaaaaaaaaaaaaaaaaaaagagagagagaacaggaaaactttttttcttccatagggatcttgtttggaatttcggtcttaatcctaaaatcaaagatggattttaattggacaggtttgcaatttgaaaatagtagtgtggctgccctttggagaaaggcaggatgaggtgcaggtgcatgtggagactagttaggaatcaatgagatagttcaggtaagcggagataagattttgcagtagagaaatacaagcatacatggtccaagctaagctgacagcacttgtggatgcaacagatatgagaagagggggataagaagagtcaaggcgaccccggcatttctggcatgtgcaatttttactgaggcagaaaccagggaaggggctgagggtaagacaatgactctcatcttggacatgtgcagtttgagacttctttgacatacccaagcgaaaatactgtatacacagttgaatttactggagttcagagaaaaggtctgaattagaaacatacatttagaaatatttaatttaagccatgagacggatggcattgccttgagaaaaaaaaagtagagtgagatttccattgatgtgttgctatttcaattaccttgtaaatagtctagtttattattatcttatcctattaattgttcttccactctttctccttcactgggttctctgaattatagaatttatgcagaaaacaaacttggagatcatcagatataatctccaaattttacaggtgaaaaaactatagtgggttactcaggatcacactgctccttagaggtaaaaatgaagacaaaagctcaggtgtttttgatgagtactccacaggactacatctggaacaggagcatgttgggagatgaatgtaagagtcccaggtacccagaatcctaccaattctgacatgcgtgtgcttgtcataatgaaacaacacaggacatcatgtgaaggacaactaacgtggggttacccatgaggtggtgagaaacagaatgggattttgcctcaaacccactgtggtttacacattagtaaactgttcaaaatggggccaaaagcttgaactctctgaccctctatttccttctctaggaaatggagaaaagcaatcattaccttgaagtgttgaaaggaataaaacgaatgtatttaaagccactaaccacatagaaggtttccaaattactaactaatattttcctccaaagtaaagaaaaaaaacagatgtcatcaaaataataaagctggccgggcactgtggctcacgcctgtaatcttaacactttgggaggccgaggcaggtggatcacgaggtagggagatcgagaccatcttggctaacacggtgaaaccccgtctctattaaaaatacaaaaaattagccaaatgtggtggcaggcacctgtagtcccagctactcgggaggctgaggcaggagaatggcgtgaacccaggaggcggagcttgcagtgagctgagatcacgccactgcactccagcctgggcgacagagcgagactctgtctcaataaataaataaataaataaataaataaataaataaataaataaataaaaaagctggccggatgcaatggctcgcatctgtaatcttaacactttgggaggaagagacatgaggatctcttgagtccaggagtttgagactagcctgggtaatgcagtgagaccctatcactacaaaaagtttaaaaaattagccagatgtgttggtgcatgcctgtagtcccagctacttgggaggctaaggcaggaagattgcttgagcccaggaatttgaggctggagtgagccatgactgtgccactgtgctccagcctgaatgacagaatgagactctgcctcaaacaaacaaaccaaaaaaccaactttattatttaaaaaaatctcaagggctcattgaaattatttggaaacattaaaatattttttaaaatattaaaaaagcaattattccggtcatcagggtttaaagcctatttattatataatgcacctaaaatttataaagcacccatgattatgaatcaaaacatctatatccaaatagtatttgatattattatactgtaatgtattttctagaatacagcacacaagaaaccacgtgctatttcaatatcttgttaagcaagtgaaaacctatgttgtcagttttaattcactcaaatatgcctgtagccaaggtaaatggtatagtttaaaatagtaccacaaatgaagcaactatcttacaaatttaaaattaatcatttcctcttttattcataaacttttatgcttcatctggatttggatctctattcttctaaaatttagagttttaagtacaaaggattttttagctggtatgagtgttatagtttgctttaccaaagattttcagatgagagaatgaataaacattgtaagttacaggatatgaattccagggaaagagctatcatgcaagaataagacttatggatttcatttacagaaaatcttcagcaaaatctacaaatatatttttagctatatagttattttttcaatttgaagacataatggtgttaacagtgactgagcacttttatgaaactctcatggaataatatttgaacttcatctttttctattgtggtagagcacttgttcaaagccaagatgtatatccccacttgtatggggcagattccgggcaaaaccactccttaccacaaagcagacacttctcagatgcctcttcaggatttattccttacctgccttcaaaatatgatttgaagcaatttacaatatagcccccaacaaacttaaaagaacaacaataaaagatagaaaaaaaaaacaattagaagacaaagaaaggcagatatgtcagggatgaatcacatgagaaaaagaaagaatggaacattaaatttagcagtgaacttcttggcaactacagaaaaaaggaaaaggaaaatacaaattatacattattgtttttaaaaaggaaaaagtaaagtttatcttcaaagacacaattttttagtagtttattataaaatacatttattttattgtttttttcattagaaacttagagaacatgaaggaaatgtcttttagtacaatttcgcagaaatcacaaaataagatacaaataatcatctatctgcctgctctaaaggctttgatactattatactcaaacttcttaaaggtttttttttgtagttaaggacagacaattcaagttctttgttgaagatgagattacaaagttatagcctttaaacagttctgttcctacacctgactttttaaacctctgctaaaggaacttaccttggttcctcgtacaagttagttacacgtttattgctaatgtatatgtaatctatttccccagcaacggtaaaatactagcccacaaaacccagtatagttactggaacatagtgagtatttgatcaatgttcattgcattgaattaaaaatataaagaaaaacgtagttagcatgcatctaagaccagcagacaccaatcccatatttttaaaatcagcttaaaaatacatatttctataacctgagcttaatatttaatctaggggaaaaaataaataaaataaagtaaaataaaaacaaaaattatagattccctggttccatctcagcactaatgaattagaatatctgtggtttgcatttgaaatctgcattcctaagaccttctccagagaatttattgcagccatactccagagtggcatttcatcaatcccaaatattctccttttataacatttttcatgtacactccttttttttttgcaaccataaatactttgtgtccaatacatgtgctatgggggatgactcctaggtataattagaagaaatattgagatgggaaaagtttaagctagaaaagggaagtcgaagtcgaaaacatagtgaaacaaaaggtagatgttttactgtggaggattgaaggagatgaagaaaccagaaggaagtttgtgcagactgctggactgtgcctgaggactggggcaagagctgcaaagctaccagtaacccagtactctctgccttatcttctctgcttctccttccttacatgcttcactgttctcaactgcagacaggcttcctttgctgctctctgcacaggggcattacccagcccctaggttacattgcctcagtgccagacatacataaacacacacacacacacacacacacacacacacacacacagagtcacacacacacttcaccaaagttctgggaatctcaacagaagcccaggggagagagctgttagtcaaattctataatgtacatacaccactgatctcattccctggccctgagacaccaggtcacatacaacctgtgcagctgcctgagctatctctgcagctgagaaggcacttctggagaagaaggtaatgctgtgactggatgcactcaaggacatttctcatctcagagttcaaggaaatggcatagaggaattatccaaagatactgtcctatggtcttgggactatggaaaccaggaggttgaaatcaacaactctaaaaccaaaacaaaaacaaaaacaaaaacaaagaaaagtcttagatgtttcactggacaaaatgcatttagcaggaaaaacaaaaacaaaacacaaaccctattattaggtagattatatttgtcattgcattctttgacatgatctgggtctggattgcagatgttgcagggggaattggattatagcatcactttctcaacacagctgttttcacttgaggtggatatgggcattacttggccaccatgacctatgttttcctttgaagcatgggagttgtctggtggagttgggtagtgttcattctcccacaaagctgttgacagctatcaatcttaggggcaacagagactctcagcttgggagtaaaggaaggagaaagaactagattattcttcctaactgctttttccttccccaagtaaaattttttttaaaaagtcattagataggctggggtggccttgattgaggccagactgcagagatgattagagcccttcaaagaaaaagattggcacaagcaaggtggccactgatcccagagctctcaataaaacaagcatgctccccggagctgcccagcttctctgggtgcattttaaggcaatatgtcttaaactttagtgcacaaattgaggttctaatttagtacatctgggggtgggtccagatactatattttcttttaaaattaacaaataataattgtacatattcatgggatacatagtgatgttttgatacaaataatatatgatggctgggctcattcctataatcccagcactttgggaggccaaggcaggaagatcactggagcccaggaatttgagactagcctaggcaacatggtgagatcttgtctctaccaaaacaaacaaacaaaaaattaaaaatcaaccaggcatggtggcaggtgcctgtggtcccagctacttgggatgctgaggcaggaggattgcttgagctcaggagggtgaggctgccatgtttgcaccactgcactccagcctgggtgacagagcaagactgtatcaaaaaacaaaacaaaacaagaaacaaataatgtatggtgataaataatgaaaagtgagaaatgataaacatttatcctttttgagtaattaacatatccattatcttaaatatttatcatttctttctgtcaggacggctcaatgtcctcctagctatttgaagctacacaacatattattgttaactatagtcattctacggtggcatagaacactggaactatgtggctgtaatttcgcattctttaacacatctctccctgtaagtttccaagtgattctgatactaatggtccatggaagtaatgaggctttaaggagcacaaattggtaacttgagaaagttagatttacaacatttgcgatccttccttccgtgtggaacagtccatagcaaagattgactccagtctgcaacaactgcactaccctcctttcacatatggcaggacttcatcacaatggtttctggttctactaagggcaataaagtcagcggattccttgtttcattagaagctctgcagtagaccatgaaacatgctcagggagagaagggggaagctgaaagagctgggaaagccagcagtccgttgcgagttgggccacaaaagaatagaggaattaacaatccccacagattataagaaaaatctggggagggatactaactagaaaagactgaaaacttctagtaaagtgaatggagcttgagaacattataatttgggaatattaatataaagaagctgataagtgctagacataatactagatataccaactaaatccacgacaaagcatctaattgaacctacgaggcagagcacgcctgcaaagtttccagggaatataaaatgattacttggacctaattacattaacgtgaaaaatgtcattgatattctctttattgaatagctaccactgttattttacagcagtgaacattaaaacaattattagagattcccaggttaattctcaatctatatgtccaatcttatttttcaattaaaatcttaatgttgtcaaccaagaattcttccaacagcttgctgttgagatatttgctatctgaagaactcaatcaaaaattttagactccactagagtgggtatcacaaaattgcagccaaacttaatcagatgagcaaagttttttgtttagcctatgtattttcataattcctgaattagaatgcctctaagcaggccatacacagtggaactgaccagttcccagtgcaggatggcaacgtagtgcatttatctgcctgaattctaaaggagataagttcacccctttcattagctcatcaatatatatatgagtaacatttttatatgcgtgtttagatgtggagttaactctgaatccttgaccaaatggagcttaaggtttagctagggacatgtgcaaaataactctaagacaaagtggagcgtacaagagatgcaaaaaccaaggcctttgagagcacagaggcaaaagcttcaggagagttttcaccaatgagctctctgaactgactactgaagaatggatggaatttaacaagcagaatggcctgtaagtgggacggtgaggagaggagaaatggagtgaagccacagatgtaaaaagtgcaaggcatcattgagaaaaagcaagaaactagaacgaagtgggcataagagggagtaacagggaaaaaagaagacacattttgttagagcaaaatgtcattccacagtagctctcctcagctccaagctccctctcttctctctgacagcaacacaggtatcaaaccccgacacggaggccgcttccctattattcctgtcctgatctctaccctcttcctaggcttgacagcttcctgatcatgaatattctcttgatcctggtcatgaggaagcagcctgcaacccctgtacaggaatcccatgaagcacccttcccagccacactcagcatcagccgccttcttctccctcctcgctgctgaggcttcgggctgtctgatctcacctctttcctaagctgtgccaggccatgccccagcacatcccaggccccaaaactggcactttcactgccccctggagtcagagcacagaggcttatcttattactcttccttgtgtcttgggtttctccagtcattgccaatcaaacccgcgggggttcctcattttggataatgattctttcctctctcagtctcctcattttaaaataaaacaccaacaacaaaaaaatgaaatccattgggctatgtcttttattctgcatgcctagttattcactaaaccctcacgctctttcctctctattccttcagcccttggatatcaggacctgggcacccaaacctgttcctgcaacagccttacccttgtcacagtgctattgcccttactgaatgccaatttatcccgagcactttcatcacaatatcctctgccaaacattttaaatgtctccatatttccccttttatcagaattagattctttggctagctttcacagaccctcataacctgacccaagttctctacagtttggtcactgtcgagttcggtgagcacagttggtggtgacagcggtcttgagcgagtatggctcttcctcatctttcaaacagctcaccactgctctgcagaaaccctttccttactccccatcagtcaggaaaaagaaatcactgatttttttcaccctcctaatttccatatacaaccttcataacattgttttttatacgtctttatttattttaatattgttttacttcgcatttgttcattcggtctttacaaactaacctagagcagggtcatgatttttggcgttttgttttactatcatttcaagtgtttcacatgataaatataccacaggcattttataagtagttactgaataatggattagagacagagtttcaatagtgaacagctggaatcagttttaaagagttatctaagaggtacaggagaaaacagaactgtgctccatgcagacttaccagagaagacgctaggtatcttggaaagaaagcttttgaccgtacgaataggaattccatttttttcatcttgcatccgtgctatgacgtcttccatctaaacaataataacataattaaaacctttataaagttgaacttttttgaaaaaaaatcagctctcataacaattttgtattcctgttttgcccaactaagaacaatgccgtattcttgcctttctagtttttgccacattaatagtttaaatactgttaaaaagagatggaggaaacagcaagaaaaacagccatgttagggcccattaagctaccaataggaattttgtgctttgaatattgcctttctcctgatttcatgtaccttggttataaaggttaagatcaaagagtgtttatttcacaaggttttagaaaccattgtcatagcacattcatgcttcattaatgttacctctactgaaatcagtgcaaaagcaagtagagccttaaaagcatctgcttgaattgcttcttcaagcaagagaatttccgtgattttgttttacaataaagttctaaaacctgcctagaaatccaggactgattgccaactactattacatctcttgcccgggtacttactgaagtgtgttatgaaacaaatacacacacatacacactctcatgcacatacactcatgcatgtgcacatacactccacacatgcacatgtacacacacacatatatgcacacaagtacacatacacgtgcatgtacacacacatgcacacacacacatatgtatacaataaaatgaatgtaacaccacagccttctgtccgtttactagattcccctttatctttgtttcaatctcattagtacactctcttttacttttacaaattgctggtaattctaaagggctgtgcttcacaaagtcaatgtggaatttagttttgaagaacattcattcattcaaatcatagccacagacattactcatgtgcttctaaacctgggagatgcagagacacacaaacatacccaagtggtagtatgggacttaaaatccattcatccatttactcattccacaaccacttatcactaactctacaccagacatatgactgggcaccgtggatatgaaaatgcatacaatacagttcctaccctcaaaaaattcagtcaatagtgacaaccaaggtgaaatctgagtaaagtatgtagtttagctaatagtgttgtactaatgttaatttcttgttttgataattatgccatggttatgtaagatattaacattaagggaagctgagtaaagagtgtatgggaattctgttatcttttctttttatctataagcctaaaattatttcaaagtaaacagttaaaaaaaacacagtctaaactttatattaatgaattatcaaatttccattggccgggcgcggtggctcacacctgtaatcccagcactttgggaggccgaggcgggcggatcatgaggtcaggagatcgagaccatcctggctaacacggtgaaaccccatctctactaaaaatacaaaaaattagccgggcgcggtggcaggcgcctgtagtcccaggtactcgggaggctgaggcaggagaatggagtgaacccaggaggcagagcttgcagtgagccgagatggcgccactgcactccagcctgggcaaaagagcaagactccatttcaaaaaaaaaaaaaaaaaaaaaaatttccatcaacatagctttagaatggttttcagctaagaaatctaatgttcttggtatcaacggatgtattactatgttgtaatcacactatgaacagatgtattactatgacaaataactggagatgtggaaagaatgggttttaatgaaacacaggtttgtatttgactcttagctcttgtaattattatctatgttctttgagtaagttaaataacctctctaagactcagttttctgatccataaaatggtgataataatacttgtaataatttcttcatagcgttcttcatgggattgcattgggcctagggtggggtaaagtattttaagggcaaatgatacaacatatataaagcctggtacatatatagaacaacaaatattagaccaaatgtccatgcacacccacgatatctggggatgcttattctccaccttcatgtttctttccatgtggaaggagcgccattaccctaatccccttgccttgtctctgccccctaatttactccaggggagctgagctgacttatcagacagaagagctgggaatgagaaactggcctgcagggcccactctttttctcttggctagaagcccacatctaactctgctgatgtagagatgcctgccctagtgggtaagcaagtctattcaggattgtgtttcaggattaacagtgacttgtgcacaaacattcttccataatacctttatcagcaatcagggtgatgttgtgacccctacgtgcctgtctttatggttatagttctcagttggctcagaaatcaagtataaaaagaacatgatgctgggcacggtggctcacgcctgtaatcccagcactttgggagaccaaggcaggcagatcacctgaggtcaagagttccagaccagcctggccaacatggcgcaaccctgtctctactaaaaatacaaaaattagctgggcatggtgacaggcgcctgtaatcccagctactcgggaggctgaggcaggagaatcacctgaaccccagaggcagagcttgcagtgagccgagatcataccactgccctccagcctgggagacagagtgagacttcacctcaaaaacaaaaaataaataaataaataaaaaagaaagaaaaaaaatgattttatcaggcctgtaaaagaccccaacaataaccaaataccaaataccccacttcttttgtaataaagatctgtaataaagatctctaagtatagaaacatgaaaatagacatactctgatgactttttattttgttactatttgttcatgactgacctgccacaatgttcagaaatgcagaataagctgctttgtcctgcctcatatcagcctctaaacccttgtattatctgcttaacggtttaaagcaggctggattagagggacatggaaacctctctgactcacactttcatctcagcacctagagatgtggcagcagtcacctctgcttcgggctgaatttaggtgcgtagctatgagtggcagtgttttctttgtatagtctcatcccctctcagttcatgggatcccaaaggagtgagaataggaggctggaaagtaaaagtgacttctgtggttgtattccaaaatattccatttttctgagtcatcatttccacaagagaaaaaaattttaactccaagtaaaaataggattggtgttctagactgaaaacgtgatcatgtacatgcattcagctgtttttatctttatccagacataatttatccgtgaaccttctcatggcctagaatgagacaaaaacaaacaaaagaaaacaacaacaacaaaatgaagaacaaagacacataaaaaaaacccctgctttctaaaaactaaaatcaattaaaaagaaaaagaaaattctagccctcaaatgactgaagggaccccctcttggctaacgggaccccagggaaaccctggaagctaagttcatggccatgatgggatggggggtgggacacacctcgttgtaccccttcctcactaaccactatcagcctttcttccctaaggggcaaacagaaactgacccttttgaaagactccacattgataatgttgattaatgacttatcttcccaggacagaacaaagctaaaatgagatcagtcattccttcactcctctctgggatgtctgctccctccattcccttttttttcaaatgttcaccttatcttatgtaaaaagtaaacttacagggcactaattaaagtctcgcaagtatgtaatcattcctctcactgttgcctcctcttttttaaggaaaatgtataaatactaaacctcctaagaacctctgggaaaaacagccaaacaggcatccataacttgtcctcaagctggctcaacaagcttcagtgattgagatttatgtctcaatcactcattttggttgtcacagtcaccaagtccacataaaaaaacacatgcatcttatctgttgatgttccctcgagcattcactcagagtctattaatttttatattaagcatgacttgaacatgcttgatggtctgttttcccactattagcaacagcaattggatgagaagaaaaatgctacaagcaagcaaaaaaaaaaaaacagagcaagttagttagacagtaagaggtatgagggatagtaaaaagcaactccaataaatatgaaaatatttggggcaatttagtctaaggccaaaagactcaggtacctcaagtatcccatatatatatgtatgtgtgtgtatatatatgtgtgtatatatatatacttacacacacgcatatatatgcatgtatacatgtgtatgcacacacatatatgcacatgcatatattcattaaaatgccattgagttgtgtgttttcacttccataagcctgtttctgagggtgaggaaactgggcatgggagaagagaacactagacgatgggcatgggcaggagagctggcatgccttgggtcaccgaggatttttctgaaggctattttctttactcttaagaagttcaaagtagatgatctgtaagacttctcctagctacaaaatgattgaagtctggaaataatcatcagcattcagaaggaggtaagtttccacactaggtcaaagagccaattccctgttacagacaaatagatgaagctattaaattaaataaaaccaggccaggctcggtggctcacgccagtaatctcagcactttgggaggccaacacaggaggatgacttgagctcaggagtttgagaccagcttgggcaacatggcaaaactctatctcttaaaaaaaaatatgaaaatgaactgggcatggtggcaagcacctgtgatcccagctacccaggaggctgaagtgagaggatctcttgagcctggaaggtcaaggctgcagtgagctgtggtcctgccactgcactccagcttgcgctacagaatgagactctgtctcaaaaataaataaaataaaataatcaaacaagaccttatacaaatgtatttgcttccaattgtcagcacattttagtttcaatgcaagacgtagttattaaaagcatgcatttaggccggttagacctgagtttgaatcctgactgtactacttacaagccatctgaacaggtgagttaatttaacactcaaagattcggttatctcatctgtaaaatggagataatcataaattgtatacatcttatcaagggtgagaattagtgaaacaatgctaattaaatgcttactatgatgccaccaccaacaccatcatcatcatcatcatcaacataattttcttccttcatcgttgtactaggaagatacggatcctttttcttttataattcagccggcaaagatgctgtagttaagtgcaaatatttgttagacgcaataaattgtcaagcaataagtagtcagagatgcctatacataagctctgtctttgatttcctgtaaaaaactgagttcatgttggcccctgcaagacaggagatttgatttgaagaaatgtcaggggaaatatttgtgcatataagcaaaggctatgtaagctatgaaaaaaatcatatttagaaagggaaatgagatggcattcacttttaacaaaatgaaaacgtctttgctgtcatcttttcttgacaaatttgcctcttgaagttatttagattaaaaattaaattaaattgagtgctgtttgcaagacttaattttttaatgcaaactgattcactatgcgtgataaaagtaaaagttaaacaagtgtattttacaaagtaattttgagaatatgtattgctgaactcattcaaaactttttatgcttctgttacagaaccctccatatttcattaactagtaaaactatctgttttcccttagatgtaaacttctggaggaaaaaattcttaccttactcatctttgcattgttaatatataaagtgtctggtccataatggaggctcactttaaaaagagaagaggggattgatgtatttttgtttaaggcatatgtttgcattttctgagagcctcaaaacaaaagtggaagttaatttaagatttggtcttgagatgtttgatatgtttttttctttgtatgtaacttttgtgaaaaatacattatcagcatcagaaatagtgacacagagtagctcagcgtagggcaggttaaaacactcttatccctcttattttttctgctctatctaatgcagatactccagcttacttgttagaggaatttcttcctttatgctctatctaatgcagagatacttcagcttacttgttagaggaatttcttcctttaatgcaagagagtaaatcagtggctgttgatgaggctgtcttcttgcttgtagatgtgacactcaagttcattgccatgtgtaagccctcaagatgaaaggcactattgaacttcaacaccctgctcttttctcaggaattcataattagcatttcctttggaatagtttagatgtcacttcaagcttgtgatgtatttcaaaaaggctcaggttaaacagttcccgcccgaacacttggcggaatgaaagaaggagcatattacacaggtccatcttctttgaagagagttactaattattcaagaggggctgccagacagggctcccacatattgatgaaaacaaaatcactgccttgaaacctttccagttctctaatgttctaaacaattatgggagtttaattaaattaacttgtagctatatttgccggaactttaccacaatatcattattattgatttcattaagccaatcgctttacagagacaccatgactgtaggcaaaacatttgttatgaagtaaagctaaaacgttttgtactctgtaattctgaaaaagaaatgaatcaatcaaaatttcagaagaagttttccaactctgccttacaaccaccattaagcacaggcatttggagatataaatgggagactaagtgggcagattgaatggcttttttctatgtgcacatactttcaaattatggtgtgtactgtcattttaagtgctagctatgaaaatgggagaaatgatcactgaagcgcttcttggatttcttgggcagttaggtggtggcaggttttcataatttaaattcgcctataactctttttacttcagaaagcctttcgaatgcagaaaatcatttacacttctgaattcatcagtgaaaacagagaaagtagagtcagtctctaatgaaagttaaattaagaataatgagattaaaatttgcaagacaaactgttttctgctgtaataattcaattaaagctgcttctaattgatatgatttttccccatgttatagtttattgcagtcagtatcttaactcagaattaattactcttttcatattaaaaaactgccattttcatgaataatcgactaaaaatagaaactagtaaaatcttattgcatgtaaatctgtcctagtttaacttaaatatagatttatttatttaaaaaacagtaactcagtgaggcatggtggctcatgcctataatcccagcacttgggaagccgaggccaacggatcacctgaggtccggagtttgagaccagcctggccaacatggcgaaattctgtctctactaaaaatacaaaaaaattagtcatgtgtggtggcaggtgcctgtagtcccagctaatcaggagtctgaggcaggagaatcccttgaacctgggaggcggaggttgcagtgagccgagatcgcgcaactgaactccagcctgggtgacagagcgagactccgtctccaaaaaaaaaaaaaaaaaaaaaaaccaacaccaccaccacacacacacacacacacacacacacacacgataacataactcatttgaaagcttagaagcttagaaacttagaaattttatccttttgtgattttgcagaaataaagtagaggttttttttctaatttatagacgtttctgcttttttttttttaaataaatcatttctctcattcatctcaaggaatataacctccactgaaaataaataaacagataaataaacaattatgctcactgtgtttgttgggattacttgggttgacagaatcccaaattcaattgtcatgaacaaagaaatgtgttgtaagtactgtgggatgtcttctggaactcgaagacgggcacataagtgggtctcataagcagcccgcctttagggcatgcttactgccccctccactctgctccttgtggtgagcccactttttcttctcggcctagagtcctctcttagttcttcaatgcacagaacagcaaaaatggctgcccttactgcttgagttttacagtttgtgaaattaaataattccaatttaaagctgttggaactttaaattatttgagctttgagaaaaatgtgactatatggcctgagcacatagcatgcagctgcaattcctgcttctccgattacagattacagtatgttactcttgtgctgtggatgattaggaaaggctgaaaggtgccataaataagagtctattactcctccttataaaatgtcgaatcagtcttccttggaatgtagtaaactataactaatcaaactcctgtaacataatctaagaattggtcttgcatgaaaaatgttgcaactctgttaacatttctgtctctacctatataagtgaaaccttacctccacacttggatgcactaaccccattcttttggagtctgtgttacccaggtggtgacagcctcaaacgttgtgctcaaataaattctacacttaatcatattttctgaatctcattatttaatgctgacaagtttatatgaacccaaggagaaattccttctctaatttccatacctgaattttggggcaaaaactttgatttataacactggaggtggagttggaaggggtgctgggcagagaaactaaaggcattcgttatcaccttattcaatataaaaacccattgaacgatacatggataaagttatatagcagaaaaaagtgtaagaaaagcagtctcaaaaaaataagagtgggtggttgctgaataatgagaaagagcccaagggccaggtgcggtggctcacacctgtaatcccagcactttgggatgccgaggcgggtggatcacaaggtcaggagtttgagaccaacatggtgaaagcttggccaacatggtgaaagccggtctctactaaaaatacaaaaagtagctgggcgtagtgacgcgcgcctgtaatcccagctatcgggaggctgaggcagaagaatcgcttgaacccgggaggcagaggctgcagtgagccgagaacacaccactgcactccagccagggcgacagagcgagactccgtctcaaaaaaaaaaaaaaaaaaaagcgccaaagaaagacaaaaattgatgcagaaaagaacgttggacagacaagtcaaacaactgaatgagatttcacagctatgaaagacagaaagacggaagtagcatgaccaaataggccaagtggttaattacattgcactcttcggcatggtaagtatttgccccgaggtagaaaataccaacgatgctaaatgtatgtgaaagagtaacttaggtttccagatttcttttttgttcctaggaggtatcacttctttaactctcaaaaggagcctcgtggctaatttttattgcagtcaaagttcaaataggagagttgtcaatgtcccctgaactatttgggaaagacttcatgggaaaagtaagattaagctgatcctagagggtaggcaggatagagagctataaaggaaaggaggaggcagagcacacgaatactttaatcaattgcttcatcttcggcgtcaagatgggaatgagtaagactcctgcacagaataatgaattctgtcagaatccttctccttctgcctctccaacttgacaattttaacctttctggaaggtgtctctgtagtcattttcaaacacaattccacctttgctatcaacttagttcacatactgcctgcttgaaattctctcttatacgaactccttacctcctgatcccacttgagctcacatcagttcgctcaagtagcaaaccccagaattaacctgggaacaagtttaaatatttcatctcttgtttaaaacttccattggcctgacaaccccatgaattttctgtaagcgaaatgaccacccaaatttatccacgatatgacgcccaactgtcattctagcgttataacttgcttcccacatgctcagcaattgctcctgcctgcctcaccttctcacatacacttcctcatgccagctgcgcccttcccttttccatctgtgcctgtggaaattcagctatacttctaggatcattccaaattgtaatttcctactgacgtccgtctttatccctccccctacctctctcatcccaacagaatatgatcatattctctgttaaactacttgagatctttatttttagtttaaattttttttaccctaccttactttacatgacttacatgtaagttatttattaacataaatatcattctctttagattataaaagctttggtaatttgcattagttttgctatctgtggcatggtccatgaggaattatcaccccccattttttactttacatacttctttgctgtgtttgtatgttcaccaacaggacgtattacttttataattaatattattttctatttgaaataattaagaattctggccgggcgcagtggctcacacctgtaattccagcactttgggaggctgaggcaggtggatcgccttagttcaggaatttgagaccagcctgacgaacatggtgaaaccgtctctctactaaaaatacaaaaattagccgggcttagtgttgggtgcctgtaatcccagctactcaggaggctgaggcaggagaatcgcttgaacccaggaggcagaggttgcagtgagccgagattatgccactgcactccagtctgggcaacaagagctaaactccatctcaaaaaaataataataataataattaagaattcccactttaatagtattaaaatattaaacgttaagttctttattcaaatgtctgttgtaacacatttgagggttaaatatcgccaactgctctttacaatatactctctgtaaacattctgtataattgctattgactttcaacaactaaactagtctacctccaaattatctctttttacaaccttttaaattcagagttaatgaacgaaattgtttacattcccttttttcttagtcacatctccaataaccctggaagtccgaatcaatagtcttatcatcggccccctttcagatggagagaccacagttcctgacagatgaaaggcttctcttgggactttttttaattgacgcaggtgcttgatttcagacaagcccttctattctagcttctggaatcaacttgaaattcagcaacctctatgtgtaacaaaaatggacgaatcattcctctaaaaaataaatgaacaatgatatttagcaaacaaaatacctaaagacaaccattgatttggatgagtgaaaaaggcagagaatgcagaagatgcctgggatttagctaatctctgagattccggcaggaaggacataaaaaaagtcaaagggctcttggctgagtttgccattttattttattatttcatttttattttattttattttattttattttattattgagacagggtctcactcactctttttttttttttgagacagagtctcactctattgcccaggctggagtatgatggtgcgatcttggctcactgcagcctccacctcccaggttcaagtgattctcctgtctcagcctctcaaatagcttacaagtgcccgccatcatgcccagctaatttttgtatttttagtagagatggggtttcaccatgttatccaggctggtctcaaattcctgacctcaagtgatccacccgccccagcctcccaaagctctgggattatgggagtgagccaccgtgcttggccaagcttgccattttaaaacattcttactaaaggaaaggggtctcacaatacctccacggagtataatagatttaaaatagctttggaacataagaattactctaatgtttcaattctttgatttaaatcccagcttctctttgtagccatttatgtctttgttgtttataaattcatacaaatatttcggaagccacttaagtttcccacctccttgggtaataaattctgtatgtaaattatctgctagttgaattcatatctagttcctattatttaattcttgcctcattcaagctcaaaagaagccccaccattttacagtatgagaatttagtgactaacaccttgtttatcctattcatggtattcgtacatccataaatgttgatccacactatctcctcctccttttcgtgagcaacagacccagtcattctcatagttctgtatggagcacatccttctacaattgtctgccccgcttgatatttgtgagggaaacctggccgaggccagataccatggttcatgtaatctcagtgctttggaaagctgagggagaaggattgcttgaggccaggagtttgagaccagcctggacaacatagcaagaccccccctctctacaagtaaaaaaaaaaatgaaaagacaagtgtaaaaacaatccagtctattgatggccactgggcatcacagactcgtttccagatattctccctccaacaccttcacacaactccaggactgatggtgggaagaacagccttatgcatgcttacttccatcctaatcctacactgcaaaccaggaaataagactgaatgtgcactgtggactaaaagcatctctgttattcccataaactgactgaaaacaataaatgtacccattgttgaaaataaggctctgtcatcatgtgttcagtgacgcagagcctagaacatttcagagtatcatgtaggtgattcttctctcaattctttcaaggctggtacaggactagtggcattccaaacacataggagagaagtttatttattacacacaatagatgcctcaggtcattcgagcttaatattcttatgaaacctgggcaggacctgtcagagtatgaaatgctccatctgaagccacaagagaaagcactactctgcttccactgagatgaaacatgaggactttggattaagtgtaggcagaagggctaaaaatatatatttttaatgatgtgatatcaagaaatgttacttaagtaatttatttttatggtaacatacttataaaatgcagcccagagatgtctctgggatggtcttagtagagttcttccaagagtaattaaagggatgacctcacagccatcaccaccgtatatatgatagtgctttgcctgggtccatccagctggcttagtccatgaaacaataccatgtttctaactaccattttcaaaatgaaattaaaaagggattataacctgaaggtagggcaaaagcactttaaaaggacaaaagcatcctcatgccaatgaagaagatttatttcaggtgtacacactaaaactaaatataagtatggtgatttatttgtcttaggtgtttcatggttttcaaagttttaaagtggtttctgcagctgctgaatctgacctttttctctgtgtaacactcttggtttacttattttgtacaacgatttttaaatttccagttcctagaattcttttaagatcaatgagtaaactgtagaagggcaaaaggaaaagatttctactttaattgtacccttgctagtgttgccgattcaaggcactacaacgttaagatggattttatttttcagaagtatttgaacagtgatgtcgatctttctaacccaccgaacaattagttttaaagcagagaaaattcaatgtgacttttctgacttgccttttatatggggatttggaaaaaacacctccttctggctagtccatctatgaaagaaggttctgcacaggacctagtttcaactactccttcattccacactgttctcaagagagaaattaggatgaatggtggacgaattcatacaaaatcccaaggcaaagtaggtccaagccttggcacacaaacatataacttctagtccaataactggctcttttatatccaccacaattttgttttccccacgagtgccaagaaaatcagaatgtctagttgccttcttcctgacaacgattctcaatgatcctatgaagaaatgaataaaaaataaaaaggtacctcacttattactagatatctgtgactattatcttatggctagaacacgaacatcagaaggtcatggcagtgatgttgaattatttaaaactatttccccatttggtaattgttaaagtcatagagacacctaggtagtttgaaatgccctccattgaaagccagcaatttctatgtgtctccaccagccaagaggaccctgtagagctttactttctatagctggaataatgaaaaacaataggttttttattgttttaaagaaaaaattaaaatactgactatatttttaaaactgcacctgctcccttaacgttttgatactcgcatggataaacaactttgataacctctggtgtaaagaacgtggcctttgttgcttagcagagccatgtgcaaatctcaggtccgtcatttgatgaatgatgttaggaaaataatttagcctctctgggctaggtctttgtactccttccctataaaatgagaatgctacttccttgataaaacatgtactttacagcataagttccccttccttctttctgtgcaaactctgagatgacgctatttctaagagtgcaacacttggaaatgaggtgtcttcttttctctggagctattaagactttctttattccctacttatgacacactctgtattacattatagtcatatgtgtacatgtcttatttcttttgttctcttttactgaaagtttcttcaggataaatattagtttaattacactggtttaatcactgtatcctgaatagtatcttttgggaaactgagtatacagagacaatggctagaccacatatgagcacagaattctgacccacagcccctgcaaccagcctgggaagccaaaccacaagctcagcagtagtaagtccaaaatggtcaagactcaggcaatgacaaccagcttccctaatttttgcctctgcctataactctggacaaaccagagaaagctagacactcctcaatctagttatattagatacccactttcagcttccccatgcaacaacctccagtcagagctcgctctttctctctctctctctttctctctctttttattataaagctttcccactcctctgcctgcctttgagtctttgccagacacaagtggtggtggacgattaccttgctacagcaagtgctgaatacatagcctttctttgttttcattttggtgaccttcatttacttccacattaaaaaaaaaattcatgtacatctcactgcattcccaagaagaatctggggtaaatccttgtccagaattatgtcttttatagaagcaaagtctccttccagttctaatattctgtgactaatagatgttgaggtcgaataaaatgctgatttgttgaacaacttttcagaaatagattattcctgtgtataagaattgtcaaaataagtaattcaaaatctaaactgttgaaactttcccttattttgagccctaaaagaatatgattatggggcctgagtcatgtgacaggcagctgtaacctaggcagctgtaacctttgtttttgtgattatagattagccttcttcctatattgttttgtaaaatgttgcaaatgactgaagggcaccagggaagaccctttccctctacgctgctgatcttcattacagattgactttcttctttcctttctcacacaaggactttacttgactatcacattgtctaagatggaatgccaaacatacttttaaattggaaaggaaatgaaaacaagctttacagaaaagaaaacaaactgtaaccaatcattacattgctgtaacccataaaccagccttgtatagaaaatgctgtaatcctgttaaatttgttttctgcttacataagcaagaccttaactttttacttctgagcactgaccccatttctctggagtctattttctgatggccattcccacctttgcactggaataaactctttaaaactagatctgatccttgcagttatttcaggttgacagaatggttcatgctgaacctccgaattaagttgttggtttaaatttttatgcaagttctaaaagaccaaattaacctcccaccacatcatacccagcaatattatactgcccagttaagagccatgggtataaaattacatgatttctttcaggaggcatttatccttctactaaatatcagttcattttttcaaaaatccactcgtccagctttgtgggaactgaacactaagaattctcaataggggaagaaacaattgtctcccccattgtatgtgtattgatttgtaacataacgtggggcgaatggtttgagcctggcttctccttctcttcttgccaaccctggtcccttgttttgggatccgtttcccttggagaatataaacattctttatcccacttcttgaaaggccatccttgtctttctagttgatgttaggaatgaactgacatggacgacaatgactatgacctatgtaggaaatctgtgaactgagtaagtagtcatatgaaaccaaatcttatgtgacctattgatatggtttagatttgtgtccccactcaaatctcatgtcgaactggaggaggggcctggtgggaggtgattggatcatgggaagggatttcccccttgctgttcttatgttaatgagtgagttgtcgcaatatctcatggattaaaagtgtgtggcacttcctccaacactctcgctctctcttgccaccacgtgtgcttcctctttgccttctgccatgactgtaactttcctgaggcctcccagtcatacttcctgttaagcctgtggaactgtgagtcaactaaatctcttttcttcataaattacccagtcgcaggtagttctttatagcagtatgagaatggactaatacacctatatttacactactctaaaacttgcattatacatgtaattttagaaatttttattgtggaaaatcttaaacagatacaaaaataaatagaatacagtgagccacaggtactcatcacccacctgtaaaaatcttcagtttattatgccaatttatgttttaaaaggaataccaactctctctatgaaaagtatgacttaggaaaaggtaccgtatataggtttttctattagtgtgaatttcccatgcataaagtggttgctctctcctagcaggctctggctgctggcttcccggcctcccttaatgctgtggatacctgtgacacaagacctggctttccttaatgcctatctaacttctttatttcctataagactccaaacttatgaaaaaaagagggtgacagacaacagttcatatactaataaagtaaaatttgacctctatttttatatacattctgtaaattttttttagttgacatataataattgtacatagtcatggggtacatagtgatgtttcaatacatgtaatgtatagtgatcagggtaattagcatatccatcatctaaaacatttgtcagtttttttgtgttggaaatgttcagtatcctccttccagctatttgaaattatatgatatatgttattgttaactatagtcatctgacagtggtatagaacactgtaacttatttcttctaatacacattatttaatttactcctaaccaccatgtaatatagataatgcaatcatgttaatcattcctttttagagataagagagctagggttctgagaattaaaccgatagatgtaaggttacacagttggtaagaagggggccctctacgaggtagtatatgggggcacatttgcaaagcattacaatggaagattatatttcaaaaaaaacacggcaaaaatgcatgtcagctttcttttcaaataaaatataaatgtccttgaacacagtccactctcaggggaaatttgaggaaaagacatatcatactgactatattccatttgattgcacacagtgatacaatcctttacatttcaaccaagacattgaaatgctcctacttcaagttctgattgttcacatgcattctctgggaactgctgcctggatgtacaggattttttaaactatgcagaacctacatcattcattctatatggcagttgttgaaataaacgtttagtgattctaaatacctcactaaagtagctagtacttattgtgaatctaccatgtagaagtgctgaatgcctgttgtggattgtggatggtgacaggaaaggaggtaagaaatgacttcctctgggagggatctttgatttgtgctttgaacactgagtgcaaatcagataaactgagtggagggacttaagcagaactgcagcaatgagaaaactcctggttaatttgacaggaaaagattgtttgcagagcggtatctgtgggataaagtggaagagtgtaatgtacaggcttgagtggaaatagaacatggataacaaagaagaaacaaccctaggaaaaagtaaagctgcaatatatttcttatcggattaatctaagatcagtgtggagaagccaacagagacataaaggacctcgtgtaagaaatcagacaatggcactggggacaatagccggtaatgcagagaatcaagcaagataagcatgaagtcagaatccaggcataggctggactaacacaatccttacctgcaaaatctgtaaaacttttgatagcaatctgcactaaaataaacatttttcatcatgacccagcacatacatgtgtattccaacatacatagatttaattgaaacaaaagttttacaaaacaatagctattctttctatggtagtgaagcctactatttttattctattccactgaataaaaattaaaatagattttacaaccttcttaaatgtttttacaacccacaactggaacatgattcaaccagcagttcataagagactattgggtacattccatgaggaaataaacatacgcaagaagtttccatccttaaacaagtttccacccaattaaacaattaaacaaaccaaccaatcacagtcctcctctggcaaccatcttatctcattttatttaatgccaaacctcttgccttccgcaaagagctgtctaacctcatagttttaaaactttttcgtctcaggacaactttacacttttaaaaattattgagaatcccaaagagattttttttaaaaaatcaaataggctgtacctattaatatttaccaattttgactaaaaacaaaactatcatttgaccctgcaatcctactactgggtatttacccaaggaaatcattttataatataaaaaagacacttgcactcataggttcatcacagcactatttacaatagcaaagtcatggaactaacttaaatgttcatcaacagttgacagaataaagaaaacatggtatataaacaccatggaatactacacagtcttaaaaaagaatgaaattatgtccttcccagcaacatggaggagagggggccattatcctaagtgaactaacttagaaacagaaaaccaaataccttttgttctcacttataagtgagagcacaacaatgggtacacatagacataaagatgaaaatataatagatactgaggactccaaaaggaggcaaggaggctgagggttgaaaaattaccagttgaatacaataatcactctttgagccacgggtatactagaagcctactttcatcagtatgcaatatacccatttaacaaacatgcacatgctcccctgctcacccaaaatgtaaaataaaataaaacaaaacaattaaaaattaaaaatttaccagctatgaaataaaaaattaaaataatcagtaaaaatatatattaattacttcattaaaatgataataataagtacattacatggtaacatgaatatctatcacaactaactatatttctcaaaacatatttggtaagaggaatgacgttattttacagttttgcaagtctcttccatgtttggcttggaagacagctggattttcacatctatttctgcattcaatcagttgcaatatgttgttttagttgaagaaaatccatccttgcacagaaaatgctttgaataggaagggatttttagtagccttatcaaacaatgaatgatactcttctctgctactataccaaaactccacaggtagtagtcagtgattacctgagatgtagaatctgaaacttttaacaatgaacttttcatactcctactgtactaaaattcattctcctattttggactttgaatggatctttttacccaggaatggcatgtactgatgacttggaaaatactgatgcactgagttatgcagatctcttaaatgctgacacaattcatcatacaatatccaaaatgacatttgttaatatcaccactgatacaatgagaaaagccttttactattggaaagctcccaggctcatcgtgacaatcacaagttttccaaaattataactttcactcacaagtttgttattggcaactaatactgtcagttgttttccttgaaatgacggtcttatttttttccattaaaaaaaggtgtgccaaatattcatgtctgaaacagcagagcttgtctttcagttattctttcaagtaacaatgactagctcagtttgcaactcaaataatagcacatcacacttttgtatgcagcgccttgatctcttcaaagccatcttccacactgtggtccgagtggcgtgttgtaagtaaatctcctcatttttctctcttattgaaaatacattggttttctcttttgactttaggataaagctcaaagtacttggcatattatgaggccctgcccatcctcaatgcaatccccatccttcccacactggagtttttaatcattttcccaggtgagccatcctcaggcctctaaggcattgcctgcctacctggttaaaatgggcttaccttccaagattctgctcaagttcaggggctttgagaagccttttctcatacaccttgctctctacataccactatcatcataggtctacttatcaattaatgttgtatttgtaattttttttgttttgttttagagacagggtcttgctctgttgcccaggctggagtgcagtggcactatcacagttcactaccgcctggaactccagggttcaagcaatcttcacgcctcagcctctcaagtagctgggactacagatctgcaccaccacgcctggctaatttttatctgttgtagagatggagtcttgctatgttgcccaagctggtctcgaactcctggactcaggtggtccacctgtctcatcttcccaaagtgtgggaattacaggcatgagccaccgcgcctggcctaaactgtgaaattcttacagggggaaattttgtactgtacagagatctttttaccagtacacatatgtgtccaaaatgatctcaggcctagaaaagccacggcctctagatagagaggaaaatagggaaactagctgacaagtaaagggtcactcctgatagcacagcagcaggctatggagtttggtgtccacagtttaagaaatggaggatagagggtttagagtggaggtgcacgagtgaggtgcattttaaataggttaagtaagcctgcttcacactacaatttgaactttggagaaagactcaaggcgaggacaccgtacctatatttagaccccagaagaaagctttgctccaggtctaacaggttatctctccatgagatagcctccacttctctctggattatgatctcacttactccttactccattactccccttgcctgggctcctgactctgaagattgcttcacagatttcaacagtaaatagatgatatcaggaaaaagaattcagaggccaaattgtaaaatattgggtgaaaaaaagtactggacagatgtcaaaaacctttcagagattttacttttctaacttgctccaaatatctctaaaaaggaattatggtttgcagtgcttccaaaagagcatagctgcagaaccttgttttgcaggagaatttcaagggctaaggtttagtgcaatacacctgggagagaccttgaggtatgtatgcatctaggttgagcgatgaaaggacaacaaaaggaaaagaaacaaaaacaaagtctctaaagagcagcaacaataaaatcatcacttgaaaacttgtttgaatatgtatgttataattgatgcagcctcacataaaaggtgacaagctatggttccaggataatatgtctgggagtgagggtggatgacagagagggttgtttggaagcttataggagaatatactgctctaaatttcttatcatgataaacttggaactttgaagtttagagaagaaagagtttatatatatgctagtctatccacctgtgttgcaattgttctttttttttttttttttttttttttgagacagggtttcactctggtacccagtctagagtacagtggcaagaccatggcttactgcagcctcaacctcctagctcaagcagattctcctccctagtagctgggacctcaggtgcgtgataccacacctggctaacttttaaattttttgtagagatgaggtctttgctgtgcaggctggtttcaaattcccgagcttacgcatttctcccgtcttagcctcccaaaatgctgggattacaggcatgagccactgtgcccaggcttaattctttttctgaaggtaattattaagttcttttccaagactgctttattacttttttgaaaaatcacttatacattgcttttgttatgcaaatgcagctgctatcttcagtgacattgttcagtaagttcacgcaaaagtaattcaacccttggcacttcattcatcctgttggcaagctgaaggagtagagagtgaaaaattaaatgaatatgtgatctgtagttagtacctataccttctatttagcattctcgttactctccccaatctggatgcctagtgtgtaccacagataccacagggttatgtcctgataaactcatcataagttgaaaatattgtaagtaaaaatgcatttaatacacctaactgtctgggcatggtgtctgatgcctgtaatcccagaactttgggatgctcaagctggtggatcacctgagatcaggggtttgagaccagcttgactaacatggtgaaaccccatctctactaaatataaaaaattagccaggcacggtggtgcatgcctgtaaccctagctacttgggaggctgacgcaggagaatcacttgaaccccgagaggcagagattgcagtgagctgagatcgcgccattgcactccagcctggccagcaagagagaaactccatcacaaaaagaaaaaaaaaaaaaaaacacctaacctaccgaacatcatagcttagtctagtcttaccttaactgtgctcagagcacttacattggcctacagtttgacaaaagaatctaagacaaagcctattttataataaagtgttgaatgtcccacttgatttgttgactcctatgctgaaagtgaaaaacacagtgatcatatgggtagtcaaaatacggtttctactgaatgtgtatctctttcacaccacggtatagttgaaaaatcctaagtcgaaccacattaagttggggaccatctgtaaacataggtgcttgataagtgattgtcagacacatgaataaatgagggaaatttcctgctcttgtgcaatcacagagacctctggaattcaacatagctactctcacaagtgctcaggaaccctagaggacatcaacaggggtggtgtcaatcagggctttttgatgacttgccccagagcctgccctgctgcagaccccaggtccttagcctcagcaacacccttggctctgaggacttcagtgtggctggaccagcagctccctctttttcatcactcattcattatttaatcagcctatctacctcaccaaggcctccccaacccagctgctcctttctgtccataaaataactgccttagttcaggcagttatggctgggtgaagcagagacaatgccactattcccaccattctaattatgacccacatcctggcaagtggattctccctaagatacaatcactcaaaggctcaggggcaagaaaagagaacatgggccggacacggtggctcacgcctgtaatcccagcactttgggatgccaaggcgggtggatcacctgaggtcgggagtttgagaccagcctgaccaacatggagaaaccccgtctctactaaaaatacaaaaattagccagctgtggtggcacatgcctgtaatcacagctactcgggaggctgaaggaggagaatcacttgaacccgggaggcggaggtggtggtgagctgagattgcaccattgcactccagcctgagcaacgagagtgaaactccatttcaaaaaaagaaaagaaaagagaacatggctttaggttttggtatcaaataagcccagaataatgctcaacccagaatgatgcagacctatgtcctagtcatggtagcatgggactgggtatccccgccatgctgtccaccctcaccttagaagagggcctgcccctggagaagcaggagaatgtgttccctttggcgaaagtttgaccaaaagaggaagaaaaatgaaccaaacatactcagatatttttctgaaagttactgatgaaatgaatcactccaatttcttaggtcaagcattaataaaggggtggggaaaagccagggatgtgcttagagagtatccctcttaagaagaaccaggatgggcatggtagctcaagcctctaattccagctctttgggaggccgaggcgggaggactgcttgagaccaggagttcaagatcagcctgggcaacattagtgagacctcgtctctagaaaaaaaaaaaaaattagccagacatagtgctgcacgcctatagtcccagctacctgggaggctaaagtgggaggatcgcttgagcccaggaggttgaggctgcagtgaactccattgcaccactgcactccagcctgggtgacagagagagaccctgtctctttgaaaaaaataaaaaagaaagaaaacaagaaccagaaaatgcatttttgttttcttctatcaagctttataaaagcattggtcaacagatggaagagtggttttgaggatagccctattccctcttaaggctgggatagagggttagggatggcattcaaaggaaaacgtctacctttagtacaaggcggttctattaaaactgtggaggcattagatggaagccagcagtaatgctttagaaccattctgggcttcctgcagagtggtgtctgctgggacctgaatcgtggcaggagatgcccagtgcacggggcccatttggtcaccagcagaaacaggaagggccccctgggagctgagccaattgtgtggacatgtgagacatatctcgggacctcccaggagagctatggaagtagtgataggacactgtaggcgctgcaggtaggcagaggcaaaagccagcgaacttgttactcatcaatggattctctctgtactaactgctgaggcctgaagaaacttggttatatacagaagtgtgaggcctcccttggagactaaagcatttgctccctcccaagacattaggcagaaaatactacttgggatggcaggttgttttgcacggtcatgcccttttacttcatgagctataatctagatgtcagctggggactctgtgtcctcatggtatatgtaggattgctttgaccctcccattggacagtgtgaagaagtcttaagccaactggagatttgtggtcattcttttcatggcttagctctatccacacaggcggtcattttctgggcctgcaccatgcagagtccaaactcagttcttccaccagtctccataacaatgctactcgctctaagcattttatgaggtttcctagaattcatgtaatatttaaggggataacaatgagagggctatatctcactgcacagtattccaatttctctaggtctttgaccctttttcctccaatcatctagatacccgacatgcacaaagacatggacacacacacacacacacacacacacacgctgaattcatcctccctttgatccacagaaaaccaagggttcctcctctgctctcccacagaacagcatccctcccactcagctttcagcttctatcctaaatatgctctgcaaggaatttgcccaacaaaggcacttctctagttagaaaaaaattatcatgccagttgctaaaacaaaaaaaacactctctttttctaaactaatttagatgcatagtaggtgcttagaaaataataagtgtgtaaatatttattactctaagtaaggtcctcttcagggtgaccctgtacagaagcagcctggggctgagatactccctatctaatttataaaggatcagggcaggcatacattaaatccttttttctacctcgatcttatttcctcttaggaactgaaagtgctttcagacattatttcagtaatccttgcagcttcccccaatgagaggaaaaaatgcccttatctccagtgcgcagatggagcccagagagatggaagttaagtgactcccaaggttgcccacagggagcacagagaagaagctaagctgcgacctggagtcttggtgaccccgttctagagttagaagataacgttgccttacaaagagttttcaaatgtggcagcttttgctctttgaaatgggaataattgaggtttcccatttatatttatttatttatttattattattattattattttgaggcagagtttcgctcttgttgccaggctggagtgcagtggtgcaatctcggctcaatgcaacctccgcctcccgggttcaaggaattctcctgcctcagcctcctgagtagctgggattacaggcatgcgcaaccacacccggctaattttgtatttttagtagagatggggtttctccatgttggttaggctggtctcgaactcccgacctcaggtgatccgcccgccttggcctcccaaagtgctgggattacaggtacaagccacagtgcctggccccatttatattttttgctctgtaatggggcatgggagttcatgcaacgggctctagatcaagcctgcttgggtcaaatgcgcagctctgctactctctagttactgaccttgggaaagttactcagcattttgttgcctcagcttcagcatctgaaaaacagatgtgctaaatacaacaatatccttctcacggagttattatgaggatcaaatgagtttacccctcctacctccagccccccatacacccactagagaggttaggaaagtgcccggtacagagaaatgctacataaatgttagctataattatttctccttttcgaattgtgcattctttatttagcaaccttaagttgattttttttttttttggtctaggtgacagcattgcctaactatagaaaccaaccttgtagagtcctaggcatataattaaacctaatatatcaccatactattgttcacttctttctttccttccttccttcattccagaaacactttccaagtgcccactatgtgaaaggtacggtattagattaggtacagtagtaaaggtaatttagaagataaatttggccttagcatcttatggtctaaggagaatatgcacataaacatttaaatttcaactcaatgtcaaggtaatatcatagagagaatccagaagaagcaacatctaattctgcttgatactatcaggaaagccttacctgaggaggtaactgagtcttgaagtagaaataggagttattctgacaaataaaaaatccttgaaatgtttgggcaatttgttcagaatacatattttttaagctcacatacaacaatataaaaagtaaccatatattagtgataaagcacgtctcaacacattttaaggattgaagtcatacagaaagcacaattctatgaagctaagaataaattactaaatccgtcaataatccctactcgacagccatcattctcagcaaactatcgcaaggacaaaaaaccaaacaccgcatgttctcactcataggtgggaatcgaacaatgagaacacatggacacaggaaggggaacatcacacaccggggactgttgtggcgtggggggagcggggagggatagcgttaggagatatacctaatgctaaatgacgagttaatgggtgcagcacaccaacatggcacatgtatacatatgtaacaaacctgcacgttgtgcacatgtaccctaaaacttaaagtataataataataaaatttaaaaaaagaataactttccattttatcaattgaaattaatagaagtaaaagtttaaatagtgttgactacaaatattagtatatagatgtatgtatttgatgtaaaaacatagttttggagattattctcttcaaatgatttagtatatttcagaaagataagaggatgataaatttcaaccaaaaataataacactgagcttttaaaagtatacttgaaaaaaaagtacagttgcatagatttgaagaggaaatatagagcagtatgttatctaaaaagttcagaaaatgggtcgggtgtggtggctcacgcctgtaattccagcactttgggaggctgaggtgggtggatcacgaggtcaggagaccgagaccatcctgactaacatggtgaaaccccgtctccattaaaaatacaaaaaattagccgggcgtgtggcgggcgcctttagtcccagctactagggaggctgaggcaggagaatgacgtgaaccgggaaagtggaggttgcagtgagccgagattgcgccactgcactccagcctgggccacagagcaagactccgtctcaaaaaaaaaaaaaagttcaaaaaatggccaggtgcggtggctcacgcttgtaatcccagcactttgggaggccaaggcaggcagatcacttgacatcaggagtttgcgaccagcctggccaacatggtaaaaccctgtctctactaaaaatacaaaaatttacctggcatggtggcggtgcaagcatgtagtcctagctaccagggaggctgaggctcgagaaacgcttgaacccggggcggaggttacagtgagccgagattgtgccactgcactccagcctgggtaaaagaacgagactccgtctcaaaataaataaataaatttaaaaagttcagaaaatattttataatgtcaaaaatataaattacacagtatatgtatatatgtaaatatatacaaataatttacatctctataaaatatttcaaaattattttataaagcaacttcccagaaattgagtatttaaatgctatttggacatgcagaataataggcaaaaaaaaaaaaaaaaaaaaaactcttcagaggaataagtagggaatttcatacaaaggggtgataactcttaagatattttagctttggattaatttacatttccctaccccgtaatgatatgctcccttggggctagaaagaaagcaaattaaataccagttgaacaactaaattgattattatattgatatcccttcttcaaaatgttaacggaaggacaactactatttatacacaattagcatggaggagagacgtaattaaacataactttagataatttctccaaattatactcctctaacattttgaaaaagtttttaaaacagaagtgatataaaaacaggtgagcttcttaccctcagcctccatgctataagtaacactgaaattcaccataagattttcttgcaaaatgccataaatgaccttgcgtgtttaagtgtaccactgaggggatattggctactagaaacaaacaaacaaacaaaaaaaaaacggaactcaaaacacttcaagcagtaaaaggttttttgtttgtttttaaatttcacaaaatgaagtaaagtcccgaggcaggatgatttcagatttggttaagtcagattctttccgtattctgactctacattcatcagcatgggaccttcccagccacgacattatcacatttttacatgcctgtgcccaaaggcaaaaatagcgtcaacctcttacttttccttcctctaactagcaaaaaagcatcgccagcaccctcacagaagaaatctctttaggtcacaacagctagaattgcattaagtatattttataagccaataatcaccggcagagagaataaaacagacataatcaaccccctaaagagcagcagttctcaaacttgagtgagcaccacagttacttggagagtttattaaacgagatttctgggtggagcccagaaatcagtaggtatagggtggggcccacgagtctgtatttccaaaaaacttccaggtgttactgatgctgctggtccttctacaaaccccctgcactgccctaaagcacgtgggagcatcttagcaaaggggtgggggaggtggctcaggtaatcaaccaaagtgcatctgagatctaatattattttaaaattgcttttcaagaattcctattacttcaaattaaagatgtaactgagtgtcttctgagtattttagaattgcaaattttgatattctaccatcactatgctccacctctctgaagccattactagggcaaggatatagtgagaaagtttctgtcactgctaagcaagtgcatccttcagattgccaatgtgtcattgtagttggagctattaaacttctatgtggcatgaaaattgtttggctaactttaaaaaggagaaaaaaatggaagtggaggttagaatttttctagcccagcaagaacccacttggtaaccacttttagataaaaagcccaaaaataatatacttcaccagatgttcctttaattttccagggattaatttgagagtcaattacctattttaagtgattaacataaattaaaaaaaaaaaacactaggctctgaaccaatgcttttaactgtatgatggaccattgttcatttccgatacttttaagaactaggatgattttgacacattaaaaaatgtcctggaatgaatttgctattctgcttggcaacatttgaggaagtaaatactgctacaaatcctttaggtagctttcaattgtccatgtctgttagtgagaagagggacagtaagaaaaatgctaaggtcaaattcactcatgacttcatgccaaaaaaaaggtatttctgagttgataactctaaaatctttttctaagtagggacaagaattactaataacaaacagtggaaaacatactgaactaaaacacaaaatatctgaattttacaggtcatttaacttccctgagcattgctttcttatctgaacctctaaggattggatttggtgtttggtttcttttttatttttataacatccctttcagatataatccaaaggtgacatctcctttctctgtcctatccatctttgatgatatgtgttaataacagttaaatgcaaaataataggataaaaggcttaattacaaaaaaaaaaaaaaaaaaccaagaggccagataattctactctggaagaactggctgtaacatcatgatgatggcagcaatttagaaagccacattaactttgttacagagatttatttaacgccagtttgaagaatgacgtctttatgccgatgacatgattcatttttttttaatgagtaaaatgtgtttttctccattagactttactctctgtaccttgaaaataaaaatacctttccagtgtcatgcatgagtcatattgattctcaaattaaactaaacacccatagcacataggaaaaaaaagccaaatgacaatttagaaatgtaagggaatttgaatgtctactcatttacttgaatctaatcattaagatgaggatgttatttcactctttctagaacaatagttttccaacttgagtttgcatcagaatcaccaacaggaccagtaaaaacagacagctggacccaacttccagagttgccaagtcagtgggactatgtagggcctgaaaatttgcatttttaacaatttctcaggctacactggctgatgttgctggttgggaaccacactttgagaactactgtttgtagaagactggtaaaaattggtaggtgtaagaaagatattctttttagatatatgtctgggagctgggggcaaagtagaaaagcatttaaaaagcaaaaatgagagacacctgaactgtcatgcatttaccagaattttctctcataacgtggcagccttcactgtcctctttcctttttactattctaaatcaaaacattacaaatgtacaagctggaactgattatgcataatagctgatgttacttcactgattaaaaacaaaaaagcaataaactttggctccctctgcaagctgcccataataaaatgcagaggaaatatttattaatcaagcaaagactgaaagacatttcgttaatggtctgcctcatcacatcagtttgaatcacattacacatcccgttaagaagagatgatgcttaaaaatacagaaaactaaatgtggcattatcatccatcccaactggaaaatgtgatggattgtccttaatagaaagagtggtagtctattcatgtggtatgtctcgcaaaggaccgccaggctccaagagccaagtattctgatcactttttccttaatgagaggctcccataaacacaatttaatcctctttgaaaacctgagggctattttgtgtttaagtggcatacacagagatcattaaaatgtaaaagaactgtgcagggaggcccaatttttttccaggtggccatgcatcagaattttgttagaatgtaacatggatttgattgaatgattctcccatttccacatggagagtggagcccagagaattgtttaatcatgtatccatgattcaatattcatttatggagcacctatgctgggccagaggtactatgagtggggatgacaggatggatgtgacagacaggacccctgtccccatgcagtttacaggctatatcagtaattaacaagaactaaaatacttggcaaagaggaatgcttccatcaatgtttgtttaaattaaaggaaaaaaacaaaccccacaacgaaataatcaatacagttgtcacaagtgcacaggacagcatgaaagcccatgacacatattttggagaagaggtacttccattttttttggtgggggaggtacattagcctcaaatttcacagaatacatgcaatctcaaagttaaaaaatgggttttactgttaaggtctgtcaataattcaacttattatttgtttgtttgtttgtttgtttgtttgtttgtttgttttagacggagtctagctctgtcgcccaggctggagtgcagtggcacaatctcggctcactgcaagctctgcctcctgggttcacgccattctcctgcctcagcctcccaagtagctgggattacaggtgcccaccaccaagcccggctaattttttgtatttttagtagagatggggtttcaccgtgttagccaggatggtctcgatctcctgacctcgtaatccgcctgcctcagcctcccaaagtgctgggattacgggcctgagccactgcgcccggcaattcaacttattaatactagaatacattttctacagaaaaagttgtgaaaaattgtgatataattgtattgtagtacattgtaaaaattacaatacaagtgaaatgctttttatttacatttataaagaatagaaaatgtaatcataagaaataagagaaaaaccatttttacataaaattgaatataaacagcaataaatgaaatcgactatatatcaatttgataaaccacagagaaaaaaataattatttcaaataatttttgaaaatagttctttgacccattttaatgggatgtataagtctaagggcaaaaaaaaaagaaaaggtctgaaagcataccttaaatttattaatgggtttgttagtagtgatattctaattttgagacaatattgtagaaaactaaagagataggttgataatattagccaccataattttttttctaagggaaaggagatacaaatataaaaaaaaagaaaccaagaaaaagaacactcataatattaattttctcccacttaatttttctgtaatactaaatttgaattgaaaaatatagtgtgaaccaaagattataaacgtaatttcccttagggtttctactgaaagggtttagaaacattgacacagtagcaacaagcaaatttagttccctgatcctggtttctaaataccattccttacagaaacaacaaacaaacaaaaaacaaaccagttaataccaagtttaggtttggtcaaggtgaactggtgacaatttgttgtgccaaacactaatttaaatcaaactatgtgaaagaattcaaaaactagcttcaaaaagcattcatgagttcacaataagaaacagggagagagagaggcagagggagagaaagagagagagaaagggagacagagaatgaatgagatgccctccagcaaaggaaagcagtaagtccacgacatcatctatccttgccaaaatgtctatcctggatctaataaagcatcccatcctgcactgcccaatatggtagccattagccacatgtgactgtttagatttaaatttagaataatttaagttaaacaagttagaatttcttttcctctatcatcctagccctctcacatatggctggtggctactgtattgggtagcaccaacgaagaacagccatcctcacagcaagatctgtcgggcagtgctgctccagacctatcttccaaattatatggaaaccaagaaaccaagttaaatgacactacggggaaaccatatgacaaatccagactgacagaatgccgtgggacttctactagactattagcctgaactcttccaaaagtaaattgtgtttgtgtgtgtgtggtgtttgaacacctacatatgtatataaaatgcaattattattgtatactacaaagatgtaagagaggtaacaaccaaatgtaatgcgtgaatctggactgaatactgaattagaaggaaatctggagaaatctgagaatagaatggatattagatgactatccccacacctacgccatagaagcggaagtcactcttgttgtttataaaaggcccacgagggaaagtgccctactttttcccagagaggggaggggcttgcgggaaatgaatgggagagagttgaagcagagtgctgagaagagggaaagatttaccataactggaaaggaaaaggagttttactagttcctcactgaaagattgtccccggggcctgaaagcttgaagagatgagaaactcctcccctttcaggcccagtcccaaggcgcaaggccacttacagtaatcagcagcgtgggtcagcaagacagcggaagcaggacgacagccggccggaagacacctaccccggccggaagacacctaccctggccggaagacacctacctctgaagatggagaaggaggccgtccgggtactacgtagcagtcaggtcagtctgggacatttcctgtttacagaggactataaaacccctgtcctgtcctcatttggggctgacgccattttaggcatcagaccgcctgtgcccaggcgctcattaaaacagcatgttgcggccgggcgcggtggctcatgcctgtaatcccagcactttgggaagccaagacgggcagatcacgaggtcaggagatggagaccatcctggctaacacggtgaaaccctgtctctactaaaaatataaaataattagccggatgtagtggcgggcacctgtagtcccagctactcgggaggctgaggcaggagaatggcgtgaacccgggaggcggagcttgcagtgagccgagatcgcgcccctgcactccagcctgggcgacagagcgagactccgtctgaacaacaacaacaaaaaacaaaaaaagcagcatgttgctccacacggcctcgtgttgtctgttggcgtgctcttgggttcgagctgagaaccttacactcaccacttccgggatgcctcccctatctttttgcaactcttttttgagggaataatggcactgggtttacctagggagaaaggatactaaactctggggctcccaggtttggcaggctcttgtggaaaaaaacctgcccttgaaaaacccctaaccaaagagctttgaacaagatgatctgagtgggaactccttctcccacgtggtgtggccggcctcgtgtctattaaactctctactacaatgtcagtggcctttttttattatttttttttgagacagagttgcccaggctagagtgcaatggcgggatctcagctcaccacaacctccgcctcccgggttcaagcaattgtcctgcctcagccacctgaccagtagcctttctttatgcagtgacaggacgaatcccttgggtggttacatgataatgacaaaaaaaaaaaaaaaactagtttgttattctaagaaagacatatttgaaaaatgagaaaatttgttgactgtggacaataaaagacagtgttacaaacaatatatgagtctttttaagaggaaataaaatgtatcaaatcagatctatcgtccaccacatccctccttcactagccggtaggtgaagctctttcaagtgggtgagggtagatggtggaggaaagataagttttgttcaattaaaaaacatgtatagacagtctgcagtgtcagacactgtgctaagctcctcattacttcaggagcttgataaaaatactgatttcaaggcccagctcccagagattctgactgagtctttttctaaggtggggtccaggaatcctcatctttgaacattggtcttcaccctttccacaaggaatcacagtggagactttcattggatggcaccttgtgaaaacctgccctagtgttttggagataaggggggggatgttcatggggtagaggggagtgtcactctggagcactctcctgccttgtgtggccacagcacagtcccacagtgaggggccacgtggcactgcgcaccgatcttgagctatagtcacaaagctcctaggcaccacccacgaaaggccgggtgatggcagaacaaaaccatctggaaacctgaagatggctatcttctcttttgcagagaacaaagaagattacgtgttttgttcctaccttgatttcattttcagttcttttggacactgccttagttcagctcaagtgcatttgtgatttcacatgtaaaaaaaattacaaatgagcatcatattattcttgcttagtgttcacaatgctttggcgtccaggctatgttccccttcctttgcattaaaaaatgtgtaattttcatatgttagagctagaagggcaccaaagaagccatgaagatgagctttctgttaatctgttggtggcttgcatcatcattggatgatgcctactgaagcaaacgcaaaattctattataaagctaattcttaaacaatgtgcattacattcagctgctgtggccaccttagctgaggaagacatttctaagggatgtatggtccctgagggctctgtttaggcatcatatcatcaggaagtttatccttattcattcctactccttcctctctcccctcaactctgggatctatgttgttcaatgttgtactatcaaagaccgtattttattggcatttttttttccttttctttctctcctgctgtgagctccttgagggaaatttatgtttcccaggtctttgcatttctaaggctacaatcagaaagtgacacaaagtctacattaaaaaactttaatgaattataattatgaattataaccaaattaacaacactgaacctattattaatgatttaagatatgtagaatgttattgatatctttattcattgtgttccttttattgttgttttagggaatataaatatgtaagcgcttacttgtggtgttttatgactttgagcccccaaattttatattcattatcagatcctgaatgttcaactgccacaacttccatcacaggccaactcaggctgtcctagcaggctgctggatgccagtcacattaggctcaattcaggatgcagtatgtgctggagctggcacacacctgctcaaaggagctgatccttaaattttcaggaattatgtgagaagctgttaaacaatggatagcttgaaattggcaatggcaggagtatctataccaaagcaactggcaaatactacaaatcatatcactgcttctaatgagttacaaaggtgtgtgcttacatgctacccaaaaggaacttgaaggccttcatgtgaaaagatcatatgaataaacacaaagaaattagggaataatggccgggcaccgtggctcacgcctgtaatcccagcactttggaaggctgaggcgggcagatcacctgaggtcgggagttcaaggttagcctggccaacatggtgaaaccccatctctacaaaaaatacaaaaattagccgggtgtggtggcaggtgcctgtaatcccagcctacttgggaggctgagacaggagaatcacttgaacccgggaggtggaggttgcggtaagttgagatcatgccactgcactccagcctgggtaacagagcaagactccatctcaaaaacaaaaaaaaaaaaaaaaagaggaaattagggaataacaaactaaaccataatcaagccctaaatttaatataatcaagaaccaaaagttataacacaggtaagtgatacaggtatcagaaatgggagatgtcacagtcaaccaaaattgtggggggatcttcagtgaggagttggaaaggatgcaggaaagagaggagaggaatatcttcaggatcaggaaccagctgaacacagctgaacacatggagccaagcacctcacatgtgtataggggagagtaaagagggcaacacgaatgccacacagcatgcagccctcagggggagtccactgcacacacgcctggcttctgtggaacttggttactggaagtaccacatctgttgtcttggtccagctgtagcagagccatggatacttaagagtttgagaattaaggtgattgcgtagccggtgcctcctctatttcacctgtcttgcttattgtctatatcctctgtttaatcctcatctcgaccctttccatttatgattagaagttctcttcaaaaatatttctttaaaagctttgagggctatttccattttttgctatcttcatttttgttaacagctttccatggttttcctcataatatatgctttttttaaaaaatataacaaatccccataatccagattaaagctaaacaaacgcaccaggcattaagcaaatcacaaactccaggcttttttctgtaatacatgatacaaaacaatcagtaacactcaattccaggaccaacgagaagggagacattataaaaaatttaaaatgtctcaaaattctgtcactacagattggccttttctgaacatttcatataaatggaaccacacaatatgtgtctggtttcttttacttggcagattttttttttaggttcatctatgttgtagcatgcgtcagtagattgttcccttcctcattcacacccatcttcctcccttccttcctctctccctcccttcttctctctttccttcctttcttcctcccttccttcctctctccctcccttctctttccttcttttcttcctcccactctcctttcctccccatctttccttccttctttccttccttccttccttccttctattcttcctctatttctttcccagatagcattccattgtactaatgtactacattttgtttatccatttaccagttgtgacacaagttagggttgtttccactttagaaataactgtgaatcatgcttcagccaacattaatgtgctattctttggatagaaatatgtttttatttcctttgggtaaatagtggatatttgaaagtggaatcattggatcaaatggtcaacttaggttgacatttttaagaaactgccaaaccattctccaaaatggctgcaccaccttatattcccatcagcaagtgtgagggggtcttattcacatcctggccaacattccttgttgtctgtcttttttattataaccattgttctgagtgtttagtggtatctcactgttttgatttgcatttccctaacaacgactgatgttcatcgtcttttcatgcatttatgccatgctttctaataaagcattcatttcaaaatacattcatttgactattcgcaactgatcttttcttgtcactataaatccccaacttagaaaaaaactcttctgatcttaagagtattgtcttggtgtttataaccatcacctaggtgtcagcctgcatggattcttttagagaatggcacccaataattgtcctgtttctgtgtgctacccctttatgtgaacagccctgcagaggaagagcctgctggatgttcctgatggccctccagacctgctcttctctcttgtctcccctcatctgtgctctggaggctgactttgtaccaggatcccttgtgtctggcttcggatggagacacaggcaggtagagagcaacattgaagagcatttttcctctgctccctcactgtgggctgcagtttggaagtagccactgcctttccctgcctagtttttaattctggccaagcagaccctttccaggggctgaatacacttgaaagctcctaccaggagctccctcctctcataccttcagggttagagatggtaagggctgttttgggtgactggtcccttattcttctccacccactgatgggtcccttaaccttgtcaacccttctggagagagcttctttttaactatttatttatttaaatagaatagagatagcatctcactttgttgcccaggctgatctcgaactcctggactcaagtgatgcttccgccttggcctgctgagtagctaggactacgggcaagtgccaccatgcttggctaatttttaaattttttgtggagacagggtcttcctacttcctatgtgacctaggctggtcttgaactcttgggctcaagcaatcctcctgccttggcctctcaaaatgctgagaatacaggtatgagccactatgcccaatctggacagagcatctttaactctcatttttcaagtgtgtcttctcctttttgctgggactctgatacaggagataagcaaaactcctttgtgaaacctaagaccagcacttttatgcataaaacaaatggttagtgctaatgattaacttaaagtagtttcttcagacatatttgacacaacattacccactagtgcctgttcacctctgatcttgtagcactttgggcttttcacaaggacttgtcaccctctaccttgctttgtactcacttgcagtaggagacaattcccaccaccttcaccccaaacagcataaaaatgtaaaagttttttccagtttccctaaagtcatctgagcagctctccctaacccagaggagtgcaattactctaagaacctgtccatacaggcgttttttagtagatgttctttactcagattggagttatgaattgctaaccgtctaaattctctactgattgggagaatgagatgaggagtgaggggaagaaaggaataaagactcatctgaagcttcctaagagggccagcccaggagaaaacagccatgaggcagttcaaatctgcctagccaagccagggacaaggagctgggaatccccacgtgctgtaactgtcacaaatgccacactcaaatgcagatccctgggccactacagattcactgtattaatccattctcacactgctatgaagaaaccctgagactgggtaacttataaaggaaagaggtttaattgattcatggttctgcattgcttgggaggcctcaggaaacttacagtcatggtggaagacaaaggagaagaaggcatcttcctcatagggtggcaggacggagtgagtgtcaagcaaaggcggaaaagtcccttacagaccatcaaatctcttgagaactcagtatcacaagaacagcatgggggtaaccacccctatgattcaattacctcccatagggtccctcacaccacgtgggaattatgggaactacaattcaagatgagatttgggtggggatacagacaaaccatatcattatgcccctggcccctggaaaatctcatgtacccacatttcaaaaccaatcatgccttcagcattaactcagaagtccacagtccaaagtctcatctgagataaggcaggtctcttccacctatgagcctgtaaaatcaaaagcaggttagttacttcctagacaccgtgatggtacacgcattgagtaaagacagctgttccaagtgggagaaattggccaaaacaaaggggctgcaggccccatgctagtccaaaatccagcagggcagtcaaatcttaaagctccaaaatgatctcctttgactccatgtctcacatctaggtcatgctgatgcaagacgtgggtccccatggtcttgggcagctccacccctgtggctctgcagggtacaacctccctcctggctgctttcgtgggctggcactgagtgcctacaggttttccaggtgcacagtgcaagctgtcagtggatctaccattctgaggtctgaaggatggtggccttctcaaagctccactaggcaaggccccagtagggactctgtgtgggggctctgaacctacgtttcccttttgcgctaccctagcagggcttctccatgaaagccctgcccctgtagcagacttctgcctggacatccaggcatttccatacatcttctgaaatccacgcagagtttcccaaacctcaattcttgacttctgtgcactctcaggctgaacaccatgtggaagctgccaaaggttgaggctttaaccctgtaaagcaatggactgagctctacgttgacccctttcagccatggctggagtggctgggatgaaggacaagtccctaggctgcagacagcatgggaatcctgggcctggccaatgaaaccacttttcctcctaggcctccaggcctgtgatgggaagggctgccgtgaagacctcagacatgccctggaggcattttacccattgtcttggtaattaacattcagctcctccttacatatgcaaatttatgcagccagcttgattttctcctcagaaaacgggattttcttttctatcatgttgtcaagctgcgaattttccaaacttttatgctctacttccatcataaaacccaatgcttttaacagcacctgagtcatctcttgaatggtttgctacttagaaatttcttccgccagataccctaaatcatctctctcaagttcaaagttccacaaatatctcaggcaggagcaaaatgctgccagtctctttgctaaaacataacaagggtcatctttgctccagttcccaacaagttcctcatctccatctgagaccacctcagcctggatcttattgttcctatcactatcagcgtttttgtcagagccattcaacaagtctctagggagttccaaattttctcacattttactgtcttcttctgagccctccaaactattccaacctctgcctgttacccagttccaaagtcatttccacatgtttgggtatcttttcagcaataccccactctactggtcaatttactgtattagtccattttcatgctgccgataatgacatacctgagacttgccaatttacaaaagaaagaggtttaattggacttgcagttccatgtggctagggaagcctcacaatcatggcagaaggcaaggaggagcaagtcatgtcttacatggatggtggcaggcaaaaagagagcttgtggaggggaactcctctttttaaaaccatcagatctcatgagactcatccactatcacaagaacagcatgggaaagacctgcccccatgattcaatcacttcccaccaggtccctctcacaacatgtgggaattcaagatgagatctgggtgaagacacagccaaaccatatctgcaagcaaggagggatgtacctttagtagaattaaaccacttatttatgtgaaatactaccactgctatggtctgaatgtttgtgtcccccctagaaattcatatgttgaaatgaaatcaccactgtatttagaggtgggggcttcaagagttgattagatcatgagggcaaagcctcatgaatgagattagtgcccttataaaggaggcctgagggagattgcttgtcctttctgccatgtgaaaatacagcgagaaggaaccatctgtgaaccagagaatgaaacctcactggtgactaaatctgccagtgccttgatcttagtacttgccagcctccagaactctgagaaatacatttctattgtgtataagccactcagcccatgatattttcttatagccgcctgagtggactaaggcagtaatgtaaagattttactagcttttatagtaaaaatctagcttttctagtttgttcttcatatatatatatatatgagcattttcaaacagagtacttctggaagctgaacaacagtgtctcctgttaaaaaattcaaatcctcatccaaattgacatacatgtgctggcgcatatgttgtttatttctctgctgtttataccaaacttttcctgcaaacgcatccatcacacacacatgtggatacgcacaggcacacacatccaaatacactgcaggtaagacccactactactagtctcacagtttcacagtgatgttgggccaaaaacctgatccattattacttactgcggttcacggaagcagctttgtaaacctacataaagattcccccttccttgggaagccataaatgcaacgtttcactgagcagcatggaggcagggtgttaacctgctgtgtgactgctttcaaagagccagcactcctcagcagaagcctaatcatctctgtggatgtgctgtcctgggcctgcttcgataagtgctgtttatgtggctgtattttcaagatagcatggagggatgctaaacttggtatttgaaatctgtttttcctcacggcagcaacaagcctgcagcacagcgctaccagccagctagccaaccccacagccgcctgttgggcaaaggaaccctggaactcgttgaggttgcaggaacatacagaagatcatttctcctctttcattttcttgctgccttttctttcttaaaatcttaacgtcccaaaggaacaactgatgtgagtcagtatgtgttggcagggcaggatggtgtgtgtgtgtgtgtgtgtgtgtgtgtgtgtgtgtgttcgtgttcattcttcctgttcctgttttcccacctcagccttgggtgtcgatgaaactttttttttttttgagatggagtctcgcactgtcgcccaggctggaatgcagtggcacgatctcggctcacttccacttccgcctcctcagttcaagcgattctcctgcctcagcctcccgagtggctgggattacaggtgcctgccaccatgcccagctaattttttgtatttttagtagagacggggtttcaccatgttggccaggctggtctcgacctcctgcccctgtgattctcccgcttcagccacccaaagtgctgagattacagaaatgttttatatacctatttgctccaggcagagtttgaaggcagagacttatatcaattagagatccataaaagccagtgaggtgacatgaacaaaagcattcccaccaacactggaagtattcaagccagattttaaacatgagatttccactttaggataaaggttggatccgataactttgaagatcctctgccatttaaaaattctatgggccagacgtgatggttcacgtctgtaatcccagcactttgggagacagaggcaggaagatcacctgaggtcaggatttcaaagccagtttggccaaggttgtggcacatgcctgcaatcccagctactttgaggctgaggcacaagaatcacttgaacctgggaggtggaggttgcagtgagccgagatcatgctcctgcattctagcctgggcgacagagtgagactctgtccaaaataaacaaacaaataaataaattaaataataaatacaaaaataaatattctgtgatgccatgatcttactcccagtttaatgaacagttctgatggtgatgtttagagtgaaactcatagtttccttgaatattttcctactttgcatatttcccaagatgctttttccattttgaggaagatacaagataagatacttctcactgaaagttctcctttaaggggagaagcaatggcatctgaatctcaaagtttggaaaaaataaaccgttttttatctcttggctgaaggcaaagtgaagaagtaaccacagctcagctctgtggagagtgggggtggcagatgggaaggtgaaggaaggaaaagcaaacacagtcagccctccctccacactggcatccatgcatccacggattcaactaaccaaggaccaaaatatcccaaaaataagaagaaaaattaaaatgacagtacaatgaaaaaaaaatacaatctaataagacaatagagcacaacaactatttcaataacatttacattgtatgaggtattataagtaatctagagatgatttaaagtatatgggagtatgtgcccatatacacaatggcaaatcctatgccgttttatataagagacttgagcatctccagattttggtatctgaggggaatcctggaaccaattccctgcagatactgagaaacaacgctatgctctgggcagaagtacttccagaagagccacacgattgttcccctatccttgctcaacaaaatgccagcatcagaagaaacaatggaaaaacctgattctttcacaagagctgacctctgactataaaggatttagggacaagattcccaacctactctatatggcaaaggaagaaaataaaatgttatcttctttctccccagaggtcactcattgcttttcctctccaaaatatgcttgtcttagttcattcagcggctataacaaaataccatagactgagtgtcttatacacaacaggaatgtattgctcacagttctggaggctgggaagtccaagatcaaggtgacagtggatttagtgtctgctgaggacccactttctgattcatagatgatgctttcttgctgtgtgggcactaatctcattcataaaggctctaccttcagggcctaatcacctccccaagccccagcctcctaataccatcgtattgggggtgaggatttcaacatgtgaattttggggacgtagaaacactcggcttatagcagtgctctttttattttgccttactgatagctaaggtcactctgtgtgcacatttatttcacacttgaagcatccctggtgtttttaataatcacctccagcctgtcacgtgaaattaataacacacacacacgactccatttttcatcaaggccaccttccagaaagaaattactctttgactactcagagaaaggtgcagagattattataaaaatcaggagaggcaatgaataatatgaagaaattcagtgtcccaagttcttttcctcccacacttatttgtagccagtgtgatcattccttatgcacctaaactgcataatctaaattaattccaatgtgttgtagagtttcaccaccattacagtttgctgtgattagcaaaccttaacctagtgccttcatgtagaagtatgactattttcacagttttgtatgaatgtacttgctatatgaccttgggtaactcactttaccttctttgtcttggtcttttaccatctgtaaaatatagtatagtttttccttctccatattttatgattaagaaaaaatagaagatggttagaaaataataggaacacatgattcatgcaatcatgccaaaagtaccaggaaatcacatttcaacatataatttctatgcaggttatcagtaaagcacatctttaaatcactttcaatcaattcacaaggtaacagaattttgatttttttcccctttttaggtgcggattaaatatcccatctagattaagttttatatatatatatatatatatatatatatatatatatatgtaagaatcaatgcaatatcatataggtctcaaaatacgttattttcttactccttctttacattcttctcattaagtcatttttttcacttaacaaatattaattgagtggctactatattccaagaagtatgttaggcatcacaggctctcattttatctatatgcctggtgacaggatagctttgccttgactatatggtgttttcaaattttctttcttttctttttcttttttttttttttttttgagacggagtctcaccctgttgcccaggctggagtatagtgtgctatcttggctcattgcagtatctgcctcccggatacaagtcattctcctgcctcagcctcccaagtagctgagattacaggtgtgtgctacaatgcccagctaatttttataattttagaaaagacaaaattttgtcatgttggccaggccagtcttgaactactgacctcaagtgatccacccacctcggccttccaaagtgctgggattacaggcatgagccaccatgactggcctcagattttctattgacttcatttctatatagccagacagtaatgaattggttctgctgaaaactgtggtcaggataagttagaaacccttttgtttccttatgtatgtctttctaaatttctgctgagctacatcttaataccttattcccagacctcagctcagtgccccagtgcctgacacaaaataggctcaaataataattagttgaaatataaataatgatcataatgctaaatgacaaacagcccttctactactgggtgacctcgggcaagtcactgcatctgatgctctcttcattcataaaataatagacaaggctggtggttgctaaccagctgggtcaagactggtgttattgtaaagatgtgaaaatgcatatacattctataataagtcctacataaaaacagaatatactatttgtcatatatatatgtatgtgcgtatgcacaccacacataaaacaaataacagttttacatgcatgtagattactgtgtctaagaaaaccagtatcatttaaaagcactgtagagtttataacatcttttggctactatgtatttcgttaatgagcacatacaaaaatgtaaaattacaaccattttgacattctaaaacaccttcacactccaacagggcatcactggattaaatgatcttcaatgtcctatctagcacaaatatctgtggttccaattcaacagaaagcagaaaatatttctcaagtgttagctatatacacagcaaacaaccaagtggaaagcagaaaatacagccaatgaactctacaagtagaaaatgtgagcattttctctttttttttgagatgaagtcttgctcttgttgcccaggctggagtgcagtggcgcaatctcggctcactgcaacctccacctctcaggttcaggtgattctcctgccccagtatcccgaatagttgagattacaggcatgtgccaccacgcccagataatgtttttgcatttttgtattttttgtagagacgggctggtctcaaactcctgagctcaggtgatctacccaccttgacctcccaaagtgctgggattacaggcatgagccactgcacccagcctcattttcttttttactaaagctgctgccatgactggctttatcatgccactccccctcccctgtccccaaggtacactggcatggtcctgctctccagagtaagttctacacataaatgacccttttccctttgtccagtaaatggctgggccatgtcctttaaaccagcagtagctgttaactcttggttaaccacaccccatacccacaatgtcaagcaataaatgtttttgggagataactaaagaggctgctggaaacatttgctgcatgttcaatagtgactgacagtggagaggagggagtggtgggcatttcttttatttttatattttgagatggaatcttgctctgtcgcccaggctggagtgtagtggtgggatctcagctcactgcaacctccacctccagggttcacatgattctcctgcctcagcctcccgagtagctgggattacgggtgtgtgccaccatgcccggctaattttttgtattagtagagacagggtttcaccatgttggctaggctggtcttgaactcctgacctcaagtgaactgcctgcctcggcttcccaagataggcatttcataagaatcatacaacctgtcctccctgtacctggggcatacacagaccaagggtacaatgcgtatgagctaaagagatcctggctgcaacgtatttgagcaaaaaaataataatcatttgtattatacaatgaagagagatgatgaaatggttgtgacttatttgagaatataaactatagtgatcaataaaatcacatttggtgcggtatttaacccatttatagagatgtatattttcactctatgttaatttgcagggacatttgagaggaaatgtctgtataataaaaacattaaaatagaaatatttcaatctcagttttgcctaaggccccaagtccttgtttatcaggatttgaaaacaagataaccagaaaaaaaaactttatgactctgagtccctcagtcatcttgaggatataaatctgatatgtatattaagggttcaaaatggtaggattagaaattaaaataaggcttatttggataaattgttctataaaccccctcccatagggagtgtgggggagtttgcctctcacctcaatccaagagaaaggttttagacatcttgatatgtagcccctggggtttggaaactgtattagtcagtgttctccaaagagactgaatcaatagaatacagatatagatgtagatacagatagatgtgagggaatttattaggggaatggagtcacacaattatggaggctgagacatcccacataggccttctgcaaactggagaaccagagaagccaggagagtggctcagtccaagtccgaaggcctgagaatcaaggaagttaatggtgtagctctgtctgaggccaaaggcacaagaacccagagggccactgttgcaagccctggagtccaaaggcgggaaaacctggaatccggatgtccaaggccaggagaagaagggcatcccagctccaaaagagaaggtgagcaagagtctgccccctccttccaccattctttttctatctgggcccctagctgtttgcacggtgtctgtcaacatcagggtggatcttccccactcagtccactggcgcacatgctagtctcctgcatacacaccctaacagtcgtgcccagaaacaatgtttcaccagccatctaggcatccctcaatctagtcaagttgacacctaaaattagctatcacgcagactgatgtctgatttgtgctataacatctatggaaagagagacggtagcggatacgcagttctgattgtggcctgaagagagggcaacaacctgtccccacagagagtcagagcaaagaaagcccaagttccttagactctgctcaggaagcctgtccagccatgcaagaagactccagcagaaggaaaatgaaggggtgccacctgcatgcagcgggtgaagggctgaagaagggatcctaaacaaccaggagaggagaaacactcaactctgtcaaagacactgcagataggagatgtcaagtgaactgacaggatggattaggaactcttttttttttttttttttttttactttaagttctgggttacatgtgcagaacgtgcagttttgttacataggtatacacatgccatgggtttgctgcacccatcaacccatcacctgcaacaccaggctgccacaacacttgggttacacctaatgaggtgactccatttccattgtattgctattctggttagtgagaagacacactataggataaagtttgcattagaagagccaggaaaatatgaagtagaattcctctttaattaatgttaaagaacttaatcacagagggagaaataaatgttcacattggcacccatcgatatcatgaatggaatacaagctccatggtaccatgtgcttcctctcttgtaggatatggactgagccaccttggcaaactatgcccatggtatattcacttcatcaacaaagctagtccagaacattctatgcatttgcttcttataacctgattcttggccacttaagcagcattctcaatgcttccaatgagtgaaaatgaaaaaaagaggacaaaataagccaataattccagctcattagcagccaaaaaaaaaaaaaaagatctttgggcaagccaaagttctaaggggaaagggggaataacgacctaaagaccagtgccacgtatgtttgatactcttaactgtaactctggaacaacaacaacaaaaaccccatccaggtttaaaaatatgtgtaaaacaccatattataatataatctcatgtttattattttaaagtaggaaaatgcagatagtgtgtcttttgcatcactgttgaaaatacgatcattcattgaagacagagcagtggtatcctagttaaaactctttcaagttattcaacaataattgggagcttcatcaatagcaattgctattttccatcactgaatgcaactcattcctgaagcccattgaacactccagaatattgtgcaggcgtaggtcttgctgactcagttgtagccagcaatatttagtcatgctcctcgtcaggtacttctggctctctatgatgtggagaaatggtaggaggatgtcatttggacccctgtgttcaatggagcaatgtggttggttctggccaatgagctgtgagtggaagagacctgccgcttctgccgagcatttcgtatatgtgtgggtgtgagtatactctccttctcctcccatggtggccagcaacgttccaggggctgagccccctgagaagcaatgcccccatttgccagagtcagccatgtagtatgagtgaggaagaaaactttgtcttaagcccatgagattcaggggttatttgttactacctgttaacctcccctgactgatacaaaggtcttattgtctacctccttactgatattgactgatcaggtcacttactgaatatgcctggactgcaactcagtgcccatttttattttaaagatcgatgagttgttttatgattggaacttggggtaatacaaataatacatttcccatacgagcatcactaagagtaaacattgactgacaatgaatagtcattgttgatttgcacataaacccacaggtagattttgttcattttgtaagatagaaattagatgcatttgtcaggctgatgactgagggtgggagcatcatggagagtcacattagaagtggtgacacctgccatgagggcacagcatttgtgcaggtactgtgagaccaaatgcactgccttcaagctggatgcaatgtaatcaatccactttaacatgagtaatcattgctgagcatttaacatgagaatcatattataacacatattatgaggcgctgaacaatttggtgaagaagagagttatacaagttatatcgatgagttcagatgatttgaaaaaaaaaaagtggttagatttacaaaaggcaaggaaggaaaatgtgtaaagggaaatactctgtgctgctcctccagaaagacattccccaacagaggggggcttgccccagtgcggtaccacctgtgttggggcaggtaagcccacctctttgggtgttcagcattggataacacatttacctgcagatctaaaccacatcccgcagtgtagactttttcagtaataatggtggaaacctgatctccttggccttactactttgttctatgtttcaatttgtccagaatagggacagagaagcaagtgctgttgattggtctcttcaaatacagcaagggaaagtcctaatggagaagccagtcttaggctgagatgggaaggaaggaagaaatggggtttgaacgtgaggaggatgggaagtattccaggatacagtactatggcacaaaatcaaggactaaatgcttatctgtctattttttgagttctgtaaagtgctttcacatacatgataaaaatgtgtaatggcactgatggtcagtgtaaatcctgtgctctcttctgtatccaaacactggcagccctggactcctagtgaaggagacagacatgtgtcctgtttttgtggcgagattctagtggtgaagttagacaggaagcaagtagtacgtatataaagtattttcagatactgattagtgccatgaatgaaaataagggagggtaaggagacaggatagtggaggctcgctcttctgggcagttggttaggtctggtctgtgaagatgggtctttgatcagagtcctaactgcaaggagacaaagagccccaaggagaaacaggaagggaagaatctcaggcagcaagaaaggcaatagtacagaccctgaggggaaacgtgtttggctgtggaggaggccagtgtggccctaggggatcaggaggggtgagtccaggggaagaaagccataacatgcaagtagcagctggaggaggaccccaatgtccaaggtcaggggccctgaaatgaaagaaaaggccagtgaaagccaggactgtgcccagagaaggcgaagtgattagaacactcttgaaaatgaatctgctactgggttagggtgtctccccgaatgtcgggaaaactggccagaggtcattaaaatattgcaggtgcgagataattagaacctagccttgggcagttattacaggtgctaaaatctgaaaactcaaactgaggaaaattggcagagctgggagacttattggatgacaagggcaaagaggagagagaaatggcagacaattcagggtcactggctgactttcactgtcagtgatggcagacgtgggaggggaggccatctaacaaatgctcacgtctagggcttatgtagtcaacggtgagagcaacctgcaaaaaaataaaaaataaaaatactgttccaagagccattttttaaaaaaagaatgtcacgcagactgaaaaagaaaatcaaaataaaatcaagaaaagggattgtattacaaactcactattctcaagataaactgaaaaaggcaaatttcatacttagtaatgagaacaaaataaacactttcaattgattaatattgcaatacaatcattttgattatgtgtctttattttatttgttattttttcagtcagggtctcactgtcttgcctatgctggagtgcagtggcaacctctgcctcccagtccaagcaattctcccacctcagcttcccaagtagctgggattacaggtgcataccccgaggcccagctaatttttgtattttttggtagatatgggtttcaccatgttggccaggctggtgaactcctgacctcaagtgatctcccctcctctgcctcccaaagtgttgggattacaggcgtgagccacctcacctggccagattatgtgtctttaaaaaataaaaatgaagacatgcataaattagtatagtagaaggaaaaaagagatacgacaccttttatcttttttagggatcaatgaaaggccaagagatttgagaactgtaagaaagccctgagaagcacattgttcaaaatttatgctcacttgaaaaaaagaaaaaaaaaaaaaaaaaggaaatgacctaggctgttacaaaagttaaacccaaattgagcaccttttaaataaggttgtcaaaggttaagtatgtttgaggtaaaattatttccccagtctcaaaatgaaatttccagtagactttagaaaaaaaaaatatggaaaacaaacatacatggagaaactgcattttacaactgaacactgggtttcaagtagagtgatttttaaaaatctcatatttagatactgtctggttttaaaaataggccaaatggatcataggctgagaatcagaaatccttcttttgggttgtctcttctccgtaagcctcaagtacttcttagtcctttcttcatgactagataaaattatagtaactaccacagggattatgattcctagtcaaacatcaatcatagtcctacacacaaatgatgtcaagtgctaggcactgtctaggttctataatattagagttcctaaatttacacacgcacgcacacacacacacacacacacacctgagatagaggatagaaagataaatgatgatagatagatagatagatagatagatagatagatagatacatatacatagacagacagacagaaagatagatgctaggctgggagtggtggctcacacttgtaatttcagtcctttaggagcctgaagctggaggattgcttgagcccaggagttcaggagttcaagaccacctgggcaacaaagcaaggctctgtctctatgaaacacaaacaaacaaaaaattagctggacatggtaacgcacacttgtgctcccagatactaggaaggctgaggcaagaggatcacaggagcccaggaggtcaaggctgcagtgagccatgattgtgccactgcactccagcctgggcaacagagagagactctgtctcaaaaaaaagaaaaaaaagaaagatagatgctagatagatgatagatggaaaggggaaggaaagggaaaggggagaggaggggaggggagacgaggggaggggaggggaggggaaatcccttcaccgaagacttgtaggtcaggtctcaaagagcagccagcagacagccttcagctgtcaactacatcagggattgacccagctgcagagaactgcctcacacaaggtcacaccccttcctgggtgactcacaatcaactgacacaatcaataaaacctgtctgtcttgagccaagttggcacaactctgaagatccattctgattgtggagttccctgtgaggtctgtgtggctgggcctgcattgtagctcaatttctccccctcctcactactgtctcctctcttcccttccagatgtcattaccaaggatcctttttaattagcatcctatattccaaactctaaccacagtctgcttcctgtacttgcatatattcattacatacatatgtgtgagtgtacatatatgttttaaaaatccctagcaagagtaagtacgttatttggtcagtcagctgttaaaacttccactttctccagttgtctggtggaattaaaaaaaaaaaaagactttcacttttattagtgcaattcatatcagtgtgccactggtagctcttggaagagaaggaagagagagctaatatggaacctggagacaagttccactctgctcctgctgaatgcccttctcctttgcttctacctacctccagaagtgctggccattgtcagctcctgaaaaggctgatgctctgacctgtttcagtgaacggggagaggacttgaggctgggaaacctttggaataggcaaggggtccccctacataggcttccctccatgactcatagtgtgttccttggttcgctccctgtggtcaaccacctgctgcaaaaagtcgttcactgctggtgtgagaatcattgtcacctacactcaagtaaaaatgtgtatcaaaggaacagatgcttctcttccatgcaacctgaatatagatctatcaggcaaattcagacagctgttctagatgcagagaccatcatatctgctaggggtcagcaaacactgaccatggctcaaatctggcctgccatcagattttgttgggcccgggagtgaagaatgttttcaggcttttcagtggttgaaaaaaataaaataaaaagcataatatttcataatatgtgaaaattatataaaatctaatttgtagtgtccataaataaacttttttcttttcttttcttttctttttttttttttttgatactgagtctcgctctgttgcccaggctggagtgcagtggtgcgatctgggctcactgcaagctccacctcccggtcacgccattctcctgcctcagcctcccgagtaggtgtgactacaggcgcccgccaccacgcctggctaatttttttttttaatttttagtagagacagggtttcaccgtgttagccaggatggtctcatctcctgaccttatgatccgcccgcctcagtctcccaaagtgctggaattacaggtgtgagccaccacgcctgtccccataaataaacttttattaggacacagccatgctaattcatttacatattgtctatagctgcttttgatccacaatagcatagttgggaagttgtgacagatacctgaaagccaaatatgtttactatctggccctttgcagaaaaactttgccaaccacagagctatgcgatttaggattatacaacacaatatcacacatttgcttattggtgaacatccaatgggtggatattcacacagatatagacttgttacctgtacatgtctgtaagtatctggcctctcataaaacactaaacaccttccacagaagtgcacaatgatgtagagaccccacgttatgctcaaacccaagcgctatctttcttcacatctttttagttcaaaatatctgccttaaaacagaactggaaaaacaacatttgtcaagtaagtgcagccgtgttaatgttaaatagatgaatgcatggatggatcttttaacatacaagcaatggagaagatatgccagcaatgataatacttgtgttagtgtgaagggtattttagatctgccccaaactcaggtagaaaaagtttccctgaccttttccctaccagtttagaattttaattcatcccagagagtcagtggctttgacacaatagcacttactcttcagatgcctaaaattttatggtcaaaaatatcaaaagattagaaatgtgattttcaatcccaaaagccacattgaagttcaattaaacaaaaatgcctggggttttcatatgcactgaaaatcataaaaatcaattttattacaaatctacccatgaaaccgtctatctgtctctccatccatcaatttatttctgcaatatgtctcaaaatagcacccaagagtttgtgccaattcttatttttcaagatatatgagctttttcaagttcacaagctccataaacttcacaaactccatatggtgttcacaaaggaataataaatgttttttatcttttacattgtttatgaacacataattcatttttactatatcaattgcttgcctaagaagttacaatgcttccttttctgcttattctggcttacaagcctttcagaattgaatcttacctgatctgttcaatattacattctacattacacacccaatttcactgtatctcacccacctgtcttcctacacactaaagcccttactcctcctaatcgccatgttttcattatctccatgtcccttttatgtgttgttctttctacaaagaaaccccttttctcctctttttgaaaaacacctacttatccttctagaacaacctaaatgtaggaactttccaaattctccagggaaatatagcccttccttccttccatccatccatccacccacccactcacctactcactaatttatcccttactgaacaaacatactgagcatctattagatgctcaaaaatgtataacaaataagctatttctgcttggtttataaggacactgagatatcagcaaagtgttatgggaccgaagaagaagaaaatagaagaaagacatcaaagtcaaactggaagtaggacagtttggaaagcatttcccagaagaggtgatactgagttaagtatacacaggacaagaattatgcagccaggtggatgagggatgggaagaggagaaagggagagggtgttctaagccaaaaacacagcaggtaagaaactgagtcaccactaggaaagttaaatcaatatggcagaaagaaaacctgctccttgggtcatttcatcatgcgtttggtagagcacttacaactttatattaagtaatatgggcttgaggttctgctttagataatatggacttgaggttcttctaccttttattacctgtcagaaatagggttttaatccctgggaggtgaagcttgcagtgagccaagatagcaccacggcactatagcctgggtgacagagcgagactccatctcaaaaaaaaaaaaaaaaaaaagaaaaagaaaaagaaaaagaaatagggttttcatctggaaatatttggggctaagtgttgtcctgaaaggaactttggaaaagaaatattccattacacttgctttgtcatcttgtgatacagactcagcccatggatcaacaaaatgccttcattctcaacagtccaaagagctctgggtaggatctcaccttccttacaaaattcatgtcagatgttgaataatagacattattctgttcctcttccaagtgagagacaatgagtggctcatcccctgaacggtgtgtggaataaggtgaaacatgtagcaatcaagaaactggactcatcccctgaacggtgtgtggaataaggtgaaacacgtagcaatcaagaactggactcatcccctgaacggtgtgtggaataaggtgaaacacgtagcagtctagaactggctgcagaatatatgtttggattttgtaactttcatgctcccaaaactcagagtcatttttctacattggctctttccctgtattatcaattgtacccttcacataacaactgtttcctaatggcaaccaatcaattcagaattcaaatggcgattcgccagtttgatatctacgttgccctggggttatggaagaagctgcaaattttggggtactgttccagcttattaaatctttttattgaaatttgattcatcttttcctgaccttatcaaaccatcccggccttgtcatctacagcaggactttgcaaagtggactcctgtcgcttgctgcattttactggtgtgaaatcagaaggagtatggtggataatgcattttgaatccggttagacattaattattaggttggggcaaaagtgatagttttttttgccattaaaaaaccatgatcacttttgccccaacctaataacacccaaaccacctgtagaaatgatttaagaaatcttcaactcaaatgccttctttcaggaggagttttaaaatagaaattacatcattccaaggttgtgtctgcatatgcagttgtatcaaaaaacttaaatgtaatttttgagggaactaagccaggagaaagggccatagtgatgaatgtatccaaaagtagccatcagagaatccgtgagttcttacactgacacaggaagaccactgtgtttgacagatgcaaaatttccattcagatctggtcagcactcttcacctaactggtgtttttaagagataattaaaactgtttgcacaatggcacagtccatgacacattaataataataactaataacacattaataataataactaataataactaatggcacagtccatgacacattaataataactaatatataataattatattattataactaataactaataataactaatataacgaattatattaatgatagtaactaataatgtgaccatgacacattaataataactaatattaataataataactaatattcaatttaattctcatttctataagtgccaggaaatttgctaacattgtatgtatacatgtaatacatgtacattacatctcatgtaatcataactgttttattgcttttttttttttttttgagacagagtctcactctgttgctcaggctggagtgcaatggcaccacctcggctcactgcaacctccacctcccaggttcaagcgattctcctgcctcagccacccgagtagctgggattacaggcgcctgctaccacgcctggctaatttttgtatttttagtagagatgagtttcatcaccttggtcaggctggtctcgaactcctgacctcaggtgatccacctgcctcggcctcccaaagtgctgggattacaggcttgagccaccgtgcccggccaactgttctattgttaaagcaggtagctaggcagacgtgagcaggtcaggagaggacccccaacccctccccaggaatgtcagctgaccactaggtaatggtcaggaggttgttaaactatttctctaaaataataattgattgcagctggtaccaaagaaagaccgtctcccaatagatataaaacacctgaaactggtgatcagcttccaaataagatctcagaagttgggcgagcacgctaagcatgtgcactaagaggcaaaatggcggcgtttaactggtatatgagcttcctccaggaacgctctgctggtaagggaaaaacgcctcaagtgagcatgcacacaacttcagtaaacacactgcgcacgcagccccttccaagtgctgacaggccactgtacatgcggacagcccgctccgaaggaagaatcaggggagaagaaatgcaagcccaaaaaccctgccaaggtataaaaccccagtcaaggaccggatggggcactggatctctcaagtcacccacttggtcctctggcaagtgtattttgcttccttttgttcctgccctaaagctttttaaacaactctgactcctgctctaaaacttgcctgtatctctcccgctgccttaaacccacttctaccccttggccaaattctttcctttgaagaggcaaggatcgagtttctgcagacccatacaggttctccactggtcacaccatcaagtaagcattatcattattattcccattttacagaagggaaaactgagtcttaaagttataagctttcttccccgagttcacacagctaataaatacaagaggagaatttgaagtaaggcagtctgactctggttctaaaccaagtttatagtctattgatagctgttgccattgttaaagcccatgtcatatttagaatatagttccagagttggcacattggaaatgacaatattactttaaaaaatgtgttgaagatgggagttaaattgttttggaatttgccactacataaactatataataggggcagatatgagcagtgtcagattaagcagagacaggctccgtggccaggaaggcataaccatttgcggcttaacacagccaaaaggtcagaaagggggttcattcgagggagccaggaaacggggcctgaagcaagacttggcagtgacctcctaactttatcagtgaaaagaaggtgatttcactcagcctgctcagtcctagggctcagtagctttttgtggagatgactgcatagcacccctcttttcaaatacagggtggaggaaatcaaaatatctcaaaacatccttctcggacatattttgagatggatgttcagagggccagcagatagaagtagccatgcaaagctgtcttttgtcggggagatacacatctgcagagaaaatctgcattgatgtagccaggctttctccaagggcctcccctgtcctcttccagatctaggaaagattaaccgactgtcgacacctttgaaggtctgaaagaaacatttaccatctattctctctgagggcggctacctgtgagatttcatctacataacaagtgatctttgctagccagggctcctcttctctccctcccataatcacaacctgttttgccacaatccaagcccccattctttctgcaacctcaagatggtacataagcttctgaaccccactggggagttgggataatcactctgcagttttcccccatgcacatgttatctatgaacagaaggacaagttagttaccctctcctcacaacccacacctcaccaacaagcaagccatcaattttgcagcagactgaagctggaagtcctctaattcagttccactctgacactctcttcctggagatagcgtcagatcccacaggttgagggctcagtccccaagaatgccccttgcttctgacgcgaattacaagtcccagtttatttcacctgtgcttctgacagaccagctggaaattagagatcccatgatcccctgcttgagttcaattaatttgctagagtggctttctgaacctagggaacacttatgcttactggtttattataaaggatattacaaaggatacaggtgaagagatgcatagggtgaggtatggaggaagggttgtggagcttccatgaccttcctgaatggctccaccctccaggaactgccacatgttcagctatccagaagctctcagaaccctatcctcttttttttttttttaagcttcattatgtaagcatgattgactaaacctttggccattggtggtcaacttaaccttcagcccctttcccctccttggaagttgaggggtagggctgaaagtcccagccctccaatcatgcattggtcttttcagcgtccggtccccatcctgaagccacctagggactgccagccatcagccaactcattagcatacaaaaagacatcacttcggagattctaaggattttaggagttgtatgttaggaaatgggatcaaagaccaaatatatattctacaatatcacaggagtccttgaccaaactagataggccaggtctggcagactgttgctagctttacctcatctttcaatttttctagagaagtcagatatctgaacattaatgtgaaattttccatgtttaaaaaatactgcgcaggccaacaaaacacatcccctactcagattctgcgcatgggccaccgatttgcaagtggcatgtgctcatatgtacttcagatcaatacattctaataccgaggcaacttttttctcagtaatctaaatttagggaactattctcagaattgcccataggtcttatataatctgaacatcacaagagaactcaaatgactataaccataatcgtagaactgaactgtgtcattcacatgctgtcatatccatcacatttccaactcattccaagcaaatcctcagctgatcctgtgtaagggctcactccttccctatgtgcgttctcatcatttgatgaacttaactttggcaaggagctagaagacttagctcttgacaccacagcatgagatgggaactaaattggtatatgacttgattcttgggcacagcagtttatgtttttaaccaacactcattccagaagtagactacataagataagtagcatacacacatatgcatttcttaaactaccgatttaataattcattccccaaatacttaatgattgcataccatgttacagaatctatgctaggggtcgagcacacaatatttagacacatgcacacgtatgtttattgcagcactattcacaatagcaaagacttggaaccaacccaaatgtccaacaatgatagactggattaagaaaatgtggcacatatacacatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggcgattgttgtggggtagggggaggggggagggatagcattgggagatatacctaatgctagatgacgagttagtgggtgcagcacatcagcatggcacatgtatacatatgtaactaacctgaacattgtgcacatgtaccctaaaacttaaagtataataataataaaaaaaaaaaaaaaccagccctgaaaaaaaaaaagaaagaaaaagacaacctggtaccaaacctcaaatgcttttacccaacagcagtagttctcaaaatttggcccccagatcagaagcatctgcatcggccactgagaaattgttagcaacacaaattcgtaggccccgcctcagaacctcagatctactgaatctgagagtctgggaaccaggctcagcaatctgcgttgtaataagccctccaggtgattccgatgcaagctcatgtctgagaagctcatgtctggagaacatctgggggtggggaacaggggtagaattcaaataaaaaacacaggagactgatttacacatagtggccagaaaagcatctcttaatagatgacagttgaacctgaaaaatgaaatggagtcagtccttgaaggataggaagaagaaaacaggatgagtggggaaaacattttagggagaagcggcacacagcagtgaccttgtgcagacaaagaagtcagcgtatgcaaagaactgatcaaaagaccctctggctggagcccagcaaatgagaagagaatgtaataagataagattgaatcaatgactccggagtagatctgaggtgcagagatggcaggaagcgaaaggatgaccctgacggacaagagctggggctgagaatggggaaaagtttatgatttcagaagggagggagtcactctgtagctgaccaaggctgagataggcagggccagagattttgggtgtaaaaacttcctagaaagtgcctttagcgataattatttgcagacagaattatcgtgaataagtaatcagaagacttctgagtttttgaaagactgtactatccaataaaccacatttccaagcttcaagcccctgccagtcttcagattgcaagagaaccctgggccccaaagcttatgctgactatgcagtgccaaaagcagcatattctgcaatgtccttttttgggtaaggtcatgaataatgtgctaagaacaatctcttgaagggatgagacagagggcacaaagagagtgaacaatggaattccttccagaaggcagaatcaggccccatggagtaaaccccatattctctactgccagcgatgggaatctgttattcttgaccagtaaaatgtgttaattgctatgaaatactttctggcctgtgtttcccatcctcttcctctccaaatgagagtttttattacagtttcctgtgccactgctccattgaatatggggtaatacagggcatggataacctgtcttttagtttgtcagtcaccaaaataagaaaagcaatacacagacccgggggagaggacgtgaatgacacaggcattctggacttcagttcagatgcagtaactggttagatcttcgggcttgcctccttttgggagcaggtgagtgtgttatgtgtggggtgaagaatacatacaaatacgtgtttggccgggggcagactgaagcagattgttggatttcctccagtattcgttcttctcatctttcaatgtaaataaagtcaccaacttctgactgagcatacgccacctgggataaatgccaaatttcccagcctgccttgagatccggtggggtcatgtgactaagatctggccaatgtggtaaaaacgaatgtgtcatgtggcatcaaccaggagatttccacagggacagctgtactctttggtcctcctctttttttttttttcttgagacgagtctcgccctgtcacccaggctggagggcaatggcgcaatctcggctcactgcaacctccacctccttggttcaagcgattctcatgcctcagcctcatgagtagctgggattacaggtgcacaccaccacgcccggctaattttttgcatttttagtagagacggggtttcatcatgttggccaggcttgtctcaatctcctgacctcatgatcctcccgcctcagcctcccaaagtactgggattacagggatgaaccaccacgcccggcctgatccttcttttatatttccccttcctctttcctgctgtcagttacccaaatattacctcggacaaagagccaggtctgtactcctggggtggtgtggtcatggaagctggaaggggcaactgaaaacatcttggagcaaagccttcagactgcatgtcttcaagactcttgtgaaaaaaatgaaaactgtttatttggaatttctgttatttgcaaatgaacttatcttaaccaatatggactcttggccactaaaagtagcttaaattttactccaaatgcactagcaacccatgagagggtttcaagcattgagcacaataggctctgctgtgttacaatacttttaactctgcaaggaatgatgagaaagaggatgggggtataggccatgtggaaaatggcaccagcaaatatggtggattcaggagggataaaggggggacatttttgataggttttagaggtaacatagtattttttgataaatttgatgagattgaagagaaaaataaaatattatctatatctcatggataatacaagtgatacttatttttatcaagttagttgacaaatagaaatttctctgggaaattggaaatatatgcatggcagatactcactagggtggctcccatgattcccgccccagcatcagtatctttgtgcaatctcctcccctcgagtgtgtgctggacctgtggcctgctttcaacaagagaatatggcaaacttgatggggttatcactcccctgactacgttatgttatatcacaaaggttgggggattttgcagattttgttcgagcccctatagagttaataaaaaggaatatatatactgcatgggtctgacctaatcaggccctttaaaaagcatctttctctctctctctgtctctctctctctctccccccacctccccacctccccaacacacacacatagagagagcgagagagagagaactaggccaagagcccaatgagcagaggtagaagtcagagactgcaggcagcaattactctctctccattgctggtttggaggaagcaggccaccatgacttctacagctgcaaggagatgaactgtgcccataacctgaagaagctaggaagtggatcgttcctctcagagccttcacataagaatgccacctggttgacatcttcatttcagccttgtgagaccctaaacagaggacataaactgtccccagactcctgacctcctgactcacaaaaactgtgaagtaataaatgggtgtttttttaagtcactaaaaagtttgtagtaatttgttctgcagcaataggatactatacatacatacatttatacacacatgtaatatatatgttatatacattaacatgtcaatgtagaaaatgatatacatgtatctatatgtgtatgttccttaagtttatcctccttaagaaaatcaagtccttttttcatccacaaatgcctgtgaatgtgacaatgtatgtctatgtatgtgtgtttctttttttttttttttttttttttttgagacagagtctcactctgtctcccaggctggagtgcagtggcgcgatcttgggtcactgcaaccactccctcctgggtgcaagcaattctctgcctcagcctcccaagtagctgggattacaggcacccaccaccacacccggctaatttttttgtatttttagtagagacggggtttcaccatcttggccaggctggtcttgaactcctgaccttgtgatccacctgcctcggcctcccaaagtgctgggattacaggcgtgaaccacccgcacctggcctgtatatgtgtttctttaggctataattgaaaacagaatattgctactttgactttactgatggctagtataagatgaggtcatttcttagttataaaattaggaatttacctattaaacagaagaaattcaattgtgtttcatatatgtacttgtttctgtgtaagaaatcgattatgtttcttcctatgtatgttcgtatgcgtgtgtgagtgcatttataacaagcatcctcaatgcttaggagggttctcaaccagccaatttctcacattacctcaactgagaacagatagctgcagcaataaaagaatatactcagatctcggtgggtatcttagagacatccctgatgaaatctcacaatgactctgggatagctaccctgggctcccttttcagaagggccaccgtccatcagcatggtgggggatcactatggccattgactaacagagacagcagcaatctcatattctgcttttggaattctcttgacatgctaattccatattatcaaatatatcacgggtatcatttagacttttctgtacaatgtgttccagtcaccactccgacttttgctttcaattatttcccaaagatttgaaataacagataaacttaattttcatttatatgcctttctctactgcctacttccttttatttgtcaaatgtatgataactctttaaaattaaaaaaatacatattttacaagtaaaatctgcatgaatcaaccttgagttttataattaggtgcaatcatgatttaatgtgtttagattctagacaacttctcaatcatcctaaagagatacacattagccttatacggagacagaaacagagaaagaaggcctgcaaatctcttacgcatttatttttataaacatatattataaacttactatgtatctgaggcaccgtggtggggtgtatagtctatgacctcaaggctaccatgttgtcatggaagaggcagactggcagagcaatgatgcaattacaaataagagctgatgtgcaaaaggctgatggagatctggagggagcagtgcggaaagtgacttgctgggcagtaggaaagatttcactctatttttgtagcacaaacacaaaatcaccccaattcctggggtaaaaattatttatgttgcattttaggtaaaccaatagtattcttaacagtctttaatttctgttttcttctttaaactctactgcatccaagcctacagaggactcaatagtagaagcaataatatcatcattttaggatagtgagacgtgattggtgataggagtaatctaattagacaagcaaaacactctggagtcatttaatatttcagtgtaggagctatcagtcctataaactttaatcatcaggaaaaaaattattgctttgctgcacactttgtgataatagccatgagtcattaaagtaaggttcaattatgttcattatgttctatttaaaacggaaagaaacataccatatttagaaatctttctgtccaatgagttatctttaaatactacctaaataggtgaccgtttcaaaatttcattcatcaaatatgtcatttgttcataatgttggaaaaataaaatgccaacatactaaaaaaaaatcacattacatttaaatagttgatagtggtctctaaagttttttcctaatttctcagcataattccataaggcagacattgtttccattgtgccactgaagcaactgacacagtcacttaaccttagtcatgtaagtcacccagttcttttaactcctataaatgctctttcatttatccatctattaattcaatagactcatttattgagcattcatatgacccacgtttcataaaataaaatggcagacagtttaggtaatcctgtaaatctacaattataacatgattcaaaatttttctggaggtggattttctagtaacaagtgattcctagaggactttaactcactttacaatgaaatactacctgccatttaattacaccagggaatacttcgggtattttgagagatagatggattaagtcggtaccctatccgtgagtgacacaggtccacgaatgggaagaactccagctttctctgtatgttcctcacataaccagatactttaaatgactttgtaattttttgttcatctctcagttcagcaggtgaaaaaacaaaacaaaacaaaaaaatcaaatcagtcagagctaacgcatcctgtggagaaacaaaaggactgactctgtttctttcttcaatgggctgtttgatattgtgtagatttagtgtctgtgctcttcttaaaaaattccacttaacgacccaaaaagaagagcattactttcacaatttaataaatggaaaactgtggaatagaaaggttaagtgagctgattatgctcagacaagtccttagcaacatagcatttctctgccagagattacatgagaagctgcctttccatgattcccattgtttatgcagtcattctgtgttgtcaaggcactttttgatttttgtcttctgtttcctaattctgccaagttattctttttttaaaaaaggcacagcacacgtggcaatctaaaatccagagtttttcttggcatcactgattatgcttttggatgaatgaacacaccgacttggatgaggaaaatgcaaaagaaaaatagtaaaatagtaaaataagagaagtattatgttcaatatttgaaataattacagtcactcaggaaaaaaataagagcatcttaaaatccattagctaacaggactaggagggcaaagaacagcatgaaacagctattggaatttataccttttttttaaactcacagactaaaccaagataccattcatagtttaaggctagggggatagcaaattggcctcacattagaaagaattgtccaggctttgaattgatagcccaaagacaaaacaaatctggctgtgtgtctaaagtcagccttgattttgatgtcagttaatttgcttgtgactttgaaaactttaaattgttgccatctttaacccttgagaaatgagtcatctgtttctgtaaagtagaaaaggacaaaatcagcaagaaagaaaattttattttcaaagttcaaagagaatgcaataagtagtggagatgatttaccagtaactgtgctattgtttttctcaagagtttgaaatactctcttaaggaacacaaaaagcaaacaattttaagaataattgtagaagtcaggttttctttctctcaaatttttgcaacaagagaaagccgaggaatttgcttggcataactataaaggaaagcatagagcagctattgcaattttttttaaagacatgattagaccaccttggtatcttcaatacagtttccaaattattttccttgtaataaataattcatgatcagtattattatcctaatttttcaggtgcataaactgaggcccataggtttttatatcgctcaacaaagtgactggtttccaaggtgaaggtctaggatctgagccctactctgtgactctgtgaactccatcctctgacctctactctagctcacttcttccagtgaatcttcatactttgattgcctgcattgtactttcttttcctatacaaataaagatggcttgcctgtcttactcaggtcatggagttgttataaatatcaaatatcacaatgtatgtaaacatggtttaggaatttaatagtgaagagtttttattttaatgcatatagaaagcatgattgattagtctgaaactggttgtttggatttagagcagctattttagtggtaatctgaaaactacctgccaaacacggtggctcatacctgtaatcctacaattttgggagatcaaggcaggaggattacttgagcccaggagttcaagaccagcctgtgcaacacagtgagaccctggtctttacaaaaaacaattagctgggcatggtgctgtgtgtctgtagtcccagctactcaggaagctgaggcaagaggatcacttgagcctaggaatttgaggctgcaatcagccatgatagcaccattgtactctagcctgggcaaggagcaagaccttgtctctaaaataaaaaataaaaagaaaattactaacctttgcttcctgcccctaccaccacttactaccctcccatagtcaagctggagaattccagagatttatagtaaatcttccccatattcccattcttccaggacacactcagctaccacacctacccatactttacctggaagaaggatgagtgtgaaagcaccattcatgcttctgattgcattttaacctaacactcatgatatacagagtttgaccagtcaaagatgcaaatcattcccaaatgtgctgggttcctgtgtttaatgagaattataggacttgctatccaccttgaggtctgctggagataaaccaaagaaaaatatgagcaacagctctttttcatgaataggttgaaaacttgcccaataattcttagcagttctaggacaagacccaattttctacttgcagccttgtttgaggtcccaggttgaaaaaattaaaagtcagatactgaagcaccccaccaccttgattcacaaatgcagtttctatgtgttacaaccagaatcaggatgcaagaaacttcaggacaagaaaacttgactttgtccaaagtgtgattttgtcagagattaatgcttctgttcccaataccaagtaagaaattgattggttcagatccacagaatgagaatgaggaggcactgatgctgctgagaactcagtgcattgcatgtcacacctaaagcacacatttatttttaaagatctcaactcaatcattctgtttgccaggcactgggctgtgagctttctatgaagtattttaattaatccttaacaaacactttttatgtgggggctatcattttacacatgaggaaacagctagtggatccaaagctagaacacaccccaacactgggctatttgcaaaaagttagcaaaaagtacgtatctggggacaactgcttccttctcccctatgcctttgtgatcagaaggagtatttctatgagaggtggtcctgtgagtgtatgatgaacacttaaaaacaaactataaagctccttttagtgtgttcagaagcgaaaatgttttctatgtgttactagactccaattcacagaattttgtttttttttttttttttttttttttgagacggagtcccgaactgtcacctgagctggagtgcagtggcgcaatctcggctcactacaacctccgcctcccaggttcaagtgattctcccgcctcagcctcctaagtagctgggattacaggcgcccactaccatgcttggctaattttttgtattttttgtatagacagggtttcactatgttggccaggctggtctcgaatgcctgacctcgtgatccactggccttggcctctcaaagtgctgggattacaggtatgagccactattcctggctcacagaaaatcttagaagggagatatatgagaaaagagaagggatcattgtctcctattacacattggaagctataacattctctagcatttttataacataactgaaagcaaagcttagaagtcagtggtgggagatgagttcgctgctacagtgtaggtacttcagccatcacagatttggatgggacttgtctggttctctgagtgccagcttccttggtcaaggctccatgaatggtctcccaggactccacacatacagaagaggtcaaccactgcagagggaagaccaggctttattccaaggtttatgagttgttgcaggcctcaagatgcttggagactaggaagggaagtggacatctgtgtcaatgccagaatgctagccagaccatgataaataccataagagggcactaggaaaatacaagcattcacagaaaggagtgtgcagagccatggtggagggaaatccaccacagagcagggagaggggcttcagctgtcactcagagttaaacctggaaaaatcagatgtctacgaagactgaactttatttagcgatgggagcagcaatagttggagaggaggaaaaaccattgcaggaaaaaggaacagctacaatcaaacacatcaagacggaatgtatgggacaagtgcagaggcccatttagctaagaagaatagtgaacgaataagaacagctaaacatttaaagagcagtgattctttttgcaagtaatttacatgtagcatcttatttggtctgctataaagtaggtgctatcagtataaggcaagaactatcactatagccactttacaaataggacctcggacttaccacctttctatgagaggaggtcctgtgagtgtatgatgaacacttaagtcaactggctaatctgcctagacagtaacagagcagatgcagcctgctcccaggtcccctttgttattatgacttccttttaagtacaatatgggagataaggttgtgaaggggagttgtggccagaagtcaagagtcctggaacattatcctaagataggatcgagaagcatagaaagccttgaaaatgttcaacaggagttagatatgatcagagctgagctttggaaagaccgaagctatccaggacattattttaaaaactgagttactagtttgcttgcttgcttaagcccccacttcaaggatgaagggaaaagtgctgatagttatttctgggtcagtgtcttctgagccagaatcctcaagtgcatttccccactccctctacactcattttagttgcctagaagagtcttacaaagttttctaattggctgaggatcctaaacccggaaacaataaatgaaagtctgagatttgggctcaatcaatgtcacaggaaagaaggcactggggcttatatttttacataaagatgctgcatttggggtagtcaaagctcacacattctgcagtcacccccattacaggaaatggtgggccttggatatggctgactgtaatattaactttatgaggaaacagactctgctctgaagacttatgacctgagggaaagatggacaaacagaagaccaaggcctcatggtgggctcctctgatagcctcctgtgctgctttcctcctcagaaatactgaggttggacgtgaggcactcttcagcaaaaggacatttctgcctttccagcactaaaatggccatgagtaaaattgatatgtcaccgtctcaccaaagtgaaaaactgaagcggactcctaaggccacgcatggagcaaaactgtttatgcaagaagcatttactgagcacctgctgtgtgctctgcttgattgacttggatgagaaccatgaacaatatgaacaagtgccctgccctcaagagtcttacattctagggcaggaggaaagacacctgtaacaatcaagagataataaaatgtctgtgaaagtaaaatcagatcaggtcataaagtaacagagcagtaggctactccacagagcttgccaaggaaggcctccctgaagaggtgatgtgtgagcagacactggagtgacgagaagaagccagcgtgcaaagggccaggcaagcacatctgatggagagagttcagcaagtataaaagcctcaaggcagggaatgtgtttcccatgttcaaggaaaataaggaacaggagcctggagcgtagacagggatggcatgtacaacagaaaatggaagtaaagggggccccactggccagatcatctagggccgtatttataaatttgggttttattgtaaatataagaagccccttgagggttataaacagtgatgcgactagtgatattaatagtattaaaataggactgtgcatgttgagtgcagaatgaatagcacagaagcaaatgtggagacagagagaacactcaattgggtactgcagaagtttaggtgaaaaagcctggtggttttgactaaaggtggcaatggggaggtagaggaatgagcagattcaagatacatttttggagacaaagacaacaagacttcctagttgactgaaagggaggtgggaatggagaaagagagagtgattaaagataattactaggtcttagtcttaagcttaaacaactgattggaaagtgtcatttgctgagtcagggaaaagtggggaggaaaaggagggtcgagaagaatccagaggtccaactgagttgccttatgtttgagatgcttactggtaaaaagacagatatgtgaattaggtagttggatacataagtcaggagtctaggacaggaaaggcacagtggctcattcctgtaagcccagcactttggaaggccaaggcaggaggtttgctcgaggccaggagttcaagaaaagcctgggcaatatagtgagaccctgtctctacaaaaaagatagaaaaaaaattagttgggtgcagtgacaggcatctgtagtcccagctatttgagagactgaggtaggaggataacttgagcccaggcatttgagattgcaataagctaggatggtgccactgcactccagcctgggcaacaaagcaagaccctgtctctaaaaaaatgaaaaagtaaaaaagaaaaaagaaaaagaaaagattctaggagacagttgagatcgctgagggttagagacataaatttgggaatcgtaaaaatttggatgcatttgaagccatagaaccagctgtgatcactcagggagagattaaacatagagaaacaaccagggcccaagagtaaacccagggagttcattcagcacctgtaggttcgtagaaggtgaacagtcagcaaggaccaagaaagtagaaggaaaaccaaaagggtacaagaacacagaagccaagaaaagaaagtgttgtttcaggaaggaggacatggtcaacaggatagagagagtgattaaagccaattactaggtgacatgttgcctaagataaaggcagttttgagctccttcaaaggtatctgtttcctttgttttgatattgtttccaaaaactacatatcaggtttgatacgataccagaatgcagttaaaatgtaatcagtttatttactcaagatgtgtgggattatagaaacattttatcaattaccatttccatttataacttgtgcatcagttatagatcctattgtaagattgatatgcagccaaactgtgctatatactttcagtgttcactgtgtaagatactaaagggcttattacactgtagcccagcctaaagacacatgctaattatcttccatcatggtgcctgcactggctgtacttctactgaattgtaagctctatcatggtgggcacgtgcctgatatgttcaatcaaacaatagtttaatgtttagtatgtttgtttgtttgttttgagacagagtctcactctgtggcccagattggagtgcagtggcacaatatcgactacctacaacctccacctcccgggttcaagcaattctcctgcttcagccttccaagtaactgggattacaggcatgcaccaccatgcccagctaatttttttgtgcattttaaatagagacggggtttcaccatgttggccaggctggtctcgaactcctgacctcaagtgatccttccgcctcggcccccaaagtgctgggattccaggtgtgagccaccaggcagattttttaaactttggctgataaagtgatttaatcattaatcagtcagtgttaagagattagccctcccattggacatgctgaaaacaggcagctggcgactaagtgaagtctcacaggcagaacatctccactaaatcacagtctagctccaaggaccccttgttattcataatatttactgcatatttagtccccacaagctcatgattaattactgcacagattcggatggacaacatgtgacctacagtttccctctgcacagtaattgtagagggaaatgtaataatacccagtcagtctaaaaagcctattagtccaattctccacaaaattccatgaaaatataacatcacagcctgttgacttccaagaaatagtttaccaagagttgccataaacattagtacattttagttttagtgatagggtacttggcaaatatacataaaatcatacacacatgaggcactttgataggcactgaaaaataaaagacatacttcctgatcttaaagagtcctaaaatctagttgggtagatgcttttcataacatgaaaagctaactaatagttagacattgaaatgagaaaaacgaaatgttatgaggttctatagaattgacagctattgatgtgggccaggtatgagatggatatgaatcttcagtggaatctctgataaacacagaaagtgggccgggcgcggtggctcacacctgtcatcccagcactttgggaagccgaggcaggcggatcacgaggtcagatcgagaccatcatggttaacacagtgaaaccctgtctctctctactaaaaatacaaaaaattagccgggcctggtggcgggtgcctgtagtctcagctactcgggaggctgaggcaggagaatggcgtgaacccgggaggcggagattgcagtgagctgagatggcgccactgcactccagcctgggcaacagagcgagactccatctcaaaaaaaaccaaaaaaacaaaacaacaacaacaacaaaaaacacagaaagtgaaggataaacagagtaacataaagtatgtgtgtgttttgttcttcctcaaaataaaaaattatcagtcctagactattttatgtgagaaacccaccttgacacctgtttctcattgtatggcaactacaaagaagtataatgctgaacagtgcatctctagagaacagcttccatgtgggacagtgtttccaaacagagaatacattttctatccctgtaattactcttctattataataagatgtcctttgacacacagaatggcgttgtagaggagcactagatcaagagtcaaagggtttcagaactcctgactctgctgtgaatttgatgtgtgtccttgccatggataggacagcagcgcacgggagtcaagagctctccagacatacctgtcattcactatttgtgtgattgtaggcaaggcatttcagctttctcagactttatttcatcatctataaattgggaagaacagtgtctccggaaactccaatgcatgttagtaagtgaaggaagccaatccaaaaaggctacctactgtatgattccaactacataacattctggataaaggcaaaaatatggagacaataaaatgattagtggttgtcaggggttagaggagagggatggatgaatcggcagagcacagaggatttttaaggcaatgaaactacctcgtatgattctataacggtggacacacgtcagtgtaaatttgcccaaactatagaatgtacaacaccaagagggaaccctaatgtaaaccatggaccttgggtgataatgatgcctctatgtaggttcattaattgaaaaaagtgtacctctctggtggagtatgttgctaatgggggagattatgtacatatacggatacggggtataggagaagtctttatagcttctcctgaattttatcgtgatcttaaaattgctctaaaaaataaaatacatttaaaacaatcataaaagaacagtacttcggccatagagtagtaataattaaatgcgataaatatgtaaaggacagcacagagcttcctaaatagtcaatgttcaataaatgccagctattactctgatcctgtttcttagcatacagcagatcaaaagctgctgactggaattaaaggtcagagctgctagaagttatactgatggtggccagatgttacaggaggatacagaagaatgctaggaaggaagcatcagaactcaggaaacatttcttccaaggctatacagggagggagcaaataatggtctctttgttttttgttttagacactgggtctggctctgtcactggggctggagtgcagtggcatgattatgactcactgcaacctccacctcctgggctctaacaatcctcccacctcagcctcccaagtagctgggactacaggtgcaaaccactatgctgagctaatttttaaaatttttctgtagagacagggtcttgctttgttgcccaggctagtctcaaattcctggcatcaaacaatcctcctgccccccaaagtgctggaattacagatgtgagccattcctggcctgctctctatcttaacagatcaggaagcatcagtaccgtgcagagtcacaacctatagcattgtgatgtaagaaaagcaggaacatttgcctaagaagggctgggttggaattcttgctctctgttggtcccgtgctaattctgggtccttgactaagtccattcacgtccctgaactggatccctgccatcaccatgcgcaataggcacagctcagctactgtccgctctacctcagcagacaggactaggacctttctggcccagcccatcttgttgtaaataacaaagcatgccccataggactccaaagaataaaaaatcatactccatttgtcacagctgtgataatcactcacttttgctctaaaaatggagacagtatgcacctcaccaggcaactgagagaattgaatgaagtcatggcttacaaagcatttgggacacacaacccccagctccgtcaatgttagtgtggctatgaatgttttctaaatgataattcacacgctcaggtgccagcatagagctatacttgctactattctgacctgggtattgtgcctccgttttgaaaattgagtattcatcccgttcctgagccttagtttttccaggtcttatgaactggcttcttcctaacccggcatctcacgctttttttttttttttttttgagacagagtctcgctctgtcaccaggctggagtgcagtgatgtgatctcggctcagtgcaacctccgccttgcgggttccagtgattctcctgcctcagcctcccgagtagctgggattacaggcacatgctaccataccgggttaatttttcggtttttgtttgtttgtttgtttgtttgttttagtagagacagggtttcaccatgttggccaggctggtctcaaactcctgacctcaggtgatccacccgcctcagcctcccaaacgtttttctttttttttttttcttaaagaaagaatggaaaaatgcatacataccgtgctctggtccacatttatttgctttcattttggtaatcctctgggtcctgctgtgtgcttgctagtcccttatccagagcctgaagcccagactcagaacacagtctgctggctgggttcttctcctcattagagatcgcccaaataccactctcattgcttggacatacaagtagaccatgtcccacctctcaatccttgaacttcgttcatgtggtaagataccctattacactatttcttctgaaaatttccattactaattgtttccccgcataaatgattgcagtatgatttggttgcgtgcctatctatggcactcaattcccactatcagcacctgcaaaaggctcagctcagtcaccacgtgctccatctgaataggcaggactagaacctttctggcctggcccatactattgcaaataactaaacaggccctgtagatacccaaagtacaataaatcatgctctgtctcgcagctgacatttcccctggaattcaacagtctagatatatcaagtagatgggtgggtcaggtctacaagaagtctatctacatacacatggtattgaaaagtctcctgtgcggaaaagtcactctcagagaaaaaggagtcaaactgggtcaagtacaaaacttatactatagagaagagacatgcttctatgagttcaaatctgttttccagtctaggcctcccacatattcccacctgaattctagtaagagagtaagagaaagaggctctatgtagtaaaacagtggaatgcactgtagggccacatgggaaacatttggaaaagtaaacagtaaggagagaggggtattccctctacttctgtaccgccttggcacacgaaggacatcagagaacctggcatctcttaggcattcaaagcacattggtggcattatcgtcaggaaagagacagcagcagctaaaggaagtgacagcaacaccctgttgggcagatggacagaacaggagtcgatgggagtcagaactaccctctgagagtagctcacctgtggatcctggaagcaaaggcgaggcattttcatgcaactttgcacccatcaacaacagagaaaggaagcttataccaggaaaagtagagaaataatgaatgtcatttattcagtgactggattattattgcactcagtgataataaacatcctgcctaattgatcagcagaaaaaaaaatgtattgagtgaagtagtctagggatcatgactccacaattattcattgagctcaagagccaataaaaacatgattacctagccactctgttgacgacagcagaaaaattatattcatgtattcatctattcatcatttaaaaataacctgtaagtacctaaccacacatcaggttggtatgacaaacaatgtggaaacagatgattaagttattctccaaaggcatctcataggtaatgatatgcaggttgagcatccctaatttgaaattcccaaatcggaaatgctccaaaatccaaaactttttgagtgctgacatgaggacacaagtagaaggttccactttatttcctgtttcacacataagtacttaacacaaactttgtttcataaggatgtaacacaaacttcatttccatttatttaaaatattgtataaaattattttctggctatgtgggtaaggtgtatacaaaacatcaacaaattttgtgtttggatttaggccccatcccccaagaaatctcattatgaacgtgcaaacattccaaaatccaaaaaaaaaccccgaattcaaaacacttttggtctgaagcattttggataacagataggcaacctgtacaatagaatttcaggttccatgacagaaatatatttgaagagctataaaagcttgaattaatctactgaggaaaacagcagttcatagaagtttgactgaggaagtaacctttgaattggacattcttaagcagaatgaaggcaaaagaaaatattatggaagtggacttttgcaggaggtaatattctaaagtatgtccacaacagaaaaatcaggtaaagtttattcttgtacattccttaaatcatccatgaaatatacatgaatttgtgtgtataaccttatagcatttttaacattaaactttgagaaccactagtcaggtctaaggacatcacaagaaactgtccacatggtctacgtataaagatcattctgcttttaagataacttcttaacaagaaataaacagaaatttctattgtttctatttgtctgaagggtttactctattttattttaatatgaaatctctatgaccacctaacaacagaggttcaaaattcatgaagcaaaaactgatagaactgaaaagagaaatagaaaaatccaaagtgatgactggagatttcaatttcaaccacaatttctctgcagttaatagaacaaataaaaaataggtaaggatatagaagacatgaacaacagtaccaatcaagtggatctaatgtctatagaatattctactcaacaagaacagaatatacatttttttcaagtgcttttagaactttcaccaaattagaccgtattctgagctataaaacaaactttaacaaatcatgaaaactaaaaatcatactaattatgtttcctgcctgaaagatcaaaatagagctcaattacagaacaatagctggaaggtcctcaaatgttgtgaaatttaaaaacatgtttctaaataaccataagccaaagaagaagtaatgaaaaaattagaaaatattttgaattaaataaacacaaaaccacaacatattaagtattgtggtatgcattcaagacacagcttaaatgaaaattaataccaccaaatgcctaaatttttaaaagagcatctaagtttccatcttaataaactagagaaagaaaaacaaattaaacccaaaacaaacagaaggaaagaaataacgaagttaactgaagatatcagtaaaattgaaagcaagaaaacaaacaaaaccaacgggaaaatcaaaatctggttctgagaaacaaatgaataaaactgacaaatttctagccagattgaccaagataaacagagagaagttacaaattatcaatatcagggaaaaaatgggaaacatcacaaagacagcatcaatatttaaggaataataaaggaatgtcacaaactagatacttaaccacactctgactcactcaaaaacattttatgctcactcaaaaacctgcttatgaaagtttatagaggatttattcataatttcccaaatctgaaaacaatccaaatatccttcacctggcaaacagataaacaaatactggtacattcataaagtaacatagtttcacattttgattaagtccaatttatcaactgatgcaaaagaccacaagaaacaacatctaagattgttttttttctagcatttttacctgattgctatggctcttcttcaaacttcttttccctcaaattacatttcctaaccatatatatatatattttttttttttttttttgagacggagttttgctcttgttgccaggctggactgcaatggtgtgatctcggctcaccacaacctccgcctcccaggttcaaacaattctcctgcctcagcctcccaagtagctgggattacaggcatgcaccactacacccggctaattttttttttatttttagtagagacggggtttctccatgttggtcaggctggtctcgaactcccaaactcaggtgatccacctacctcggcctcccaaagtgctgagattacaggcgtgagccaccgcgcccggccatctaacataattcttatccagtactagcatatggctatgacaatggattcaatgttggataagacagaaatgtaagcagatgatgggtcttgaggtcttttgcgtcaactgttcatttgccaagtaacatgattcactcatattattctcatagaaacttaagctcccttaataacaaatcctacatacttctccagaatgccaaacgagaatagattttctagtttagaaatgagaaaattgtgacaatttttgaagtactgaaaaggttataatcagaggaaaggacccagtataaacctctgtgatttttttttaaagaaggcaaaaaaggaaaggcagatgttgtgaaggagtgaaaagagaaaaagggagagtgtagtgttacataaaatctcaatttaggctgaacatccaccaagattctactggaaatcaagcattttactctcatttcatttccctaggaatcctgtgaagtaggtaatagctctccatttatagatgaggaaaattcagtttagagtgataaatgacttattcaatgctacattgctagttaagtgaaggaggtaagatttacactaagaattagagattatacactttttttcaagtgccacttttgggagaaaaaatgattaaatatcagtataaaagtattattttgaggaaagaaggctccttaaaaaggtactccagttgtttggaataattgcagtctcgtttcagtctcagctctatatgcagtacagctcaataaagctctaatatgcagtacagctcaataaaggtggaatgccaaagttctcatcttttagcctcatggctgttgtcccacttaagggacacagaatggctttataaagaaattaacattaaccaagtatatactgccacttatctctcttgcctcatttctcaataaagaaacctgaaagttactttctatggctagcttcaccttgaagcatgtttgttttatctaataaaggaactgtttagcttaattccattactgattttggtgtcagatcacacgatataagctaacaaagatctacttcactgattgcattgcaacattatctgaaaataaaagtggggtaggaagggaaggagaagggagagatgaagagaggatggtaaatgggtacaaacataaaactaaatagaaggaataagttgtagtgtcagcagagtagggtaatgatagttaaaaataatttactgtatatttcaaaatatctagaagatatttaatgttcccaacacaaagaaatgataaatgttttgggagatggatatccaaattaccataacttgatcattacacattgtatgcatgccatcaaaataccacaggtaccccataaatatatacaattattatgtgtcaataatgaaaaaaagttagagttttatataacttctattatagtccttttcttttatcctcacacacacacacacacacacacacacaaaaagagacagaccttaaacaattatacagaaagttgtctacaaggatgttaagagtaataaccaatctactttttaaatagttgagtgggttttcagaaaaaaaagtattcaataaacaggaaatatgtgcaagaataaaaagagaaccttaattataattatgtatttcttttcagcagagtgttaaactctggtaatagaaaaaatatatttttttcttttaatccatggacattttatttacaaaatcttatgatcataggtttattaatgatcctcagacgttttactacaaaaaatgcttgagattataaaccacgacagaaacaaataaaaccacctcatgatagtcttggaacactaagaaaaagtcctaagactaatattaattgacttctatggtcaatggttctctgacattattgtgtgaccttaggtagtaaattagccactccacaaatttgtttacttatttaggaagagaagtagtaagaattcctttcctattaccacctcaaataattattgccaaattatatgaggaaatacacaccaaaatactttgaaggcttcgaaattcagcagaacttcaaactatcaaccaaacaatatacgagtgctccagttcctctacattctcaccaacatttggtgttgtcacttttgaatttttttttgagacagggtctcactctgttgctcaggctggtgttcagtggtgcagtcatagctcactgtggtctcaaattcctgggctcaagcgatcctcccacctcagcctcccaagtaactgggactccagacacatgccaccacacctagctaattttatttatttgtttatttttttgtacagacaagagtctcgctacattgcccaggctgaactatttttattttactgttctgataggtaggtatgtagtgatatatcattgtgattttaattgttatttccctaggtgttggacatctttttatgtgcttatttgctatctgtataactttggtaaaatgtttatttatatctttgcccttggtctaattgtttgcattcttactgttgtgttagaagttctatagtctatattctagatactagtcctttgttagatatggggtttaccattattttcttccggtctctagcttggcttttcatccttacttaacaaagtctttcacagggcaaaaggttttaattttgataaagtccaatttattcactttttcttttataaatcatgctttcggtatcaagtcttagagctatttgcctaggactagattctgaatattttttgctttttctttacactttttataaagttttacattttacatttaagtccatgctccattttgagttaatatatttaaagtttgtacaaggtgtgagacttgaggttcatttattttagtctatggacatttaatcgctctagtatcatttgttgaaaggtgatgtttccttcattgaattgcttttgaatctttgtccaaaaaatcaattggtcaggctgggcgcggtggctcacgtctgtaatcccagcactttgggaggccaaggcgggcggatcacaaggtcaggagatcgagcccacggtgaaaccccgtctctactaaaaatacaaaaatttagccgggcgcggtggtgggcacctgtagtcccagctactcgggaggctgaggcaggagaatggcgtgaacctgggaggcggagcttgcagtgagccgagatggcgccactgcactccagcctgggcgacagagcagactccgtctcaaaaaaaaaaatcaactggtcctatctgtatgggtatacttccacaccatctattgtgttccaaactatctattctgattgctagtggatttatgtgtctgttccactgataatcttgatactatagtgacatagtaagtcttgaaatgaggcagatttatttttatcacattatttttcttttcaaaattgttttagctattttagttcctttgaattttcatatgaattttaaaataatctcaatatttataaaaattttgctcatattttgataagaattatgttaaatctgtatgtcagtttgtgaagaactgagactttactatgtcgagttttccaatcagtaaaaattgcatttatgtccattaatttacattttgtgtgcttcctttgattagtactgtagttttcagcacacaagctctgtacattttgtaagatttacacctaaatatttactttaaaatgtttctgattattgtaaatggtgttataatttaaattttgattttcatgtgttcattgctatgataaatacaacagatttttgtatgtttatcttctatcttatgaatttgctgaacttatttatcagttctgtggatgtttttgtagatttttttcattttctatatagacaattattccatctgaaaatggtgactgttttttttccttcctggtttgtatgccttcccccagccccatcttattgcattagcaataccttccagcactatgttgaataaaagtggtggaacctgtttctaattgaagggaaaaagctttcaggttctagccattaagtgtaatgttagctgtagttttcttgcagaggggatagatgttctttatcacgttgtgaaaattctccgctattgccattttttttttttgcgacggagtcttgctctgtcgccaggctggagtgcagtggtgcgatcttggctcactgcaacctccgcctcctgggtttatgccattctcctgcctcagcctcccaagtagctgggactacaggtgcacgccaccacattcagctaatttttgtatttttggtagagatgggatttcaccatgttggccaggatggtctcgatctcttgaccttgtgatccaccctccttagcctcccaaagggagggattacaggagtgagccaccgtgcccggcctccactattgttatttttatgagaatttttttatcataaatgagtatttaatttttttaaatgctttttctgaattagttgatatgatcatgtgagcctttttttctttagcctgttaatacaattaaacacattgactgattttcaaacaatgaatcatccttgcatttctagaagaaatcccactttgattatgatgtataactctttatatgttgctgaattctatgtgctaatattttgttaaagacatttttatttatatttaggagatacatcgctctttagtttccttttttgaactgcctttggttttggttcaaggtaatactacttcataaaatgatttgagaggtatcttctactcttttgtctggaagagattgtgaattggtgttaatttttctttaagcttttggttgaattctctggtgaaatcatctggacctagatatttctttttggggagttttagattataaatttaagttccttaatagtcatagggccattcaaattctcgatttcatgttggtttacttgtaatttgtttggaattggcctgcttcatctaagttgtcaaattcatgtgtatagagttgttcatatgcgggcaggggtgcctcactaccatctaacagagatgtaaattcaggctccttcctgggctgcctctgttatcacccaggtgagggtgtttggtctcaacagagcctcacaaaggtcaaagtctacgttttctactcaggctttgctaacatgagcagaggcggggccaaacttctttctgtggtgtttggctggaatagaaaggttattatctaaaagctccatatcttgccagcctggccctttcctgatcatttggctagagaaaacaggtgtgtgtgtgtgtgtgtgtgtgtgtgtgtgtgtgtgtgtgtgtgtgttttgctttgattttgatttggcttggttttattttctgtctgcacgtgtgtgtgtgtgtgtgtgtgtgtgtgtgtgtgtttggtttgctttgattttgatttggcttggttttattttctgtctgcacctgtccgcatttccaggattctagttctttagcattaagaactcactgccatgtggtttttcaggtcccaaaggccccagctcaaatgtttcttttctccacttttcagagtcctttatgtatattttatgtataatgttcagaatttttacttagtgggatgaaaaggcaaagaatgcctacttcagcttctagaaacagaagtcatccaggatttagttttaaatgaattggtcaagatgaatttctggtacataaaataggcctagtcaaaacatgaataatttatccatgaaacaaattccttttcgtgacatttttccttggtgggccaatctgctattccccatcagaaaagagcccaggtgagagaagaagaaaatagaagaaaacagaaaatcaggaggactttctctttctcactcctcacttcattcctgcctcactcccaaggcaagttcagagccccacagtaccaagagttcaggaaaatccaagggctgaattcaacatccatctagccagtagagatattttaaaaatcacacatattatactgacttgaaaaaatattttcagcacctactttttaagtactcttatgctaaacacaatggagaaaattaaggtacaaaggcatagcctctttcagaaaatccataaaacctgtatccaaagaactataataatgggcaggttctgaagaatgacatagaatgggccacacatctctaggataggatttaaaatgtcatttaaatataacacaaatgtttgtattgggaactctaaattgtccttgtctacagccttcttccttccctttcttacaacctataagatcagacttaagtaaactcctaagctaattttgaatcatttgtcctccctaagcccataatcacatggctaagccaagaattattcaaacctaattctcccgcaagacctcatccattgctcactgctcctgaagatggtcttgagtatccccctggatctgggcctcagactgtctttgccactctcctgtgttaccacatggagttggtccccgccatgtttggtcaggtctcttagaatgataacttctaacatcatggatcctgaaaattagctaatgtgatttccaactactgtgtctcatctagctgatattatcaatcaattcatcctgcctgaatttataacaccacatttggatatagtgtttagttgcttaacatatgttcaataagcataaattaaatacatatagacaaatggtctagagcagtcttcatcatgcttctccggaaggatctagagtacttatacaatttgagaagattgagtttcataccaagtagggacagggtctggaaacaggcagtacacaaacacttgaatgtatgttaagactgagacttctgctacagaaagtcagaggaaagaatgtgactttcaggtgagatcagcaaagaaggattccctctgccacaaaataacaccttctttcccagaaactcagatttcctttgatataattcactattaattttcactctaggagatgaagcatctgaatgaatgttcctggaatatgcttggaacatgggaataaatcatgctagttgatatggaagacaaacacaacactccagcaatactctcttaggaattccctcatcaccatttaaattgttgattttctgctcttctgtagaaatctctagttctggatgaacataagcactgtctatattcgttagacagcacaatacatattagtctttaatttatttcacctacaccaaacctaaattttttcttcttctaactttatgtcctaattttctttacttaattttgtctacatttttgtcatcattttctcttagatttttgttcagctttccttgaaacccaataaaagcaaaaattatattgagaaaagacaaaatttcacatcccatattctacagcttgctacctctgggcaccaatggacattcaactgaaatataattttttaaagaattttatcagtataatagactcttggacttgaattatgaagcctaacaactggtgctaaatcagatgaaattgtgaagaaatgtctgcagtgtagctctaactaaaagctatattctaacaagtcggcgatggagcctccaactttctcatgcctctggatggaatttattccctaaactcagtaaagccactgactttcagaaaatgaataatctaaaaaaactgcaaaggcaaggcttttgttctttaaaaaaagaaatgaagctaacttctgcttatggcaatggagatcagtttattttgcaccaatttcctactgaaaataactataaaggctgaacaaaatgtccaaaacccatctgtttgaagtcatcagagagccatcaaggtaaagaggggcttcagggcaaataatctgacagaggcaagccaagagatgttcaccccccaaagcagttactaaaggcttggaggttgacaggagtatttaaaagtcgcactgagaaggacaacacaaatttgagtttagtgccttccaggaatgaaaaatccttggataaagacttaggatatcactctgcaatctacagggcttcaccctgcaagtgagtgtaaacagaaaatagaacaagccttataaaggtttaagaaaagttttaggtcagctcaagtcctaaaggattaaggtgattggcatctcacttagctgcctggtagaagcaagttgaagtcccacctggagaaaaacattcactgaagcctcaaaatgccttgcaagttttcatctaaaatgtatgacactcaatgaaaaattaatagcatattaaatagatttgaccagcggggcgtggtagctcacgcctgtaatgccagcactttggaaagctcaggtgggcggatcacctgaggtcaggagttcgagaccagcctggccaatgtggtgaaaccccgtctctactaaaaatacaaaaattagctgggcatggtggcgggcacctgtaatcccagctactcaggaagctgaggcagaagaatcactcgaacccgggaggcagagggtgcagtgagccgagatcgcgccattgcactccagcctgggtgaaaagagcaagactccatctaaaataaataaataaataaataaataaagatttgaccagctaacaagagggaaagaaaaccagacagtgcaaaattatccatgagaaatgcagttgttgtatttatctgataggacttaagataacagtgattaaaatgtttaaaagattaaataaggcaatacaattcagtgaagaacaaaaaattataaaaacaaagaaaatataaattctagaactgaaattaagaactttacagatagatgtaacaataagacatacaggactattgaaaaaatagtgaattggaagataggtcagaaataaatattgagaacaaaagagggagaaaaaattacagaaaataaagaaaagagcatgcaaaatttatgggacaggtacaatgaaaagatctaatacacatgtaactgaaatttcagtaagacaatgaaaagaaaaatggggcacaagcaatatttgaaaagatagttgctgaggatttttccaaactgatcaaatactttattcaagaaatgctatgagccttaagaagaaagaatacaaagaaaaccacatagctagatgcatcatagttaaatttctgaaaaccaaagtcaaagagaaatcttaaaaaaagaaagagatagagaaaaaagtgtattaacttcaaaggggggacaataagaatgacagctaatagctgacttcttaattgaaacaatggaagccagaagacagtagaaagatatctttagaaaggggtgggggcagaggtcaacctgtaattatgtatcagtattaagtgcaatacaaaaattcacaaaataaaagcattttcacacaaataagaactgaatgcaccagcagcagatgaacagagaaaatactaaaggatattcaagaagaagtaaatttgtactaaaaaatgtgtaaaaaaaaaccccatctgtttgaagtcatcagagagcatggagaaaaacattcatttaagcctcaaaatagcatattaaaaatatttgaccagctaacaagagggaaagaaaaaccagacagtgcacacaaatatccatgagaaatgcagttattgtatttatctgataggaactttaagataacagtgattaaaatatttaaaagattaaataaggtgatacaatttattgaagaacaaaaatttggcgatgcagaaaggaatgaagagtaactaaaaggagtaaatatgtggataaacacaagtgaatattgactataaaacaataatactaaagtcttatggattcttaagtatttagaaaattgtaacacatgagaacataaattagagtatgggtaaatgaggctaaagtgtattctaacttttgcattgagttggtgttggtaaaaatagtaatttatgttagacttgaatttcagggatgtattatatttcataagctagggtaagcactaatacaatggtaaaagaatgtgtatctgaccagctagtactggggagaaagggaaaaataaataatactgaatccatccaaaagaatgtaaaaaaaaaaaaaaaagaacaaataaggaatatgctgggttaattagaaaataaatgtaaagttctagattttaaacttaatatatcaataacattaaatgtaaatggactaaacactccaattaaataacaaacattttcaggctggatttaaaaaataattatatgacacaagagactcaccttaaatataagaatataaaaaagttgaaactaaaaatagaaaatatatataccataaaaatactaatcaaagtatctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatcaaagtatcttaatctcaaagtagatggtatagcaagaagcaccactagagataaagatcactttccataatgatagaacagtcaatccatgaggaagacacattttaaaacttgtgcacagttaataaatagtgtcagaatatacaaaggtaaattattagaagtaaaaggagatatataaaaattcaaaattgtagtgagagatttccatacatatacttattaactgatggaccaggcagaaaaaaacaatcagtaaagagataaaagaccaaaaaaaaaaaaaaagattgcaaacttgatctagttgaaatattcaaaacattactactgtataataatattcttcccaaatgcataatttaccaaaattaaacattatctatctatctatctatctatctgtctacctacctacctacctacctagtttcaaaggtttggaaatgtgaagtatattttccaacctaaatggagttaacctagaaatgggtaagaaaaataagtagaaaatatcatggacttggaacatagactatttttcaataattcatgagcaagagaagaaattacaagagaaatttaaaaatagtttgaaataataatgataatgtaacatctcaatacttgtaaggttcaggtaaagtcatgcttagaaagaaatttatatttaatatatacatgagacaaaggctgaaaaatcaacgattaagcactaaactcaaaaaatcaacaaagagcaaattaaatgcaaataaagtgaaaactagaaaacaataaaaaataagagtggaaatcaatataactgaagcaaacacataatagaagaataactaagaaaaaaggtggttctttgaaaaggctaatatagttgatgataacttgtcaataccctgatcataaaaaaggcagaaaaaaatccataatgaacaatgagattattacagctcacataggcattaaaaaggtaatagaatattttgaatagctgtatgccaatgcatttgaaaattgacataaaatgaacaaatttctgaaaaaacacaagctaactaaactgacacaagaaaacgtatcatttctaaaaatatgaatatttctatatttgtgaaagaaaatacatttataattttaaaacttttcataggaaaatctataacctcagtgttgttactggtaaattttaccaaacacatttggaaaaacaaaataccaatcttacgttaagttctttcaggaaacagaaaaaacgtggaacattttccagctgtttttttgaggttaccataatcttcatatcaaacctgacaaggactttacaagaaaaatcaaacaccaatcattgtcataaacccgtatgcaaaaatattacaaatttgtgctaaccaaatccattaatatagaaaaaagataatatacaaccaaacagcctagttcggtttattccaagaatggaaaattggcataacatgtaaaatcagttaatgtaattcaccatatgaagagaataaaaggaaacaatcatctcaagaaatgtaaaaaaaagaagtcatctgattatttatctgatttatttataataaaagcccttagcaaacaaagaataaaaaaaaaagactttattggccggtctcacgcctgtaatcccagcacttcgggaggccgaggcgggcggatcatgaagtcaagagatcaagaccatcccagccaacatggtgaaacctcatctgtactaaaaaaaatacaaaaattagctgggtgtggtggcatgcctatagtctcagctgcttgggaggctgaggttgcactgagctgagattgcgccactgcactccagcctggtgacagagtgagactgtctcaaaaaaaaaaggactttatttatttagtaaacagtatctagaaataacttccagcaaacattatacagaatggtaaaatattaaaaatttttcctctaaaatcaagaacaaagtaaaaaatgccagtgttacttacatttgacatgtacaagaggtcctagtcaatgcaataaggcaagaaaaagccaaaacatgtgaggattttaatggaatgaatgacagaagtctagtcctcttccctttcaaaataagctgtggcttccagaaaaaaaaaaaaaagagaaaggatgatgggaatgaaaacaacagcagatatctactatgtttctctagatgaaaataaatatagttactctgtttttagctgacaactagtcagtgtcaggatattgatgaacctcagtccgtcaatcagaaaaactactgctatcatcacacagaaggggttagaattcaagctgtactgcctgctagctgtaggacctttgacaggtcatatagcatgtctagcatttagatccttcatctgcaaaatgtgggtggcagaagtacttgcttcctctgcctgtatgaagattaaataaaattatacaatgtaataaccctaacatataaatacaaaataaacgttagatgaattttactgaaattattagtaacaactccaaagccttggttccttcagttaaggcgaccactgaagttaatctcatgtgaaaataaattataccccaaatttaacacaaacaactataacaggtgatctggaactgaaaataataacaaaaaattaatgaagcttacattaatgagatatttaaatattaccttacttttttcaaaaagtgttccttttctctctctttcccatgatttttttaaaaaaagcttttaattgctgcaaaccggcagaaaaatacttatttatatcttaaaggtactgctcaatgaattttcacaaactaaacacgtccatgtaaccaacacccagatcaaattcttcccatgatttgatcattcagaaaatctttgacaaagaggttgacaaactcaagctggagtcagacaacccagatgctaattctggctctaatagggatgcactggttgacttaaattagctccttccctacatcctttgcatcctaatttttctcatgtggaaactaagagcaacacattcccctgcccctccaacctcttgtttcacagtggagttccaggaccataactgcaggcaaccaaaaccgtcttcctaaagctccctctcctttagcttccatgagtctagaccttcctgaatttcatccactgcccccggattattgcttagtttagtttctgttcatctttgaatgaagacatttcccaagattctgttctgcccccaactctcctcagtttctcattaaatttctcactgcactttctcattcaattcctggttagtttcatctgatcacctccatgtccagacttccaagtgcaaaatccaaccctaatttttctccccaactccagtccaagattttcaactacctgctgatatcttcaagtcctgttgatacatcagtcccaatctatcaaaagagaaatcatctttcctccccataccttctccctatgttatattctttactttgattaccacttctggtcacctctgtaagacacctgggaatcatcagctttctctggttcacttgccaaatcttgttaattctaccaccccaatatcctttgaaatgtccctttgtcactatgcctaccccacttctctaattcagttcatctgcctgagggatttcaagagtttcctgactgatctgctactcatggatctaatttctgcaatgcatctttcattctctaatggacttcttttcctaaaggtgtgtcagatcatgaaaatttcctgcctttagtcatcctacataaaagcagaataaagaacaaactccttggcctgtcaacctaaaaggacggttcctttccagaaccatccaccatgaaatagcatcatacaaattacactggagcctcaccagagtgtgcactgttcctgcatttccataaacccatgattttctaactttttgcctcttctgtactcaccaaagtgatatgtatccttaaatttcttccctggccttcacaatcagaataaattagcccttcatttcagaaccaacaccacttttttttaatacatatataagaacttaaaaataaaactacttttgtctactttgtgtcaagcatttgaataggtactttatatgctataattcatttaatcctcattagttgaatcttcacagcaactttacattttagagatgagaaacttggtctaattaaggctgaatggttcacccgaggtcttactaaagtgaagtaaacgtaggagccaggatcagaatccaagactttgggattccaaagtcaattttctttatacttcgcaaaataatttctacagctaattgtttatatgtgtctccctaaaagactgcaagctctcagctgagaatgtgaataatctatttcagcccactacctcaaccctgcaaacacacagacacacacagacacacacacacacacacacacacacacacacacacagagacaccctaattgggttacttccacaacagtttgactctgtaactgttgaggaggtgaatgaataaattatcaaggttcttacattaatacctactcagatcttatgatagatattaatgacaaaagaggtatttctgtacctgtctctgtggaacttgcaaacacagaaaagaacaataacaaaataacatcagttgtagcatttactagtccagaaatagctcacctatgaaacaaacacaattttaattcattttccccatcccctaataggaaaatagttctttctgtgggggccaagggaaaacttccctgtcacactctgaaggttcactgaaaatcactgacaaaaggcagattaacaagagaaaaggcatacaaattcatttggtcatagttttgcatgacacgggagccttcagaatgaagagccaaagagacaggagaaattgtccatttttatgcttagattcaacaaaggatgaacagctgtgttgaaacacgattgggcaaaaagggaatgatctaatggtaacagactgagtggggaagctcagcaacgcctgtctgtttagatttctgggcctctctgaagctttccttccttctgggtatgaggcaggcccctctctggaatgcaggtgttatgacctacagtcaaacaagtcagataagttctttacggctagtttttatacagaagtggggaggagtgtagggggcagttagagtagtatttttaggttttatggctggctttaggggaaaggggttctggcttctatgacccgccttcaggaaggggaattctagtttctatgcctaaccttgggggagagtaagaggccagagacaggagggaacgaggtcagagaaacatgcttctgagtccctcatattgggatatcattttctgagctttaacatttctgtaagaataatgacaactaatttgaggtgcagcactaaaaatagaaggaatctagcagctcttgaggggtccatcctgagttgctttgttctgatcacttagcatgtgatcttgctacctagaaaattattttacctgtggtttttctcattgaaacccaggccataaattccatcctgcactaccttccttccactcgatcacatttgcattttttggctgccacgagacttaccttgagttctgcttctttttttatttttatttttgagatggagtctcgctctgtcaccaggctggagtgcagcagcgtgatctcggctcactgcaacttccacctcccaggttcaagcgattctcctgtctcagcctcccaagtagctgggactacaggtgcccaccaccatgcctggctaatttttgtatttttagtagagacgggtttcactgtgttggtcaggatggtctcgatctcctgaccttgtgatctgcccacctcgggctcccaaagtgctgggattacaggtgtgagccaccgtgcccggcctgagttctgcttctttccaagatagatcctctggttttctgttgattctgtgagcaccaggtactccaaagaatatcatttcaacaaacagttttctgtttaaaccaatcaaagtaagatcctatggcttgaaattaagaatcttgcctgacataatccctgtctcttgataaacacaaacaggcaatcaccaaaccagtgccataactccacaactcaatttttaaaaattaaaatataataaatcccctctcttttcatttattcgttcgttcatggcaggtacatttctagataatgaagatacagttataaattttgatggattttacaattttcatatctttgttattggcaaccaaagggtataacatgcacagtccagacaaggaagttaatcagaaacagtaaaaacttatcttcccgaaatgataacctgaaggtcaaatacaacaggagctactcttgccctttcaaatggccaacaatctgaagatatcaactaaatgccaaatattaccaaaagtaaatactataggagttgcccagtttgttaggtgagagtttaaaggaaactttagaaagaatgagcctgaaatgatgggaggaacacaggtgtgtatagagaaggagggatggaaccatttatggtgaaattttctcagaaatggcacaaagaaaggagctcaagaatcacagtcaacacccaaggaggagggtaattcattggattgaaaggatcccagaggaataaaaagttgtagaagaaaagaccaaactattgcatttgctcaccaagttctagagaattattttatcctctaggtcacagagatgggctgcagggggtggatagataagatgtggtgtgcaagttcttaaaatatgtactgcatatcatacattttaggtgggtattggacaattttcttagtgaataaagaggaaattcatttagcaaaaatcaaaattaaggtaactctagcattctttttcctttctctctgaaaaggtaataattgtgatatctgccaatttataatagaaatgtttaaaaacaaaagaattaaacttagagagttctccttaaaagtcagacaaatttatcaacaaaagagaagaaaccattgtctcaagtgtctttttgttgtttctttattcttcttattttctgcaaaaaaaaaaaagaatgagcctatgaaaagcaatgttaatgatggcacactctggggttttcactaatgttttaaataggctttacatagagcagcaattatgtgagatgatatagttaaacagtatcgataataaaatattccatttgagcacctcaaaatactttggactaattcatattagaacatcttgctatcagaactgttgagtttaaaataatatacacatatgtatatgtatactcatatattatataaacacagttacacaaaagtaaatttatttattaatagattcatccctttttatctatggtcataaaattcaaggatcagtaatagaatccatagatcccctaaattcatttgtgatttttttttttttttttttgagatggagtctcactctgtcaacaggctagagtgcagtggcaccatcctggctcactgcaacctctgcctcctgggttcaagcgattctcctgcctcagcctccagagtagctggaattacaccactatgcacaccacgcccagctaattttttttttttttttcagtagagacggggtttcaccatgttggccaggatggtctcgatctcttgacctcatgatccacccgcctcggcctcccaaagtgctgggattacaggcatgagccactgtaaccgactgcatttgtcatcattttttaacatctttcttattcataaaccaattagctagtgggaaaaaattaattagcatttgtaggatatactttttttttttttgagacagagtcttgttctgttgtctaggctggagtgcactgacacgaccttggctcacttcagcctccaccccccaggttcaagtgattctcctacctcagcctcctgaactacaggcatgcaaccaccacacccagctaatttttgtatttttgtatttttagtagagacagagtttcaccatcttgcccagtccagtctcgaactctagacctcaggtgatccacccacctcagcctcccaaagtgttgggattacaggcgtgagccactgcacctggccaggatatactatcttgattttttcctaatcttaactttaaagatgctcctatgaataatactaataaggtcccaggtaatgagagagaacaaagggtaaagagtcttggtaattcccaggctagacaaatattaatagacctatggagaggtacaagacagctgacttgttagaactgtgcagtttgttactgaagccaaaaatttggcagtaatttctagacagtaatttcgtaagtgttttttttttttacatttatgcccccatgtttaacccactagcaaattcagttgactcagcccccaaaacacacctgagataatctatttctaggcatccccattataatcaccctggtcccatggaccattatttctggcctgaactaatgcaacagcttcttaattggttttgctgttgccattcttacccagttacgatccatttgccccatgacttaaagaatgaactttttttttttttttttgagacagagtttcgctctgtcaccaggctggggtgcagtggcgctcggctcactgcagcctccccttcctgggttcaagctattctcctccctccgtctcctgagtagctgggattacaggtgcccaccaccacacctggttaatttttgtatttttagtaaagatggggtttcaccatgttggccaggatggtatcaatctcttgacctcgtgatctgcccacctcagcctcccaaagaatgaacttttaaatacttaaccagatggcttcattcttcttttaaaagtttctcattgggttcacattgctatcagtaaattaggaacttcttactttggcatacaacgtgagaagatggaactgccatctatgtgcccaatcttattctttgtcacggtctttttcatgtaccatactcccagctgcccttcctcagttcctcaaacacaccaatcccatttcctccttacggcattgggactagctctcacatgatttgaaactctcttcctgctcacctctccatgttaaccctaacttaaatgtcacccccttaggccatgggaacacccaatttaacctaattcttcagccacattacatggctcacctttaattctctccatagcacttagtgctgtctcaatttaccttctttctttctccctccctccctctctctctccttttcttccttctttctctctctggttttttttttttttttttttttttttgagatggagtctcgctctgttgcccaggctggagtgcagtggtgcgatctgggctccctgcaagctccgcctcccgggttcacgccattctcctgcctcagcctcccgagtagctgggactacaggtgcccaccaccacgcccggctaatttttgtatttttagtagagacggggtttcaccgtgttagccaggttggtctcaatctcccgacctcgtgatctgcccgcctcggcctcccaaagtctctttgtttctttctttctctctctctctttctttcccctttcccttctaaagatcaagaattatgcatgctttgttcatcactgtgccaggtatggagtatgcactttaaaatgcatatatatatatgcgtaaatatacagctatgtacatatagtttacattttgatatcatgcagaccgatagctatgaaatctgattattcattcagtgaaggtttactaaacacctatatattccaggcactggaatatgagacagacaagactactgtcttcatgcagcccacatttagctcagggagacagagaactaacaaacaaatgaacaaacaaaagaaaatttcaggctgtaataactgctaggaataaaattaaaaaggtaatatcaaagaaagttataatggacttgttcaaaaagcttcattaaccaaacgcaccaaaagaatcaattgaaatgttcaagtagaagacattttgcaatttttaaatatcttattctccaaaatcttccacacgtttggaagcagttgtccataaactaccttcgaatgaaacatccactaaattactgccactagaaaaagaaaagactggctcaatgctcaagattaaaatgcaggctgacactttctgctttacttgttttggggttgtgtggagaaatgctgacatctttgccttttttctttgagatggaatctccctctgtcacccaggctggagtgcaatggtacgatctccgctcactgcaacctctgctgcccaggttcaagcgattctccttcctcagcctcctgaatagctgggaatacaggcgcccgccactgtgcctggctaatttttgtagttttagtagagatgggagtttcaccatcctggccaggtggtcttgaactcctgaccttgtgatccacctgcctcatcctcccaaagtgctgggattacaggcgtgagccaccgcgcctggaccatctttgccttttttgaaaatagaaagagtagtaattcttgcattgagaatatgacataatcccaaccccaaaccatgagtctcatggccatgtctaagccacgccctgacgatagggttgggatgactacgccaggcttagtaatgcacagggacaggaggcatttcggaaccacaccacgacactgctggcaagaaagatgggaaaacggcagcaattctgtctgctgtgctttgtgtgtgtgttctacctggctgattgaatttcctcccaacacctacctcagatgtgttgtctaggtgaaaataagcacttcaatgagctggtctaattttaatcctcagcccttcccagtcagccccgcccccatgtagttacctccgtcatgacaaagaggaacatcccaggtgcaaatctagcacagtttccctatttcacctgtgtccccctccccatcttcatgccagcatcagaaacaagagtccaaacatcctcggcaacactacagaagctgttcaaacaatccctgtgttctttccaatttgccgacgtggtctggcaaacaaagagatttctttgtttctctaagaaacaaaggtttcgtaagagaaaccttaagagatgataaatacaattaatagagagatagccaggcaaggtaagagaatgcttgactgttttaactgcttatcctgtgctgtaacagcttacctaagagatgtcagagggacggacagaaacctatcagcgctcaggcagaacaggtgctccagtggaggcaaggactgcgcctgcatctgtccatgcagaaactatgttctcatggatacaggctgatgatagtaaattctggtgggctatttactggtggagtgtctgttcccaaagaaaattaattattaaatcagtgtcaacttagagagatgtctctagtggtctgccgcagggcactgtctggggcactgtctgaggcactgtccactctgccacttttaacagtgctttgatggcctggggcacacagatgacacacttatctatgtgtgataacgctcagcctagaggaacacagaatgtattgaataaagggatctgattcagataagtgggcataatggaaatttagcaaggtgatatttaacaaaccgcgagcttaccttaaaaataaaaatgaaatccccatgagaatggatggggagaatgtaataaacattagtacaaataagacttaggagttttaatttaccattaataatagtaattgtaataatgataatagtaggtagcacttatcaagagtttatcatgtaccaagcactgttctaataatttaaaacttatcattagaggctgggcatggtggctcacatctgtaatcccagcactttgggaggctgaggcaggaggatcacttgaacccaggagtttgagaccagcctgggcaacatagcaaaaccatgtaagtatgaaaaattttaaaaattagctgggcagcctggcatgcacctgtagtcccagctactcaggaggctgaggtgggaggattgcttgagcctgggagactgaggctgcagtgagctgtgttcatgccactgcactgcagcgtgggtgtcagagccagaccctgtctccaaaatataaaataataaaataaagaaaattaaaataaaatatattattaactcatttaatcttgacagaatctttagagtaccttattggtatctccattctataggtgaagaacagatgtaaagtaacttaaaatgaatcaataatgtaatgtcattgtcaaaaagtattaatgtgatcttagagaatagggtccagaacatgagaattgataaagcttctctaactgcacttaaattattgtattctgttttgggcaaaatggagccttgaggaaaaaggttagcatgaccaggaatgcaaccatatatatatatattttttctttttgagatggagtctcgccctgttgcccaggctggagtgcagtggtgctatcttggttcactgcaacctctgcctgccaggttcaagtgattctcctgcctcagtctcctgactagctgggcttacaggcttataccactatgccccggtaatttttgtatttttagtagagatggggtttcaccaagttggccaggctggtctcaaactccggacctcgtgatccacccacctcggcctcccaaagtgctgggattacaggcgtgagccaccacgcccggctccaggaatgcaaccatttttaaagaggaacaatgaatagaaaagtctgatggatttatggctaaataacagaaagaagggtagaacatgagagtttgagtgaggacttcaaacccttcgtaaagttcagtttaaatagcatgaaacatatgccctgctgctttggagtgtggccatgaaaataatagcaaacacattccatggaatatttactatgactttcccagattacaaagtacaaggattagatgtggaaaagaataaatagaagctcaataaaaagcaaagctttctagtgggattgctttgtgagatgggaatcatgcctcactgaggatgtgcaggcagtggctgaaatcagatgacacagggcgaagggacctccccggatctctactctgtgagtctataaagaataaactgcagacactattttggtaatagatcaacataagaaaatttaaggctagaggtcaattgtggtaaccaaactaaatgtcctctgaaaaggcctccacctgtacttctaagtgtttccataaaatttagtaaatattggccaggtgtggggctcatgcctgtaatcccagcactttgggaggacgagaaggatggatcacctgaggtggggagttcaaaaccagcctggccaacatggtaaaaccccatctctactaaaaatacaaaaattagctgggtgtggtggcgcttgcctgtaatcccagctactcgggaggctgagtcaggagaatcacttgaacccgggagggggaggttgcagtgagctgagatggcgccattgcactccagaccctgtgtgtttattcactaggctatcccctgcccacccagactccatcatgaaatgaaaggcaggcatagcacaatattagtcagataagagtctcatattatgtgggaaccatgccattttatttctgaaacagcaacttcattgtgaggcttagaaatccctgagctttgtggcaactgaagacctgtcaccgtcaccgtagctggagtagtgagcaacacgaggtggtgggacaaaagccattcctttaagtgtcctctgtacctgacaaaagaggacatcaccaaagacctagcatacagttggtactcataaaggttggctgaattgaggctaattttctagctgcagcaccagtcctgtttataaaaaccggtcaaatcaatcttctacaaggaattgaacttcgagcactttgaagtttctaaatggaagtctgtatgtttcatcaagcttaaaaaacagtccaaggcattgatgtagcaaggcgttatggtgtcatagaaaggaaactggacaaagagttaaaacaaaaacggatttgaatcatggtctgtctcgatgcctcagtttcctaatgtggaaaacaattttatttttcacaagattctaaaaatccaatataattgcgttaggtgaaaagcattctgtgtacggtgacaagttatacaagtataaataatcaatatcattactaacaattacattattattaattgaatgagtgtattcacccattaatcattaccaatccattattacatgtgtattattaatgattattattcaattattatatgtattcatttattatacatgtaataattgagtaataaattattcaattataattaataaataatagttaattattacatgtgtaataattgaatacatgtactaattgagtaataataacaaatacacatgtaataactggatacactgaaggaagtgtattcacttatggtttataaacattccaacatcagatatgtaatatttgcctctttgtcatttagaataatctgtatcactagtcaagtgtttgtatccaaaacccaggaacagggtcgacttcgtgggtgtgtcacctgagaggtgacacacggttccaagcttaaagggccttgtgcttggtttaatgctctgctgtttccatcctgaaattcttattagcgtatgcatttttattttgtgctggacctcataaattatgtagccagtcctgtggtgtgaataaaagctgaatctgaagctgccagggtaggagagttggaggaaaaggtgggcttacaggaggaagctcctagctgtctgcacaggagggtagtactcagttgcatctgactgcagcactgaataagaatctcagggaccttggatatcattcagacccatctctcatttcaattgaagaaatcaagagtcccagattttcggccatttgcccgaggtgcccacctcaccagcagggtgtcctctacattctgtctaatgaatgaatggcctgccctggaacataagtagggcttccgcgttgttgtaggacagctttgtgttccagatcacagatgtctctttcataagccacacctcctcccactgctgtgtgggccacagctccggttagatgataactctttgactttttctcaaagtccctgaaatcagtcacagagaaaatggactgatcctttacatcaatctgagtgtccttgtgcgtgtgtttcattttgctttctattcatcctcaatgattgccaacctgcttgtgagatgtacctgagaataaccttcagacaaacgcagtgggctctgcattgatggtgctgattcagaacacatttggggtgttgtgtcatctgtctattagaatgcttccaaaggatgacgactcactgatagataatgttttgtttacaagcatgtccttgggtatgagactttgtagtgtcatgactgaccgtaaatctcactggcagtagcacagcatatgaaacaccttctgctctagtcattactttatgttcatcacaaacaaatcagaacaaattctgaatgcgaatctcctttcaagttagctgactcaggctgtcggaactcatgtaaaagcgaaccaaatatgacaggaggtgaaagctggccgtagaactggaaacggcagaacgtcattgaagtctgcctaagaactagtcagcatcccacctgcttgctcacagtcacactcaacatctctgtggaatttttagtgctcttttttgtattagtcttttagtcgttaccctagtgactctgatatgcattcctaacttatcagtttactttgaattaacattagaccacttgatatataatgtaagaacttcttacagtgtaatttcatgtacagacttcacaatccttttgttgtagctaaagtttacttctacctagattataaactccacaatactttgtcattaatgtactttatcaggtatgaagattcagttaattttaaataattttttaaaaagaaaaatactctttttcactctgatgcccaggctggagtgtagcagtgcaatcactgctcactgcagctttgacttcccaagcttaagcgatcctcccacctcagcctcccaattagctgggactacaggtgtgtgccaccatgcctgggtaattttttctacttttagtaaagacagggtctcactatgttgctcaggctggtctcaaactcctggactcaagtaatcctccccccgggcctcccaaagtgctggaattacaggcacgagccaccatgcccagcaagaaaaatagcctttatatttatctatgtattaacaatgtcttttacttgcctctccagtagatctaattttctatctggtatcatttcctttcagcctgaagaccccctccttgagcatttctcatgttatagacctgtcagcaacaaattctctcggtttttatttatcttaattttttttattatgccttcattttaaaaacattattttctttaatatagaattctagactgacaaggtattttcagccctagaaacttatcattccatgttgcctggtctcaattatccaatgacatgtcaattgtataagctagtttaaacaattcttgtcatttttattcaatatataatgttttttttttctttggctgacttttaaatttttctttcaacctttggacttcagcagatctgcttaaggtgtggttttctttattgactgagattcttgaatctgtgggcgactgttttaggccaaatttggaaaattttcagccagaatttcttcaactatttttttcttcttcattttctctcttctcttcatcaaggactacagataaaagtatatcagatcactctatactgtccctcagatcattgagaatgtgttcattcttaaaatctttttttaaatttgtgactcattttaggtaatttctattgattcgtgaccaaataaactgcttcttttgttgtgtctggtctgctgttaatctcatccagtacgttttttaaagcttcatctattatatatttcagttcttagatttacatttgctttatttttaaatttttcttatttttcttgaagttccccaattctttatcctaactatggatactataactttaaccattatatctattttttcctatggattctttatgtgcttatcatagttaatttagagtacttgtctgctaactccaatatcagaaatatttctgtaaaattattttttcttgactatgtctaataatttttagagtgccctggtcaaaataacttttgattgtatagtggcactgtggatgattcattgtaaaattttagaatccattatctctctttgaagagtattgagtcttgtactagcaggcaattaaattactaatgaatcaccctgactatgctgagacttgatgtgtttcatgaggatatgtctattttagttatgccatctctcagtcttgatacatggtatttattactaggagtggcccttataggttttcagtgaaaagttcaacatagttatcaatgccctctaacttcacgggactcatacttcaaacgctggctcttagcaacaggaagtagttgaaatctctgttaggctctttcagccttctgactgttggtttcctctagggctccttgactatttcccgaataaatgagcaggtcaggagtcaaccaaggacttgagaggagtttacgttcatattgtgcaacccctccttctatgtctctctcttttctagtatttcctcccccagtttccagctgctctggctgttctaaacttcctttctgactcctcaggcaaataggacttcaaaaattttttttggcctcagttctagccacccaagagatattattcgggaagtcctcgtaggggaaaaaaacagtgtgtatcttaaccaatgtcattcccttgtttgaagcgttaaatgccctctaattccatctgcatttggttgctttcattaacttgaaaattctctttctatttttccccagagtttataattgctatcagtagaaggcttaatcttatacaagcacttctaccatctccaagaccagagtgctccattggtttaatgtgtaaccatgagtgaacaaaattgttttcaaaaaatagacaaacctcactgaacctcaatgaacactgaaaagtaagaataaaggccgggcgcggtggctcacgcctgtcatcccagcactttgggaggccgaggcaggaagatcacgaggttaggagatcgagaccatcctggccaatatggtgaaaccccatctctattaaaatataaaaaaacgtagccgggcgtggtggcatgtgcctgtcatcccagctacctgggaggctgaggcaggggaacaggctgaacctgggaggtagaggttgtagtgagccgagatggtgccactgcactccagcctgggtgacaaagcgagaccctgtctcagaaaaaaataaataaataaaataaaaataaaaaaaggaagaaaaatgagaataaaaagaggtaaaacatggcgtttcatcttataaatttaaaatatacctgatttggtactgaatgattgtaactaagtttttaaacagtgttcatggcgtgactgtaaacccagctcacttttagaaaaacgtttttaccaacccaaacagtatcctactcaacaccagttatatttgtgggaagagagatagagttttctggggaaaggcccactcttctaagaaaatatatggttttctttgcattacttttccttctttattccctattcacgctattgaacatgtctatcccaacccttttttctggtcacataatccaggtctgaccacttggccttcttcttctcaatgtaattgatttaggaatgagtttgtggcccaaacaaatggaaagagatataatcctgggaatctgaatgaaataattggtaagataaagttttcttttcactgaggtagacagtagaatataaacttggaactggtatggccatcttgtcatctcttgaagacagcctgcctaagaatgaaaatcaatgctgagaaatataggacagagtcctgacaatgtcagttaaacctgaatccagcaactctgatagctatccctgattgcttagttatttgagccatttcattattgttaattgcccttacagcattttcagctgagttggtgttgtagaatgaacatttgtgtcctaccacaaattcatatgttgaagttctaacctccagtgtggctgtatttggacacagggcctttagggaagtaatggaggttaaatgaggtcataggggtggggccctgatccaataggattggtgtccttataggaagagccactgagcttgctttctctctccaggtgcacatattgaggaaaggccatgtgaggatatagtgagcaggccacctgctatgagccaggaagggaccccctcaccagaaacagaattttctggctccttgattatggacttctaggtttcagaactgtgagaaaataaatgtctgttgttgaagctacccaacctgtggtttttgctgtggcagctgagcagactaattcagttggggtcacttaaaactatgagtctccagtcatccaggaagtaggggtgcaaaggcagatttgtactgtgaccctgtcatggcaattcattctactggcaaaaatttccctcaattaaaacccaaatgatttcaaaacaccccataataggatcagcaagagactccaccaagactgaaaatccactgtgccaacaaaagccttctaaatgcacgttttagactttccttttaccttttcaagtggctcactggcaaaaatcaaggttctaattaaatctaaagggctatccaatcacacggttggcaccaattactcatttaactatgtatgtgttaagcataagctaattgcctttctctcaaaccagagccagttcagatcaggccattcaagagcatttaaacttggcacaagagggtagcactgaaaactgacaataaagaattctctcttgcaggagaacctttcaggaggctttcaatcaatttttgcaagttccaaaactcaaagaagcaaagctaactatgtagctggtgtatttctttctagatcttgaagcattaataaaaagatggactcatctgagaatcaaatatctggtgaaactatacataaatagatatatttgtgtgtctgtgttcatgtgtgtgcatgtggatatgtgtgtgtgtgtataattgcatgatgttcttcctcaccttcaaattctgacagattctaaggaggaagggcacagatgtgtttcctgcaaaagagccccgagtatcttttttcacctcccttccttccctttgtccagatgagaatctttgttttaggggaaatggaatttaatatgtaaaatttattctcagtgagtttcaccaaaataggaaccatatctctaaccttatattattattatctgtacaatacctgtcaaacggagcccccagtaaatgctgaaagcacttcacatccattgggaaggtgagtgcatttccctaacgtattttagagtataattaacacacagtgcctaacagagaaaatcatttttgtgtgttcagctaaacactcaactccacataagttgcatttgatatcgggttcactcggagaaatggctctcacacttgagcctgtgtcagaatcacctagaggggctgttgaaacagactgctgctctgggtcctttccccttcccctgggtttctgactccttagacttaagtgggggggtcccagaattacaatttttgtttgtttgttttttgagacggagtctcacactgtcacccaggctggagtgcaatggcgcaatctcggctcaccgcaacctccacctcccaggttcacgtgattctcctgtctcagtctcccgagtagctgggattacaggcacacaccaccacacctggctaattttttttttgtatttttagtagagatggggtttcactatgctggcaagactggtcttgaactcccataattagaatgtttaacaagttttctggggatgctgctgctgctggactggggaaccacactttgagaaccattggctaagaagctataggacaagagaggcagcttgccagcaggaaaggcattaagtgctctgctttctgggggagttttgcagtagttcacccactgtcaggagctacaaggctcacatccagctggtgtgagggcatcatgacttaaaagctacatgcctcacatctcttgtaataacttcatagacatagtgatgcggtttggctgtgtccccacccaaatctcatcttggatttccacatgttgtgggagggactcagtgggaggtaactgaatcatgagggcaagtttttcccatgctgttcctgtggtagtgaataagtctcattagatctgatggttttaaaaagaggagtttccctgcacgagctctctctctttgcctgctgccatccatataagacgtgacgtgatcctccttgccttctgccatgattgtgaggatttcccagtcacatggaactgtaagtccaattaaacctctttcttttgtaaattgcccagcctcaggtgtgtctttatcagcagcatgaaaacagacgaatacacagagcttgcagggaccccactagagatgtgccagttacccgagtcacagtctgagatggtcagagttatggcttcctttcaggtatttacaggtcacccagtacaggaatgacacccattagtaccaatcagggatcactttacaatgttgcctagtgacaaagttgaaacataccacctttgtatgtttgcagagaaacagagctagaaagataagatcaaattttcatgcagaaggggaaagaaagcattcctttgttaagcctttattcacaaggtacatatctttactcacattatgcccctattttaaaagcttaagaaatgtaaacattatgtcaaaaatttttcattcttggtttagctgaatctcaaagccaccagttggaaggatcatgccaatcaaggaagcagatggcttgctttgggcttcttcaacaaaatcacctagatcctaaattgctgtttctgtgacaatccatattgtctgtttctgttgcacatgataccacaggatttgctaatctctaacctaatttgtaaataggaagtaaatttctacttcagagcttctatcatctagtttttcttcacctgactgctatatggtctgcttcattttgttatgttgcttacttgaaaagaccatggagaaaatgtatttgttatttaaataaatacccaaatttgcaactccagatcttaactctgctaataaaagaaacttttaaaagaaacaatcttggcctaagtaaggaattcttacccttgttacataaacctagagatctaaagaagtaattattagccctggttgcattcacttaaagatctttttaaaaatactgacgcctgaaccatactgcaggccaattaaatcacaatgtctagagagatagggtccaggcacagaatgttcttaaagctccccagataattctaatgtagagccagcgttaagaacttttgaaactaaagtctatcactgagagaaaattatttttccttcctgtcacccttcctccccttctccttttttttaagaaagaaaatactgggaaagaaatcctaggctgtaattatgtgggttggttacagctttctttacaaacactcctgggttatcagaagaactgctctaaccttggggcaggtggactcttcctataatgacatgtaattattagtattattaatacttttgcaatcatattaataattaaggttcttttgcaataaaaaagagacatgggccaggcaggttggctcatgcctataatcccagcactttgggaggctgatgcaggaagactggcttgagctaagaagtttgaggccgcagtgagctatgtttgcaccactgcactccagcctgggtgacagacagagagagagagatgaaaggaagaaaggaaaggaagaaaggaagaaaggaaggaaggaagaagcaaggaaggaaggaaggaaggaaggaaggaaggaaggaaggaaggaagagagagagaaaggaaggaaggaaggaaggaaggaaggaaggaaaagaaagaaagaaagaaagagagagagagagaaaggaaggaaggaaggaagaaaggaaggaaggaaggaaggaagggagggaaagaaagaaagaaagaaaagaaaaaagaaaacaaaagaaggaaggaaggggaaaaaagaaagagagaaagaaagagaaagaaagaaaaagagacatgaatctaagctaaaaaattagacaaagattaggttctgcacttcagtttaaaaaagaagaaataagtacgcaaatctatcatttaatgagagcaaatatttatgtctccatgtcttaaaaatgcagatgtggcatagactggcgagatgctcacccacctgtttcctttcttcctgagcatgtgcctgaacatttcccagcttcctttgtccatggatatagtgacgtgactgagaatagtcagtggaatacgggcagatgtaaatatcacatccagagctggtcaatgaagcctacccatacatgactgtgatagttacttttatgtgtcagcttggctgggcgacaacgcccagataagtagttaaacattattctggacgtttctgtgaaggtacttttgaatgagattaacattcacatcagtgggctttgaataaaacagattgcctacaagaatgtgcctcatccaatcagttaaaggcctgtatataacaaaagactgaccacccccaactgaaaaaagaattctgtaggagatggccttcgaacttgaatggaaacatctactcttctctgggtttccaaagttctggcctattctataaattatagacttgctagcctccataaacataagccaattccttaaaataaatctttctttcctttctctctctctctctctttatacacacacacatacattttatactcacacatatacactttatacacacacacatagacatacccgtattctattggttctgtttttctggagaaccctgactaatacaatgaatttctaggaagaactcttaagaatgaagaaagaatttgggtttctttgttggaagtcctcttgccaaccagggacatccacatggacttagcatgaatgggaaataaactttcattgtgttaagctactgaaatttgtggttgtgattgttatagctgccagcattacttgatctaactaatatagcagatggtgaatgagatggttgttaatttccctttatcgctgacattctaaagcagtggttctcaaactcagctgtgcataaaaaaatcttaaagctttgagaaagtactcatacttggtctttaccccgaaattacgatttctttggtttctgaggtatagcccaggcactggaatttctaaattctctccaggtgattctaatatgtcaataatttgaagaactactgttatacaggatgactgagaccagagttaaaagttcatggataagagaaaccaagagggttctgttggtgaaaggcttcatctggatgaatggtatgattttctggcctcaaagcagagctcttgagctatataattatcgttattattaatagtaccaagaggatacatgcattatcttactaccttgctaaattctcacaataaaactcttccataaatattatgattctcacattttaaatgagagaagcaaagctcaaacagagattaaggtaacttgctcaaagtcacacagctaaggagtagagcccatgctcccaactctaacctgtaatacctcccattatcctaaagaaaatgctatcccacccccagccccccaccccctgacaggccctggtgtgtgatgttcccctccctatgtccatgtgttctcattgtttaactcccacttatgggtgagaacatgcagtgtttggttttctgttcttgcaatagtttgctgagaatgacggtttccagcttcattcatgtccctgcaaaggacatgaactcatcctttttgatggctgcatagtattccaaggtgtatatgtggcacattttctttatccagtctattattgatggacatttaaataacatatagtttcccaagccatttagcaggagaacctgctatagatcgagaaccactataattgagaaccactgctttagaatgtcaacgataaagggaaattaacaaccatctcattcaacgtctgctatgttagttacatcaagtaatgctggcagctataacagtcacaaccacaaatttcagtagcttaacacaatggaagtttatttcccattcatgctaaggccatgtggatgtccctggttggcaaatgtcctgatttgccaagatttgtcctgataaagaaaatgtcctgatcaaaataagtaagaatcacactgtgcaacttgctgctcagatacctgaaatattgcattcaattcccagagtcccagtttaaagaagaagatagtaaaattgtgttcagagaggagcaagtaggttgttggaaagcctggcaagcacgaataagtggaagagaaaggaagggttagatcccagaaaggcaatgctaaaaaagaaggaatgattaaagaaagagaacataatagcgcattcaaatattgtaaagtttgtcacgtgaaagaggaattagcctgttctccctttgtccagagggttaaatcaggatcataaattagacattgcaaaaaaaaaaaaagaaagaaaattctgtttggtataaagaagaccttctaataattagagcttttctgaaaactagcagggttgctaggatttaatgagaaaatatgttctgtaaatgcgtataaaacactgagtatttttgttgctattatcatgtaggtgagtgttccattcattgaaatgtgcaggtacatactgaaatggtggttctgcacaagataggaataagttagatggtcattaaggtccattctaatcctaagattttatcctcacatatcttgggtccctccaaaaaaaaaaaaaagtgttttataaaatgtcttgtctaatgactggttgactggtgaccaatatatatatatataccatatatatatttctttaatttattttttaattatactttaagttctggggtacatgtgcagaacatgcagttttgttacatagttatacacgtgccttggtggtttgctacacccatcaactcgtcacctacattaaataattctccaatgctatcccacctcccagccccccacccctcaacaggccctggtgtgtgatgttcccctccctatgtccacgtgttctcattgttcaactcccacttatgggtgagaacatgtagtgtttggttttctgttcttgtgatagtttgctgagaatgatggcttccagatgcatccatgtccctgcaaaggacatgaactcatcctttttgatggctgcatagtattccaaggtgtatatgtggtacattttctttatccagtctattattgatggacatttatataacatatattttcccaagccatttcgcaggatatgcagtctatttcttcccaccataaaagttaaagaaaatctacagcaataatttggtcaattgtggtttactgaaaacttactaggaggctaactttgagatattcactttacttgaatataaatatcacgaagtacatatagtggatagagtacttcctgagacagcacgaaggcccatgtctgtcccctttagctcctcccatagtcaatcattgtgttgagttgttcagtctgcattgtctcatcttctccatggcaagcttttctgaacaggtccactacgctttggtattctctccacagtatagctcagtgattgccacaccacagatgctcaacaaaagtttgatttggagatgacctagaccctacaaaagttgtctgtggtcctgcactcacagcatgataactgagggataatgtacaaggaaaaatgtgttttttttttcttttaaaaaaattttatataaatgtaagggatacaagtgtagttctgttacatggatatattgcctagtgatgaagcctgggctgtcagtatacccatctcccaaatagtggacattgtatccgttaagtaatttctcattcctcatcccccttgtaccctcccacttttccaagtctccaatgactattattccactctctgaatccatatgtacacattatttcactcccacttataagtgagaacatgtggtaagcaaaatacatgttagatatatctctgtaatgaaaggaaaagtaaaagaatcagtcttaaactactgaaataatttatgcatttctcccacatgtggcaaatatatcaactctctttaggtataatatacctgacctcattgctgatagcataagagctttaaacaaatacttattcaatacttagctttttctctcataaaatggaacaagatatactagggtagagaggacgcttctcacgttcactgctgtatcctcagcacttggtacatagtgtttgcatcacaaatactggctggatgaatcagtgaatgaatgaatgaatggggaggctatggatgtgaaatgtttgatatgccttttagagagatattacaggcctttgagtgactatgatatttccaccaagcttctcttttgagcatataacttagtaagtatcttaaagttcatgttgacagagagggtgaaagtatgaatactttcttgagcttggttatttctaacttgttaggtacagttatcaacagtgataacagtccagcctgagctagatataaacaagaactgtatgccagctttcaaattgcagtttccatgataagctggctctgttttgctgccactgaatagagtgccatttagcagtggtgagagtaagaaaaagttgatcctttggtactaaacagttgagacctactcaagggagctgacattttcaacaccacttgaaacttgggcttggagccaggagaaagtttacacacaatcaagagggcactgctgcatctgcaaaagcagtttcctgtagctagatcgtaaaccaagagtgatggagatgagagcacccaagttcataaaaattccctaatatgttcatttgtaaaagaagaaaacaacattggccaaagaaagatgttctcctagaaaaaggaaaagaaaaaaaggaaatccatcttaccctctaggtgaaaaacacaaataaaatgtccgcgggaatattaaatgcttttccaaaatgtgcaaaacaataagcttcctactgtcctggtgtgcaacgtttgagaggaggctggaagaaggagcattcttgtctatgggcacctgcttctgccatgctggagagaaggcaaatctcaaagggtctggtagttaggatgattggatagagtgatatctctatctcagtctaaaggattggaagtactacacattcttccttcatacagtccaccttttctgagcacctgttagcagccaggcagtgtagtaggaatgaggagataatcagttagccagaccacccctgcactcatggatcttatacaaaaacagaggtaaaagacaatcaacaatggactgattccattacaatgatggtgttagaagaagaaatagtactaggaatttacatagtggtgaaatctgacctacttcattccatgagcaggtgacaccgagctgaacattgatgcataagcagaaactgacaaaaggaagccattgccaccattgataggaataagaaataactatttcccaaattctttatgttatcaaattattctccacacaggtgttttggctttgcttttttaaattctgaagtctgaagtttcagaaactacattgtaattgaaaataggtactcccctctttttttctctgatgctttcattaaaaattctcatcatctttttatgttacttattcggaccttaaaatgtataaaaatatgtgtggtttttgctttcagaaggcacacttgggatctgaagcagcaataattatgaactgacaatacgaaggttggctggctctgatgaggaactccaaggaccttaaaattcacttatgtcaagaggggaaaaggaggaatctaccatagcaaaataagacccttgtacaggatacacccacgtgcacacgtgcactgagagaaaatgagagttgtagggggctgtaggatcctgactgtctcatgcctacagtgagaggttcatagagattaaagagattgctcaggttgtccagcttggaagtgacaaaggctgggagtgctgaatactggaatgtaatggaatccatctacaggtaaaaagcctatggcaacaattagagggagaggtaaagtctctgaggcggcaggcaattggtacggagcctgaaagcccaggacaaagttttatttgctttcaagagcgaataggctcacacctataatcctagcgctttgagaggctcagatgggaggatggtttgaattcagaagttcaaagccagcctgggacacacagtgagactctgtctctaccaaaaaaaaaaaaaaaaaaatagaacaattagctgggcatggtggtgtgcacctgtagtcctagaagctgagatgggaggtttgcttgagcccaggaggctgaggctgcagagagtgagccatgattgctccactacattacaccgtactcctaggtaacacagcaagaccttgtgtcacctccagaaaaaaagaaaaagccttaacaaacagaagtgaaggtaccctgagggaatattctatttggctggggactccttatcatgattttacttagtgttgcagcatattgtgttttctgaaggtaggtgttccccctcaatctttctcatcccaccggcccttctccaatgtgaccttgccattcctccatcaagaagggaactctaacttgcctccctcttcagatctaggctaccttatgagttgctggtagccaacaggaggtggtggtgaaagtgacactgagtgacttctcaggctatgccagaaaagccatggggcttgtgcttgattctcttgggacactggctctggggaagccactgaccatggaggtgactgactagcctgacgctgctattttgaaaaggccacatgttgatgctctagtcaatagagtatcaggtgagcccagcgttctgtccaccccggccacaatgccaaaacacgtgaatgaggaaatcattgtagaagtgatctcctcccagccatttacgtttccacctgagcccctagaaatcatggagctgaaataacatgccctgtctaaattgctaacacacagaaacggtacgcacaacaaaatcacataaatatagataaaatccactaggttaaaaggagtttgttacacataaaaaaaatgactgaaataaatgttatattatctatctataaagactactatgggcattgagcccgctgaacagataagaaacccaaggtacagagagataaacccaactagatgatagaatcataagtagaatcttataaatgcagcaataaaatgatcataaaagtacatgtgaggacactgagtttcatagaaaaatgacttggatccagatgcacagttaataaaggcagatccaggaaaagaacttagatttcctgaagagtgctggagtctgaagctctttccaaaatattagatcaagcacggggtagttaaaaaaaaaaatcacatgctttggcatcagatctgggctgattatatccctgaggtaagtttactttatgcctggttgcccctatctttaaatagaaagaaaacagagaaagaaaaatatgaataaaacaatgaaatttggaacaggcttgtagtttaataggatcgtactaacgttaattacctggttttgattattcaactatgattacataaaatgctaatagcagcagcagctgagtgaggggtaaataggaaacctctgcactatttttgcaactttttgtaagtctaaaattagatcaaaataaaaaattaaaaaaaaaaaaaagaaggaaaaaccatacctaacttgtggggttttaaaaaacaaatttggaaaatgcaatgcctggtactttaaaaagatttcagatataattctcctctgcttccctcattccaactttctgataaagccagaacagatggcccacggacttctggttcagaccttgctccccaagaaaaagtcccctcatactgcaggtatatgccagcactttgcagctagaacacctctcagaaaatgaatcgaggaagcagacgatgggaaacttcccacggtagtgaaatctctaaacctcttctctgacctttgaattcttggcagccacaagctacgttcttgccaagagtcctcacgcgtgtagcttccacatctcctcgccctcatttagagggtagacttcctccacactccagtcatccggtgccatctgtctgtggccatgaattagctgaaagctctccgaaaccgccttctcaagctaattgagctgctctaaatatttgaagagacagaaatggggttataccagagatggtttaataaaatattgaaagagcttttttctaacggtgtagtagtccacttccttctttcctcccccagggaaatatgcatcttatcagtttatcatccgaaatgaacttgactggtctgggaaatcggccacaccgtcaggggagagtgaaggagaaacttccgggaaatgatcagaactattttaaaatcattttgctagtgcaaatcttgaacattcataaaacttatctatgaagataaagactgaacataaagaatagcaatgggcttggcctcctaccttaaaaccatagagattgactgtgttaaaatatattgttgaggatctgtaacaggaaacagataacctcggaagttcagcgtgaagggctactgcaccacagtcagcttctggctacaagaggaggagtccatcagttcacaaaaccaatgacttccatcaatttatatttaagtttttttttttcactgaataattctgtccttctaatataaatctgacttttctaaccttgccttatacttcttggaaattcctacttaatatgagtccatataatcagaaaacatgatgaatttggggcacaaaaactaatttttatttatttatttatttatttgagacagagtcttactccatagcccaggctgaagtgcagtggtgtgatctcggctcactgaaaactccgcctcccaggttcaagtgattcttgtgcctcagcctcctgagtagctgggactacaggtgtgtgccaccacgcctgactaatttttgtatttttagtagagagagggtttcgccatgttagtcagtctggtcctgaactcctgacctcaactgatctgcccaccttagcctcccaaagttctgggattactatcatgagccaccgcacccggccagggcacaaaaactaatttttctactaacagttgctgggtatgccatggggcccatcaacaatggagcccactttgactcacagttctgtgctctgagtgagcaaaaacattaacctcaaggcctgtacaatgcctgagcattttctgaatcattaagtacaatgacgcagggaaagagaggacaggaagaaggctgggaccaggcccccttcaccctagtgttctgtcctaggaccgtgagtacagctgcagtcttaggtgtgcttgtagatcgggaggaggcaggaagcttgggaaggaaacagacactttggttgtccccatattgcttctggacccctcatggtgctctaagaaggagagagcaaatttgtctactgagagggacattgtagtggacatcaagatgcaagttagtgctttataaatttatatttcctcatcttttcaagttttacctctgatcatgataactcttttggttgttggtcgtactccctcctgtttcccttgactagtctagaaatccctcctccctaagttctccacccttttctccttttcttcaggccaaaatgttctcaagttgcctttgatgaaactagatctgaaatgacttctagttgattaatttgttcatacaatatactgtgaaactgggcaagagatgatataaacactccttgaagctagctggggaggactctgccactgttttttcattttacaaatgaaagagcctctatttatggcttttgatgacatagaatagtctatttgataaaaattaatagtaccccctctagttctaataaaaaatttatttattataacaatatctttataaatgtggagtgtcttcctcttaatgattttctggaactctagtggtaagatcacattttgattaaccatgcctggctaatttttgtatttttaggagacagggttttgccatgttgggcaggctggtctcaaactctataggcacgcaccaccacgcctggctaatttttgtatttttagtagagacagggttttgccatgttgggcaggctggtctcgaactcctgacctcaagcgatccacccaccttggtctctcaaagtgctgggattacaggcgtgagccaccatgcctggcctcttttcccattttctaattaatcatttgtcttattgagttgtaagatccctctgtgcattctgaatacatgtctttatcagataaatgatttgcaaatatttcctctcaagatatggcttggctgttttcttaacagtatcttttgaaaagcaaaaggttttaattttgacaaagttcagtttatcaatgtttcttttatagattgtggttttggtgttacatctaaaaactcattgcctaactcaagatcagaaaaattttctaccatgttttcttttagacgttttataacttttgctcctctgtttagttctattattcattttgaggtaattttatgtatagtgtaaggtaaggatttaaattcgctgctttttgtatggatatataattgtcccagcactatttgtttagaaaacaatgcttaccccctttgaattgcctttacacctatgttgaaaaccaactgaccatacatataaaggcttattttgggatctcttaattctgttccattgttgtatatgtctattctctctctctctctctctttctctctctcttttgagatgccagagtgcagtggtgagacaatagctcactgcacccttggactcctgggcttaagtgatcctcccacttcagcctcctgagtagctgggaccacaggcttgagacactgtactcagctaattcagctaatttttaaatacatatatttttttttggagagaagggatctcattttattgcccaggctggtctcaaactcctggcttcaagcaatcctcctgtctcagcctcacaaagtgttgggattactggtgtgagccactgcactgggcttatatgtctattaagccaaaaccacattgcctgataaatgtaggctggtcataaattttgaaatgagtggtgtaaatccgctaactttcttctttttcaaagttgcttggctgttctaggtcatttccatttccatatatattttaggagcagtttgtcaatttctggaaaaaaaaaaaaaggcctggggggagcttagatagggattgggttgaatctgcagatccactgcagaacgacagtcttaactacatagaatcttcctatctgtgaacacgtaatgtctctccatttctgtagatctttaatttttcacatccatgtttgtagttttcagtgtgtacttcttgcacttcttttcttacatttattcctaagtgctttgtactttttgatgctatttttattgttatattgtccattgctagcatacaggattaaattattgtagttttgtaggtcattggcttatataaaaaaaatcttataatctttttacaggaatcatatggtgacatgaaaagggttccataatatagtccccacctgctactccagcatcactccccagcacccgtaagtcagaatgtatgtttccctagcactgaacttctaaaaattgatacatgttagatgtccatgtgataatttcatacatttacataatcaaatcaaggtaacttggatatccgtcaccttaattatttatcatttctttatgctagggacattcaaattattatcttctagttattttgaaatgtccaatcagctaatattaactctagtaaatttactgatctacggaacaccaggtgttatgtcttctttcaagctgtgtatctgtacccattaatcaacttctcttccctcctccacactgccattcgcagcctctggtagccaccacactactctctatcttcatgagatccactcgctagctctcacagtctcacatatgactgaaatcatgggatatttgtctttctgtgcctgactcacttcccttaacataatgacctctagttctatccaagttgctgcaaaggacaggatttcatgctttttttatggttgggtaatattccattgtgtacatctaccacatttttcttatcctttcacccattgatgaacacttagattgactccacattttggctattgtgagcactgctgcaaagtacatgtgagtgaggatatcgcttcaatatactgatgtcatttcttttggatatatacttagtagtgggattgctggatcatacggtagttctattttttagtttagtttttttttttttttttaaggaaactccatactgttttccacagtggctgtactaatttacattcctactagcaacgtatgagggttcccctttctccacatcctcaccaccatctgtcattccctatctttttattttaactgggataagattatatctcactttggctttgatttgcatttctttaatcgtgagcactgaactttcgacagtaccctgcaaccttatgatgtttttacttaaatttaatttcaacctcaagtctcagtttatgcattacctcatcctagaagcctttcccgttttctctctacttgcgctacgctgcatacactggggaacgcatgtgtgcatggacactgtcatttctataccaaattttaaactatactaaattttaactaactacttacatgttcatcttgagaaacctgtgtcaccatgtatagcaaaacctgccagttgtttatcgatatccatcttctctttccaaaacaatagaacccctaattttttgctaggcataaagcaaaagaaataaagaccatatttctggccccgcttgccattaaatgcagtggtacgattatcttgcatccagtgagagaagctcatcgggcagctcccagaaaccttccctcaaaaacagccaatgcatatcttgtttttctttttctttttttctttttttttttctccttcttgccagttaaaccagatctgctaaatgaggctagaccagccaccctgagtggatgaagtgaagtgactgtgggaacagagacccacatggggcaaagcaacaataggaggggagcctgggtctccatatcccaccctggtctgcctacttctgggctttccatgagaaagacacacaattctccctgctttaggctgttatttccttgggtctctcttaactgttgccagacttagtcgaaagaggtttataccacatcctattgcatcttcagtacctggtgctgtgccaaacacatagtagttacttaattaatgtttgctaatttactgcaaaaggatagcaaaagttaaaaaaaaaaaggaaaaaaagctttatggaatattaccttcaaatccatcctgctccacatggttaccaaatctctttccaggataataaaatcttaacattttaggcatacaatttggccttcaaaggcctctcagctttttaaatctaatttctattctaatttattcatcatgatgttaataagatgtttggtttttcatgtagaaggaaaagcaaatttatacaatgattccatggatagtcaagagacagaaggcctgtaattgactataataatagatctcacaaaatcataaaactgatagtaacaatggggttcaagcaattaaacaattttgattccacagatgaaaaagctgatgttcagagaggtgacacaactaattccaggccacacaaacattgaatggcagatctgatgtcagaacccagataatctaacttccaacttggtactctcagaatcagttagagtgcctttggttgtcaagagcagactaactaacataagcaaaaatccttttaaaatcttagaatttacaggatccaaagcctggaacaggcaggaaccaggcagctctgttcctgcctggtttccatggcaacatcagctacagagctcatactgatttagctgacggaatgaatgaataaactccaacaacggttattgttctgtttttcattctgattgtagaatgcttctttttcttttcttttctttctctttctttcttcctttatttttctttcttcctttcccttttctctcttttttcttttttctcattctctctttctttctctttctctctctctttctttctctctctctttctctctttccttctctctctcccttcctttcctttccttctctttctctctctctctctctcttcactcctttccaccattatttttgcttactgaatctgcttcccagaacagtggctgatgagaagcctaggcaccaattttctcattcccatttccctcaacctaatatagggagtgagatacaagggtgaacccctaggagatgcactttgagagagagagagagagagagagaaagacagacagagacagaggagaggagagagtaagagttagctctctggctttcctggcttcctctcattttctgtttttatatgcattttatttgttcacatgtttttaaagtctgcagtttgagaccatgagatgacaaggagagaactgaaagccaaacttttgagaatacttaagagaaagttaccaagtgcctgagtcttctatgatatcactgagcaaatgacgacctccgccccccatattttagaaacaaataactgaatgcatgaataccgtaaaggaagatgagtacatacatgtaagcacttagagaaatgagaaaccaccttgtatttttatctggaaactaataaaaagcaaaatgcatccaggaatattatacgacatgcaatttcgcaattcaaggtttttctctttcagtgtgtagagttagccataaagcaaattgacagatactgaatgacctagttaaatcttccacggatgctaatatctcctgttaacaccctgcagcttgaccctaaggacttccgcgcacccatcacatgtatagtatggtgtttatttcttgattttatatttttaatatataaacacattggttatggacaggaaagaccttctgtcttattaaatgactcacatgatttgcctcgaaaccacaagctaagtcaaacttgtgctaagcatggtttaatctgacagaatataaagattctaggacaaatcaaacccaagtgaaagtttccagttttattgccacacccaagttcgataaagaagcaatatgagcttgaattaaacttgcagccgagaaaggttacaacttgaatatagtattgagcagaaagaaaactttccatggatcaaggactcaacataattctaggatctataaaaaaaatatccatctgatcttcaatgtgtgtacattctaggagtaaaacctatgctttgttaatattacaaagtaaagcaatcttctttcttcccaacagcattgctttgcccattttagtctgttatgtagcattatccatgaagagcacgacaagggaaatgtacagcgagcccttgttaatggtcttcggagaaaatggtttaattgcacagacaaatgctgagtcaaaggtgattgtgcaagccagagaaggaagaaaagaaaatattttttaaaattagccaataatccatttataaggacaacaaacaatagaagcttaatgactttttgccatattactaaaacatgtaagaattacacgtgacttctggaacacaaaattcttaatcccaggtcagaatagttaattcaaaactaatttgttttcagggaacatatctgagaaataataaaatgtagggtctcagctcacatccacccttgctcagatgaatgatcataaaaatggtcctaggcaaggccacagggtctggctggctgaggactttgtgcactggaccatataccatgagcagtgagttatttcaaactccagctatggggccagaaactccttaggagtccgcaccagaatgtctagaggagcacgtatattaacaagcatattttacacttaaaaaaaaaattaaccacagaaactgagattccaccagacttccttgataggaagataaattgtaaaagttttactgaaggacttaatttttaaaattaagccatttaatttaaaaaaataagacttttaaaacaatgttgagaaacacacccttcaccagaagaagaaaggggcgtggccagggaagcagagcagttccgcctgtacctggtttatgcagtgcacttctgaatattgccttcgaggaaaggttaggacaggataaagcctccagacaccaccgttcgagtataatttgagccaggaaagctgtcagtgcagctttttactgtgttgtagaatcctttgggaaagaaatcttttcttgggttcctctgagaattccgactgaggcaaaaccagatttatcagggattttgcagatatcctgaaacaaaccgtctctcagcgtgagtctaaaactccatccgccaagaccgtcgctgggactaagccctgaagctgagtgatcacttgcttcctctgctcctctctcgtaagaattccttccctcaaaggcctcacaggctagatagggaggcagacacaccagagaaacaacagtgaagcatgcaaagtgctgtgaggaagtgttgtgcaggtattgtagaagctcagattgggagtgcctagggctgaccgacccagacagtcttttatactgggcatgtgtgtgtgtacatgcatatagaaatttggggaggagaagaaaaagaaataaaaggaagtaatagtggctgcaacttctgcctacagatactatgaccttgtatagataatgcttttgtgactatgacttggccttgcttgcaacccaccatctgagtcctgctaaccgaggaccaactatttaggaacaagctacactgtgccaccaaaacagacatcaacaacacctttattacatacacaattgccccaagaatttttatatatactattttcctttgcagcaactttactcaccctctctctcttttttcttttaaaatttttagaggagtttcactctgtcacccagggctggagtgcagtggtacaattatagctcaccgtagcctcgaactcctggggtcaagtgatcctcctgcctcggcctcctgagtggctaggattacacatgtgtgtcaccaggcccggctactaagctactaaccctctcttaaatacaagctactaaatctattgaatgatccgggaagaaacaatatgaaaaataaaaagataattaagaatttcacaaagcaaatatatgtataatgtctagaagaatcaaagatggaaagataatatggtaatatgacactaaagagcctgatgaactttttgatttgttataaaacatttaaaaattttccttcaatatttaattggccaatgagtctccaaatagctattgcctctctctcttttttttttttttttttttgagatacagtctcgctctgttgcccaggctggagtgccctggtgcgatctcggctcactgcaacctccgcctcccgggttcaagctattctcctgcctcagccttctgagcagctgggactacaggtgtgtgccaccacgcccggctaattttgtgtatttttagtagagacgggtttcatcatgttagccaggatgttctcgatctccggacctcgtgacctgcctcccacggcctcacaaagtgctgggattacaggtgtgagccaccgcgcccggccatccctctctctaactcttaatccacattgccatgcattggttccctgctattaacctctttggttctaatctagatgatggcatctgctggtcagtgtcctggtccaatgtggatcccatccagcatgctctccaccttacatgcagagcagtctttgtaaatcacaaatctcatcatgtccccccttcactcaaatgcttagatacagcctttcaggataaagtccaaactttttagccgtctataatctgactcttttcttgttacttgctcaatttgggacatgtactctggacaaatgaactgtgtcataccccaagcacgccatggtcttgtgtgccttcatcttttttactctccactccttaccagggatgaactgcctcccattctcagtctagatccgtggttctcaaggttctcaagggaacagtggcgacagcagcaaacgggacatgtcagaaatgcaaatgatcaggcttcatctcagatctcctgagtcagaaattctggagaatggaccagcaatctgcaaataaggactatagaagatcttataccacagaaaagctaggcagcgtgcagagaactagagggccatcgatgacttctttgcctgcagttcagcaaatacacagcagaagtgaagaccactaggtcacttggtcaagctattcataaaacagaagtggctcaaggagaataaatggattatacgcagggacccctgtagcttgaggagtcagatagacattatagaaacagagactgtcagtgtcccaggggtccaggaggtcaaatagtccagtctcatcatgtcacagaggataaacaggagtcctggaaaggtgaaatgacttactcagtgtgagacagatggccaagagaacactgaaaccaaagtgttttagaaggaaaaagctgcatggtaaaaacagctgagtcatctgatggacactgacacaggcaagtccctcggtgggcacccaggcagaatgagaagcatgacatgtttgttcttaataactcagtgggctgatcctgcagtctaggcaccctgctgacgggaagaagcaacgactcagttagactcacgtggatctgtccagcactggacgtcagcagtagataggtttgatggagctggaaagtttatcctttaaaaatggccacaaatattacacttataaatatgtatgtgtgtgggtgtagaaacattacttgtaaaaaatgaaacctgttagattagatcaaactaggttgccgcttctaaggtagtgaacgtgtaaaagagtaaacctcatagaaacatgaggctgcccaatgcatgtgtacatgttggtgttgtgtgcatatacttcatcatatacatatagttagaaattgtatgtataattaaaaatataatcattcaatcataacattaaacagtgaaattattacatcataatgttaatcataacatggagcaattaaactacagtgttttatgacatatagttttaaattataacattaaaaatataggtaaacggctaggatcggggagcaaatattaaagtaaataaatccctgccctactccctgagccctttctgctcatattttgcactcttctgaggactgatgttggcctcccaggcttcaggacaacctgacatcaagatgcctttaggttctttctgacagctgctgctgcttcttcatcacagagagttcatttgctctcctcggcaggccagagctaattaagaagagaacagcccaggttcaccctcccaaccctcctcatcggctagaactgcctgtttgctgccctccaggtcttctgcagtgagaccccctgcttttctccagagagtgaggaaaccaccactagaggggtggggtctcaacacagacatatttacccaacaggagcagaatgtttccatttgacaattccactacaagaagcaggccttcttggacctcttgcccaacttctggccttctgattctaagtagaagttgtcatttttctatgactactattaggttggtgcaaatgtaattgtggtttttgcaatgaaaagtaatgacaaaaaccacaattacttttgcaccaactagtgctagcaatgccttaaaaaataaattgggctcaagatttcttggggcataaattgttttgtgctgttttccgtttcatctccatgttccacgggcttaaacaccacagagcaaaggcagcacgtgtctgtggagctgccccctttccaaggaagctgctttgaccttcaccttctgcctcctggtagtgtgtgatgatcacatggaatagtaaccagagctgtgtcacacttcacaaaacaccttggggattttgtgacctcaaagtattctcttcacctggcaggtggcatgagccatgggagatcccgacactcccaactttgctaccaatgactcagatagagggacacatgtatacatgtgtctgtgcacattaatggaccagcactggccatgtttctatgaggccttttcttttacatgattaccatttaagaagcagcaggtgaatctaacctattttgttttcttacaagtaatactgtgttcgctttttgaaatttcttttctgaactttagtaaaaccatttgctactctttcactctctttttgtgtttttttttttaatttttaattttgattttcataggttttgggaaacaggtggtatttggttacatgagtaagttctttagtggtgattcatgacattttggtgcacccatcacccaagcagtatacactgaacccaatttgtagtcttttatcccctactgccccccaccctttcccctgagtccccaaagtccactgtatcattcttaggcctttgcgtccttatagcttagctcccacttataagtaagaacacacaatgttcggctttccatccctcagttactttatttagaatatggtctccaataccatccaggttgctgctgctgcaaatgccattattccgttcctttctatggatgagtagatagatagatagatagatagatagatagatagatagatagatacaatttctttatccacttgttgattgataggcatttgggttggttccacattttttgcagttgtgaactgtgctgctataaacatgtgtgtacaagtatctttctcgtataatgacttcttttcctctgggtagataagcagtagtaggattgctggattcaatggtagttctacttttagttctttaaggaatctccacactgttttccatagtggttgtactggtttacattcccaccagtagtgtagaaggtttccctttttaccacatccctgccaacatctattattttttgattttctgattatggccattcttgcagaaggagtaaggtggtatcacacggtggctctgatttgtatttccctgatcattagtgatgttgaggatttttttcatatgtttcttggccattttcacatcttcttttgagaattgtctattcatgtccttagttcactttttgatgagattgtttgttttttcttcctgatttttggagttccttgtacattctggatattagtcctttgtcagatgtatagattatgaagattttctcccactctgtgggttgtctgtttatactgctgattatttcttctgctgggcagatttttttagtttaattaagtcccatctatttatctctgtttttattgcatttgcttttgtttttgtgtgtgtcttttgtttttctcctctcccactcttatccccaacccaactttgatttctctctttattctctagaacgtgaattaaccagcagcctgcatttcacatttaactgaagaagcagaattgatgagtgtcacctgaactatcttgaacatttcatgtcacattgcatgtcagatatttaatcttgacacctcctctccgtccagagccaaaaagtcaccaggaatgaagaattctttcttcatcatatagaattttgtaggccatggaaagcaatctagacattattctaagtgctatagaaaactgtgtttgagttttgagcaggaaagtgatatgatttgaattctacttaaaaactcaggctgggaaatagaagaatgaaagcaaagagaccagtaagaggatttattgcaagaatgaaaggatcacatgactatgggggagagaaatggatgaatttgggatatattttgtgtgcagccaacaagacaaaaattaatgcttgcaaggaggggaaaagaggcatgaagggaaagagatggatcaaagaagattcataggcttttacttgagcaactaaatccttgcagctgccctttaacaaaatagggtacagagggataaaggaaatttggagagagaaggaataaaaagttctattttggccacattatgtttcagatacctactaaacacacaaatagaaacgaaggaaagtggtcaccttattttaatgggaaggcagcaacctgaaaacctagtcatcctggagcatccagcagagaaaatttctattgcaagaagtaaacacttgattttgccttccagacagatcatttcattattcaaagaacattttttttcagaaggaccatgagatatgcaaatatatagcagagatttttcagggtacacaggtgttagaagctaaaagtagtggagcaaggtgacaaaaaagagatcctttctagcgggcagtgaaatgcctatatattattttctttagagcaagattccctttccaagtatgaacttaaactgacctatccaggtacatattattattttcttagaaaatgtgtgtgtgtgtgtacacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccaccaaaaagtgggcaaaggatatgaacaggcacttctcaaaagaagacatttatgcagccaaaagacacatgaaaaaatgctcatcaccactggccatcagagaaatgcaaatcaaaaccacagtgagatatcatctcaccagttagaatggcgatcattaaaaagtcaggaaacaacaggtgctggagaggatgtggagaaataggaacacttttacactattggtgggactgtaaactagttcaaccattgtggaagtcagtgtggcgattcctcaaggatctagaactagaaataccatttgacccagaaatcccattactgggtatatacgcaaaggattataaatcatgctgctctaaagacacacgcacacatatgtttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccattattctcagcaaactatcgcaaggacaaaaaaaccaagcaccgcatgttctcactcataggtgggaattgaacaatgagaacatatggacacaggaaggggaacatcacacaccagggcctgttgtaggttggggggaggggggagggatagcattaggagatatacctaatgttaaatgacgagttaatgggtgcagcacaccagcatggcacatgtatacatatgtaactaacctgcacgttgtgcacatgtaccctaaaacttaaataataataaaaaagaaagaaagttggacttaagaactgtaaaaatgcaaggtgatataatttggatttgtgtccccacccaaatctcacatcaaattataatccccagtattggaggaggggcctggtgggaggtgattggatcatgaggatgctttcttatggtttcgcactatccccctagtgctgtcttatgacagagttctcaagagatctgcttgtttaaaagtgtatagcacctccccacacccccctcctcttgctcctgccgtgtaagtgtgctcacttccccttcgccttccaccatgattgtaagttttggtgatgcctccccagaagcagaagcttgcacagcctgcagaaccatatgccaattaaacctcttttccttataaaaaaaaaaaaaaagaaaacgtgtgtgtgttcaggcctggcacagtggctcacgcctataatcccagcactttgggaggtcgaggtgggcagatcatgaggtcaggagttcaagaccagcctgaccaacatggtgaaaccccatctcgactaaaaatacaaaaattagccaggcgtagtggcaagtgcctgtaatcctagctactcgggaggctgaggcaggagaattacttgaatctgggaggcagaggttgcggtaagctgagatggtgccactgcactccagcctgggcaacacagcgagactccacctcaaaaaacaaacaaacaggcaggacgcggtggctcatgcctgtaatcccagcactttgggaggccgaggtgggtggatcatgaggtcaggagatcaagaccatcctggctaacatggtgaaaccccgtctctactaaaaacacaaaaaattagccaggcgtggtggcgggcgcctgtagtcccagctactcggaaggctgaggcaggagaatggcgtgaacctgggaggtggagcttgcaatgagctgagaccacgccactgccctccagcctgggggacagagcgagactctgtctcaaaaataaataaataaaaaaccgaaacgtgtgtgtgtctgtgatgatggggtgtggatgaagactgggcaagctatctcaaaggcaatcagaaattgacattccccccaaaatccaaaaatagcaggaaaggtatgtaggccacagagtctgcttgagggtgagatataattatagaagggaaggaaacctggactgataaatctatctgtctttttccacttgtcatatatataccaatgcttcactactaaggtagtgaaccgtgatagagcatggttgtgaaattgaaatcctgggaccagaccatgtccctgcgggtagaaggtaaaattccttccaaaggaagtagatatttttactgtctgtgttccaatggagagatccattccagtactaatacgaagtttaagaaggcatgtgttaaactagaaaaaactgaagatgaaaagaacacagcttcctcctaagagacttagaggaagcatggctctggatttcgattgagtactatctacctgtgagtagtccttcgggggtaggcaaagtggattctgcaataaggcattaggccagaagctaagggtctgggtatgttggctttaatagttaccatatctagttgctattataaattgtcctctttgttgtttttttttctattattgaacacactgtaaatcttgtagaattagaggcccatgcttggatgaaacatcatgggggagagcagtagcagtccaaagggagccatttcaggaagtaggggatacatgaacgtcagctgtggcccttgcgcagaactgagagtgctggctagctgaggaacacagcagcaagggaaggaattagtttaacagttaccatctcctagaaactcccagaaatacacagaaagaaaattttgcaaaagactaaaattactgcattcaagcaggagggaggctgggaccattgtacatatgttctttaaaagggaatatgttctcattttatctaaaaatgagacacacctggcacatttgtctgtctccttctgtaggctataagctctttcaaaacaaggacctatcatgtcagaaagacttaataattatttacaaacgaaagaataagggtatccttgaatcaagcctttaatttgaataactcgattggttttacagtagcaccaagttctacttcctcatttacacattgtgaattacaatgctattattatttggaagtaatggcttttaaatgagcctggagttgaaatcgtaggaagaaagtagttctgtgtatgtaaattatttggttgatgaagggggcctgccgctccacacctgtgggtatttcttgcaaggtggagacgagagactgaggggagtctgatctctctttcccccacaggttgaaagagatggttgcatgctgttgttctttaccaataatgccagggataactagccacggagggtcaaagggtagtaaggctttgtaacaactttcttaatgcaatgcaatcatacaggtggtatgcatggccaccaaggagatgcagattggatttaactagaataacctggggactaaccaaggttccttttctcaactaaaaaaaaaaataggtatagtgatgctaaatctctaaatactcttagaaagattaagaaaataattataagatatatgtcctcatgatggaattaaaaatgaatgtattaatgtcttgtattggtagatttgttttatgacccagcatgtaggctttcctgataaatgcttcacgtacacataaaatgagtatgtaatctgcagtaattggatgatgtaaataactctctatatggtcaagctgatggatagtgtttcttgagttttctgtatcttcactaatggtccatcacttgttctgtaaattactgagagaagaatgttaaaatgtccaaatatctttgtgaaggtatatctttctccctttctgtcactttttgcttcatggatactgaaggtatgttattaggtgcataaacatttaggattgcgaatcattatgattttaccctttttatgtctaataagacttcttgtcttgaagcctattttgatatttatacaaccatgtgcaccttcttgtggttagtgtttgcaatgatgtgtatttttccatgaatttactttcaattttttaattgctgtgcatctttatatttaaattatatatgtgcagaatcctatggctgggtcctgttgtagatatatatacatatatatatatacgtatatatatgtatatatacatacatacatatgtatatatatatacatatatatataatcaaataatctctgccttttggaaaaatatattttggtcgtttacatttaatgtaagtattgatatgactgtggttcagtctcccatcttgctggcttttttaatatttggcatctctgatcttcgttactttgtcccttatctcttcctcatttcctgtgttcttttgtgtgaagcagtattttttttaaaatttcttctatctcctccactgcattttaagctacatctctttgtatttttaaattcattcctagagtgaacatatgcatccttaaagtgtcacaatctactttgagcaccaatactaaatgttagggattcaaacacgagcaaggcatatccctccttttcggatgagtggagaaggcagacatgtaagtaataaatacagcaaaacctctcactattcagaggacctttaacatggccacaaggctcaagcttatcattcgacgaacttgctaccagtatttcttggttgtacagattattttttcctcttcgctcactggatttcatatttgtctgaaaacatttcgccctgtttttaactaaattgtgttgtcatttgtatagtctatatacaagtgctttgttggatatgtattttgaaaagattttctcccaatctatatcttgtcttttcatcctcttcacagggtcttccacagagcaaaagtttctaattttcgtgaggtataacttattgattttttttggtttatagattgtgcttttcatgttgcatgcaggaaaactttgtgaaacctaaggactctaagattttcttctatagttttatagtttcaggtttcgattttcactatatgattcactttgagtcaatttttgtatgtggtttatggtaaaggtcaagatttttttttttttggcatttgactatacctaatttatcctttccccattgaattgtcctagcattttgtcaaaagtcattgctcatatatgtcatctatttctagactactgttcccttgaaatattggtctatttttatgccaatactacactgttttgcttactttacaataagtcctgaaatcagtagtataaattccttaactttgacgtctgttttcaaaattattttggcaattccagacctttttcatttccatataaattttataatcaatttgtcaggttctacgaaaaagcctgctgagatttcaattgagattgcaatgaatctatagatcttttgggggagcactgacatactaatcatatcacctcttctgaacatatgcattcattatgatctagcaatctctttctaagtatgtcttagaaactcttggacaagtgaacaaggaaatatacacaaggatgcttctagtactgctgcttgtaacagaaagacaccagaacattttccttatcacttgagaagatagaaaaatggtggcatatttatacagaaaaaaattttggaatttcatgtggcagttaacaatgaattgactcataaacataacagttacattttaaaaaaggaatatatatagtattatcctatcaatattacattaagaaatatgtaaaaccaatcacatgttgtttgagaaagcaaatatatgtgttaagactatacagaagaattaggaaattataaatacaaagttcataataaaattcataatgagctttttacaggatggggaaagcaataaccttgggagggccacaaagttgtatttcttaatcttgatggtgagtacacagaatgttatcaaagtgttattctatacagcatatatgtattttagtatatccttttctatttaatatttaatatctaaatcatttttaaaaggaaagacagagaattttatcgagggggaggaatcagagtaaacttaaatcttacactagtgaaacagggcacaagcatttatggttcaattgtgtaatcgattcttcatttatactattccatttgcagcttatgaactgcaaaacagcatcctgaataaatactaggagtcgccaatgtaaacctgttaatattgtgggatttttttttttttggacactcaccttctgcaaagtaacaaaagcactttaaaatgtgagaataaatgttgttgattgcagaagaataccagggaaaatagcacaggccatgcctttctctcttactcctcctattgggtctgcaggcctttcgcttgcatgagtcatccatactcaggtaagcactgtgcctttattctttattgcactaggcctcttgacaaatgactgtttaaggagtgtttgcacacctgtcaatggttcctgtcatttgtcaagtaacaaatataaaatctgataactaaacaggagaaaacctgtataaaccaagaaatattggtaccataagaagttcaacagatgataaggctaagccctgtggctctctggaagcccctccgaatagtgagtggttctgctgtatttgttatttatgtgtttgtctcctctgctcatttaaaaagtagggactatgccttgctcatctttaaatccctaacacttagcattggtgctcagtaagtgtccttaattgatggaaactgatatctgttgatcccaaataaaaacaggtcaaagccatctttcacggcatattttcaaaccttctgttttcgcattaaatcgtgaaccttttgaaagtatctacacacttttaaaatattttggaggcattattcaaataactattttgatactgagaaaatactaccagtggcatagatacaaattaactcctggatgcttttaactaatttttgtgtttggtgctaatgaaaaagtacctgaagcctttaactttgaagcccgggcttcaaagacatgattgctcagatgtcttgctttattgttgcagtttagcaagacaagaaactctcccaaaatgtcttactattatgtactcactgtagagaaaatatgattgtgaggaagaaaagtaaagaaggaaagcagtgtgagagttaagcacttgaagtttgcctggagtgaagaaggtcctaccagttaagtgctttggattttttcttttttcttttctttctttcttttcttttttttttccagatggagtcctgctcgattgcccaggctggagtgcaatggcgcgagcttggctcactgcaacctccttctcccaggttcaagcaattctcctgcctcaacctcccgagcagctgggattacaagcgcttgccaccacgcccagctaatttttgtacttttagtagagacggggtttcatcaccttcaccaggctggtcttgaactcctgacctcaggtgatctgcccacctcagcctcccaaattgctgagattacaggtgtgagccaccacgcctggctgggattttttcaagaatgtgtactcaaggtccaaacttttagatcatttgaaggaaatccttttgccactctcaggtaaatcactttggagctctgtaaagagtaaaacagccctccgcagccacacacagatttgcatggtggggctgcggagcctcggagtccaagcgtgacttatagtccctcataagcagaggccaagaagaggccagcttttggctttttctttctttctttttcttttttttttttgagacagagtctcactctgtcacccaggctggagtgcaatggtgtgacctcggctcactgcaacctccacctcccaggttcaagcaattctcctgcctcagcctcccaagtagctgggattacaggcgcccaccaccactcctggctaatgtttgtatttttagtagagatggggtttcgccatgttgaccaggctggtcttgaactcttgacctcaggtgatctacctgccttggcctcccaaagtgttgggattacaggcgtgagccacagcgccggaccttgactttctttcttgataactgtaaaagcaactgaaacagatgatgaaagaagaactcactaccatgagccagagcccatagttctcaataactcaccttgcccctgagctgacaccctcccacaccctgcaacaaatacatgtggttttctttctttgagaaacatcactatatttgggcaacatgtcacacacagcccagtgtattctcggtttcccaagtaacctgtagagaaattctatgatgtgatgccctttttcctggaggaccatagaattcagagggagaggaggccttgagaccatcctcaggtctcctgcctgaatgttgctaagcctcaggactccctccacccacatgcaaccacacatagcttttacaaataaattaagagtaagtcttttgcgggtaggtattatggcattttcacctcctctaggcagaagtagtgtggtgcatttttaaggaaggggaggttgctttgcacaggcctggaggcagaagatctagtcatccatatctccccaaagcacactgccccccttatcctcggacttgcttctaagatttgctgtcttgctgagaagttagcagtactcatcctctgaagatgctagactttccagatatttggggaaagccaatgtaatacatagcaccctaggtcagaagtgtgccttgagacagagttctacagtgattacatattttcttcctagtctgagcagccacatatcaactatcaagaaggtttctaccctattcttgatgctatgcctatgcagtttaactccagaatttatgaagacacataatactgttgacagattggatgagaaccattatcatttccccagattatcgacatgtagcatgctattagtaggagacaagcagtagattatgatgtcagtctgtttatgtgtcttctcactaagagaggtgagaaataaaagccagtggggatagaagactggttttggtctggcttaaacctccatactgtggggttttattctacgtagtttgctgtaaacgtgtgcccacttcttccttcttgagggctcccaggtggccatagatctctgtgacatgaagcttctttggagtattctgatgataaaagggagaatttcaattccatttgacaggaagagtcactccctccttgaagtggaaatgaaaatggatccctaactgtgcaagaggcaacgatgaaatagctctccctctgaccctccattaaatgacagcaggcagtagaattattatttggtactttatgcccaccgttgtgtcagctgtacacatgggccaaccacacatttctctccttccataattctgactcatgctgcatgggcttgagaacaatgttgaaaagttcccccagggtttctgatttacagtcccctcccttttccctggtattcaactaatgatttagaagctggaagtagaggaggctcttcttatttctgtcaaagagacagaaaaagagcagtcagagacagactaagaaatcatgattctaggaatggaatgtcccattctagaaggacagtgttcaatgtggtgaagaaattgaggaggagagcagtaggcagaggttattggttttgatggtgatagattctgttaagaaattagtggtaaaatcctggctaacacgatgaaacaccatctccactaaaaatacaaaaaattagttggatgtagtggtgggcgcctgtagtcccagctactgggaagactgaggcaggagaatggcacaaacccgggaggtggggcttgcagtgagccaagatggcgccactgcacccagcctgggcaacagagcaagactccatctcaaaaaaaaaaaaaaaaaagaaagaaagaaattagtggtgaagccatgctgtaaaggggttagaagaatatgggagtagtttgaagatgtggcaaggtcatgtttgtgaacaatggaattcacagagaagaaattttcttgagctgtgatttagtcagattgggatgctagaataccacagactgggtggcttaaacaacaaaatttatttttcacggttctggaggctggaaagtccaaggtcaaggtgccatcatggctcttcctggtttgcaaatggcgtcttcttgtggtgccctcacatgctggacagacaaagagctctggttccttcatcttctaaggatactaatcccatgacctcatccaaactcaattaccttccaaaggtcttacctccaaataacatcacctcggggataacggtttcaacatataaattttggaggagacacaaacattcagtccatagaaagattttttttgaggtttcaattgtataattcttatgaataagttacaagatgtcaactatttattctcagaataatgtttaactgagtaaattgcaaatctataatgatatagtaaaaaccacattgtctgggattttaccacctggaaagtgctagatatcaacacttctgacatttcccaagaaatatttaatttattcctgaggctgatgccaaaagtcaccaactctatgctgaaacacccactacatagcatcacagaatttcagaactgggcaagtatcccatccaaccaactatccttctacagatggagaaacataggcctcatggagaatagaagatgactgttgaagtcctttctaaccctgaagatatataatctcagaaactagcttgctaaagttcatactattcttttaaataagtgaacaccattctctgatcctgattatgtcattactagtgggcaactattgttttttaattcatctgagtgataaatgtgaaatagtacaagcagactatcgccagttctgaatcagctgagtcctaatttatgaggtataaataaatgtattttgagcttctcctgggaatgagagcctatctataatgtttcaatcctgaaaccaggttttatagaagagagactggcattaatcatcacctaaaatccttccaactcatcattgacaggtgtagttagtgatacccatggcttttacacaatgttgtttaaccaggaccaaatagaattctaggaactgattgtccatgacaggaaatcctacctaaacaaaaggcattctaagctcacacagaaaaatgagcaggcctgaacttgagggaacacaagaatgacaacaattgctacatttaaaccaagtgaggggggtaaagagaaactgctgtcagcatttagggagcccaccatcctggttgaagcagacagggcttgattcctgagagatctgcaatgtgcttccttctttagataaatgtggagagaattctgcattcatatgcaactggaattctgaattctgcattcgtattcaactggaattcagagaattctgaattcatattcgactggaaatatggtggttcctaccgcgatgtgcttttctaaaactcccaaatgggtgttcactaagtaaacatgcatttcaaagagaacttaggtaattcccttagcaagagaaaccagaaattctgactggggctccacaatatgtttatgaaaataatctatgtttccggaaattttgggacaccagcggtaaagaaagaaataagactgagaagtccttgaaaatgacaaactaaaaagaagagagatctggaacaataataaaactgcacatagatgagggaaagtttcaagatcttttaagataccagttaactaattgggaatccctgttctgtaattctctagccacacctcccccaataaaacaaattcatttcagcaagactgaaccatcaatttcttatttatgtaagaggatatagaaaattagggtgtcaatattttaaaatttatgcataatttaaaattatacattttttaaaaggctctgggtggttgtaaaaatttaaattccctctcaaaagatctttttggaaattattaaaaagactatgctctgaaaaaaatgtttgtcaacacctggcatgatttcaaagagtgatcctgcacagaaaagtaccaaccagctgatatccacagaaacacttcactgtcaatcattgaggatgaggatccaccataactgtgaggtattcctgttggtcacttatttacaatttcttcaagcaactgtcatactcaggtcaggttgccataacaagaataccatagactgggtggctgacacaacagaaatttatgtctcacagttttgaaggctggaaatccaagatcaaggtgttgccatatctggtgtgtggtgaggggccccttcctagctggccaatgactgcattctcgctgtgtcttcacgtggtggagagcacagggagtgagaacaaggtcttgtgtctcttcttataggggcactaatcccaaccaggagggcttcacactcatgatcaatttacctcccaaagaccctacttcttaatatcatctcattttaacacatgagttttggggaggcacaaatgttcagtccatagcaaggatatttgtcaacttctcccgtaggccaagaccccagttattcttaaactaccactagaaatacacacacacacacacacacacacacacacacacacgtgtgtgtatctatatatacatattgtatatatatgtgtatatatgtgtgtgtgtgtatacactatatatattgtgtatatatacagtgtacatatatacacacacacattgcttttctaagactactgtcttagtccatttgggctgctataacaaagtatctgaaaccggataatttataagcaacaggaacttatttctcatagtcctggatggtgggaagtccgagatcaaggtgccagcagattcagtgtctgttgagggtatgatctctacttcatagatgtcacctctttctgtattctctgacagagtcccccaaacccttttataagaaaattaatgccattcataagggtagggccttcatgatctactcaccacctaaaggccctacttcttaatattatcatattggggatcaagtttcaacataaattttggagggacataaacatttaaaccatagaaatcactgtctcctaacagacacttaggaatactttccaaaaaacttaaaccaacctagattgtgccaaaattaaccagtcaatgaaataaaaatttgaaaaaatttgcaacactgtgcccaaaatgtttttatctaatttaaggggaaacaatacatttccctttggggaattaaattctgtccaaagtgtgagtaaaacatcaagttttaattcagaaggccaatggtaaggagattctttctccaccttctcttttctcacctctcattctcctaccctccttgcaagcacacacaaaggaaaaaaaatgtggtctacattgcctcatagataaggaaccagaggcacagagaactgaaatgcttcactgtatttcatgcagaaagtgtttgctagaattagaattcacttttcactctacaagaccaaacacgacatagactatatagttcctttattgtcattgaagatttaaaatctataacacaatgcaggtagaatgatgtaaattatgtaaagatactcatatagtataaaggtattataatatagtatgtagacactatgaattccaacctcctaaaaacttagctctcctgaaaacctcagagtaaagaaaagtctattgactatgtaatgagactatctctgataattcttatatatagtattctggattggcaagaagtttatttctttttttatttcatcacattcatttagatttatggaagctggaaagatttcccttctcttatggaaatggaattaattgcagcacttcaataatctcagtgaaacccatttcccctggggaaatgaggaaagagacctagacttaatgtagataaaacaaattgacatgggacgtgaatgggagagaaatgagaaaaccattctagactaaaggtcttacacatttcaggaacgagaagtaatagagggatttttattggcagaacttattgaatctcataatttataatgtttaaagctactggtgaccttttcaaaagcaattaattcggttacatatttattgggagctacatcaagctttcaggagtcatgcacgcataccaaggtctttaaaggaacagaattaagtagataaaaggaggaaatcataaaatgtaacatcctttcccaggtggccacagcttgttcttattctatgcttctattagtaaagaccaaggtcacacaagtcagaccacttagagtcctaacaaggaacagacacccttgcaggttctaattgaactgatttgggctagaaactctgtgaacatcactgaagcctgaattttaacaagcaaaaattcaggagggaaaaactattcagatggtcttctacgggaggcaaaatacaaggaaacttttctacgccaacgaactttgcctagcaacgtgataattcacagagtattatcctgcaggcttcaaagacaacagacaatcagcctaaaagttacacctttgcttttaaatttcttcatataactaggaatactggtgtaacaatgtcaattacagcagggggccatacttcacaagcaggaaaattgtagagagatacaggtatgcgccccagttcctgcccctccctttcccacaatggaaagaccacctttcacttcttcgctcactccccatacttccagttaatagcatcaatttcaaatactactacaactttctcatgttccaaaaaattgacaagcacatgaacatccgttcaattttctctggcaaatatttatcaagcagcaaataatgtggcactatactagccgtggtattgattaggcattatcctatcttcaagaagttcactagttaatggacctttgggtgtggcatataaaggtatgataagtataagggccaaaaagacaccacaaagaacaaaattaggaacaaattatgtattactggccaggcgcagtggctcacacctgtaatcccagcactttgggaggctgaggcgggtggatcacctgagatcggtagttcgagaccagcctgaccaacatggagaaaccctctactaaaaatacaaaattagtcaagcgtggtggtgcatgcctgtaatctcagctactcgggaggctaaggcaggagaatcactagaacctgggagatggagattgcggtgagctgagattgcgccatcgcactccagcctggacaacaagagcgaaactccgtctcaaaaaaaaaaaaaaaaaatatatatatatatatataattaaaataccaatctaacagcaacaacaatatgttttgatgctcaagaacatgtccaggacaaagcctgcaggacacaaggtccctgtgccacctgcatctgtcactgcatcattggttctcatgacatgttccagcctcaactgatgccactatacttaattggcacagtttaaaattataaaatattagtagtaaaagggaccttagtgaccatctaggcttatttcttcatttcagaatctagcctagagattaaaatgttggtttttatccccataattaatttgttgaatcgtcaagaccagaatgaatgaaagtcatttaccttccagtcctatattctttagctacaccacactgtctgccatccatatggaatttgtcctatacccacccaaattcttactgcttcgtctcagaaagtcttgccttcaccatggaactcttctaaccactgtctctattgatctcactcttctttgagctcctacaacactcacaggctaagccacaattgtcctatcaattactttattgcttctcgtagggaactctcccaagtacacagtaggtcacttgaagatagagactgatcctcaatagtattcttgtgatcctagcttctgtcgggcacagtcaaggcagccctaaatacctgctcagtggctgaatcatcatttaatgtaacctcacctccatttactatattgggtatatcaaatacttgctattacatgaaaaagccatacctgtcttcaaactggcacacctgctttacacagggcagccaatttgtgctttaaaattctaaataaatttagctcaggtgaagataaggaaaaagagtaaggtgtgattcagttgctttttttcacatatttgtttctcagtttttgtgtgtagaccttggataaggcatttaccttcactgaatcttgaactcacctttactataagggtaatattatctactttacaagtacacatgcttattgtgaagattaaagaaaattgtgaatggcaagagcatatcacactaatgcccatgttttccatcctactgctctagcctctaaaacccaaatccatcctttgtctcattctgctaaatcctgggaaggtgctagcagatatctaaggagttggttaaaacagacttaaggtgagactcctccctaagacagttttttcatggacacaggaagaggaacatcacactctggggactgttgtggggtggggggagggggaagggatagcattgggagatatacctaatgctagatgacgagttagtgggtgcagcacaccagcatggcacatgtatacgtatgtaactaacctgcacaatgtgcacatgtaccctaaaacttaaagtataataattaaaaaaaaattaaaacaaaacaaaacaaacaaaaaaaaacaaacaaaaggcagtgtttttaacaaaaggcttcttcgaacctcaaaggattgctgttctcacagattaggacaggcactggggaagagggccctgctggtgcctcaagtcatccccagaagcagtagcctcggagtgtcttggtaagtggatgcggctgggaacagaagtgcatgcagctgggactagaagccctgtgctctagtttcagctcttgctacattttaagttgctcttcttaaaaatgagggcaatgacactttgggaggccgaggcaggtagatcacaaggtcaggagactgagaccatcctggccaacatgggagaaacccagtctctactaaaaaataaaaaaaaaagaaaattagcccggtgtggtggcacgtgcctgtagtctcagctactcgggaggctgaggcaggggaatcacttgaactcgggaggtggaggttgcagtgagccgagatcgtgccattgcactccagcctgggcgacagggtgagactctgtctcaaaaaaaaaaaaaaaaaaaaatgagggcaatgatttagatagtcaccccaatcattccagccctactatcatattctaccccttcataccaagaagacagatgctaaataaggatcaggagccataatgttaattttaaccaaaaaacccatatatattcatctggtgatactagagctgaagaaaaccatgatgattagtaaagcaagaaataaaaaatgtatttccccggattttttatggttggttgtagatagaaaaatgggggaaatttgctgattgagattaaaataataataaatatgtattacatatatactttgtgagtggcccaggaaaaacagattttttgtttgttcattttttaagaacaggtagaaaaaaggatttttttaagtgaaatgaaatttttatcaacaggaagacacaactcatatgtatgtcctcaaagtctcaatttcagaccctcacatgaaaggctgggactgttccaccctaccccattccccattcccccttgcaaggtcttggcgattcacagtgtgccaggcaaggaagagaagaaggcctctctgtatgggtcccaaatactgcagaggctacagaagagatccatgtctctacagctaatacgccattgttgcagttcttaaaataggtagggtcccatttcagctggtggggaccaaggcattctgtgacatttggatgagaattgcaaagtatctcactgtcaatcaagtaaaggaatatttcatcttcatagcatcatatccaaggcagcaacagctttcaagaaaaaagatgccagaagttcatgggcactatcaacaatctcaataagcctcatgagaaagttgtttcacctgtccttaatgcacagttatgtgggaagagagatttgtttgtgagctttgaagcaaaatggaaaattagcttaacctctgcatcaatagttcagaattgtggccacatctcacattgttactattgttcgtagcaacataattataaaatcgcagagtttaaaattttgtgaagactccctaagtgtttatttcccaatttctaaacagagatactgcacttcttcaaaagagtcatggttacgggtagtctctgcttttggtgtttctacctgcatttcactaagaaaatatcacaatacctcatctatttaaaatattatcagccaggcgtggtgattcatgcctgtaattccagcactttgggaggccgaggcgggtggatcacgaggtcaggagttcgagagcagcctggccaacatggtgaaacgccgtctctactaaaaatacaaaaattagccaggcatggtggcggacacctgtaatcccagctactctggaggctagggcaagagaatcccttcaaaccagaaggctgaggttgcagtgagccgagatcacaccactgcactccagcctgggcgaaagagcaaaactctgtctcaaaacaaaacaaacaaacaaaaacaaaaattagccgggcatggtggcatgtacctgtaatcccagctactcaggaggctgaggcaggagaattgcttgaaaccggaaggtagaggttgcagtgacccgagatctcgccactgcaccccagcctgggtgacagagccagactccatctcaaaagaaaaatatatatatatataaaataaaatattatcaatagcttataatgggcacacttcctacaactccatcaatctgctttcagccaacagccctgtctctggggaacatgtagtgcccggttaggaacttatattttgaactgcagtcgctccaaagggtacaactatagcatggtggataaaaccaacagggctcgtctctggagcttctctggcttattttggcaacaggtggacctgtgtggaaaccagtacttattgcattcattattcagcaggcatttatttacagggtgcctggcatatgcaaagtactaaggttatagcagataataaatgataaatgtatgaggtgacagacatgctaagtaccctgacttgatcattatacacaatttatatgcatgaaaacatcaaattggatcccataaatatgtacaattacaatgtgtcaactttaaaaataatcaaatttttaaaaaagagtccaaaatgccggcctcatgaaccttacatttaccaaattgttgcatatcctgacattgcaaactctggggaccagaaagagggaaccaggcctgggtgctcttatatccctggaaacacagcaggaactactcagaagtcacagaacttcatgccagtgattattcaaataaatggcgcctctgtggttttaaatagaaggtagggaaatcactgtcatttccaaattataagaaataattgataatccagaagttgttcatgttgcttaatagtaaccaccgtgcaccaccctgacttactagagctcttaaaacctcatccagtatatagcactattcactgagcaattaatattctaacttatgtttgagtattttttaaatttccaaataatttgaacaaatttctcacaagaacatatctccttttaaaaatatgacattaggccaggcgcagtgactcatgcctgtaattccagcactttgggaggccaaggtgggcagataatttgaggtcaggagttcaagaccagcctggccaacatggtgaaagcccatctctactaaagatacaaaaattagctggctgtggtggcgtgcacctgcaatcccagctacttggaggctgaaacaggaggatcacttgaacctgggaggcggaggttgcagtgagctgagacagtgcctctgcactccagcctgggcaacagagtgagaccctgtctcaaagaaaaaaaaaagacattaattctatgtattgataaaaaaccctgaacgtcatgttttcaagaacactctttctgctcataactagctatgtgactgggctcagggcattcaataacctcagcttcctcagctatgaaatgaatgtattcaggtgaataattatgaagtctccagtaagctacatgatcttttaatgctaaatagatcagtgcagttggtgtggattgactctgccccatgatgcagtaagagatagaaggctaaatgcagtggttggagcagaaaaggaagagacagacataaacacaccaacaggtcaggagatagagggaggacctgtggtatgaaggcctaaaatgaagcctcaatatgatatgtgccttgacatcttggaaaaaacaggagatcctccagcggcctaactgcaagtttccccctccatggggctcccatagatcctggagccaaacaaccctccttattaagaagtgcaggcccagtttctgcttttctctgagtggcggccttcagttcccttccagcccatggagttattcaaataagccagtcacattctcccatggaaccagggttcaacctcttgttactacaaagcctacctcccacatcccctgattgttcaccgtgttcccaagtgcagcctttgtgtggctgttcctgcagtggcctcctcctgtaggctgtgaatgtatgtgattaataaactgctgtcaatgttatctgtccagcggcaggtgccatttactcggccatctccataatccctccctccttcaaccaatgggatgcagagaaggcaatcaaaacaaacttgttcatgggtcaacttgacacacgcagttgattctgagtatatagaaaataataaggtaaatggcctccaagtgagtgcaaggcaacagagagaccaagaagatacagaggaaggtttttctgtaggcaggtggaggacagccacaggaggtgtaggtagccagaggcagtcttatgagatccacatctaaccacaggatgcagcctccaggcaagacggctggggctggggacagggctccaaagtttacataggtcagacaagcaaactaaaggaaggagttggaccaattatccagacaaagactgagccacagagggcagatacaaatgagtcaatagatgctcaatctaaggaaaaaaacagaactttgattactcagattgaatcatgggataaaatattagcagccaagtcaccctgatctcaagttactgcccttttcctcgtccttttttttttttttttttttttttttagacagagttttgctcttgttgcccaggctggaatgcaacggcgcaatctcggctcaacgcaacctccgcctcccgggttcaagcaattctcctgcctcagcctcccgagtagctgggattacaggcatataccaccatgcccagctaattttgtatttttagtagagatggggtttctccatgttggtcaggctggtctcgaactcccgacctcaggtgatccacctacctcggcctcccaaagtgctgggattacaggcataagccaccgcgcctggcctccctgctttttagcattcaagacagacttgtttccagaggctgaatagagctgatctgtccaggaagttttagaagagctcaaggggaattgtgagtcacaaaaaaatcagaacgagggccacttgccattttcatctcattttaatcatgttatttttccaaggattaacaccaaattttcaagactgttattcacctatttttaaaactattttgcagcttctatgtgtagctctggcatcatgccaggtttttgtgattttcaaaataattgggtgcctcattaaatctgttagctaacccccctaagatcatggagttcggtattgccaagatcacacacttattccattctttaatttttgaaagtggcttttatcaggattatcttggttccataattggctaaatctctccattctatttcctttaatttaaaatctctatccagttcttagtctctatagaacacattcactgcttgagcttttccatttggggccaggcctattccacttgtattacctttcctcaatgtattttataaagatttctgggaggtcttccgtagtcttccacactttgtaggactaagatccatatttgaaatattcattcattcaactaacatttacttgtggcacacctaaaacttgctaagcattggatagaaacttcaggaacctagtgaagaatgcagttttattttacagagtgtaaattttccttttggatacaaaaatgtgacaaaaaaatcaaggcaaattctttttcttcctttccctaaaacctcctcggattctggatctaggattgtacttacaagaccaatcctataattcagacatttggcctctgtatgtaccgtgattaagcaagtaaagtctgggtctgcccgagttaaaaccagtgctttactagtcctacaaatccggaaatcattcagattcatttttctttcctggagacctctgccttctaaccacaggtggtctgtacctgtcctcagatgtgccgtgagattgggtgtcttacttcaggatcctagctccgtctctctcagtttctcccacttcccagcgtcttcctcaaaaaaggatgcatacaaggtagatttaggtgctcctggctgcctgagatgtctttgttccttcctcaccttgcatggaggggtctgagtaagtgtagaatcctactttagatgactgcacctgattactcctttgctcttcaggactccgaagggactactccgttgccttctagggtaccaggatgctgcagagaagctggagcccattcctatttccagtgctttgtttggacttattttttctcttcgatgttctaaaaattcacaataatttgcctttttttctctctctttcaatttttggggctggctacttggcagacctttccctctggaagtgcatattctttggtttgaggaattattcttgcattgtttccactgatttctcccccttattatctctctctatacgtagaacttccagtgatcacatgctagagccccccattttcacatcttttctctactctcatcaatttctttgccttttattttactctccaggcaatttcaactttattgttaaattcttctatgtatttttttagcacacatatttttaatttcacatagcactatcctgtcctctgatttctctctttagcatagaatcaatggaatcttccgttatctctccaaggatattaactacgaggtttttgaagcattctttttttctatactttttaatttccctgtttacacttctgaaaatttaacttcagttggtttattttagaatatgcctttccttttagaggttgttctaaaatgtctgattctagaatgtttctaaaacatttgtatttcttgtcattcgtgtttaaaacaaagccattaaaaagctgaccggaccgttgagcacactaggggtcttgctagctggtggaccttaaggttggatgactgggcagtgagagcttttttattgggacacacccaaagtcactgtctagaggacttttctgctttctggtggaaaagaactgcccaagcccacctgccattcagcattctgggagcagagccaggaagagagctgaggcttccataattcagtgcgtagacttcagcttcctctcctgcattcagccctgtctgtctcttcaccctagaacagggtttctcaacctcggcactattggcatcctgggctctagccctgtgggagactgttcggtgcatcgtaggacgtttagcagatctctggcctctacccactacacgccaggagcaccccccaagttgtgccaatgaaaaatgtctctagatatgggccaatgttccctggggtgggctactgccctgcagggtgcttgggctccctgaggtctgagttcttccaactgtttctccagttacaaagttctaaactcttctagaagcaaagggtaggtgtggtttcctgaagctaggagatacgagagggaaagtggggatgtaaatgccacatgtgaagattttcttgcaattttgcctcgtgttatccttgctctctgtggtatctagagcccccagtcatgtgtcattatgggactctaacagttgctgctcaatgatacctgcagacactgagttcagctttgtccctccgctggatcagtctccactcctccaacccctacatattccaaaaatgtgtggacacctctagcccactcctgactcctcacctcttcactattgaccttgtcttttctgtcttttactggcatttacatggacttgtggaagggggcagagagaagccacatgcccaatgccccatgtttaactagaaacctgtactgttactttacaaatgtgattcctcatttattggtttagtacgtgcataatgaatttcttcagtagttattctagagattctgattaattatacagagtgatattgatcacttatatcattttttcttttcccaactcagatcaactatctcatgctcccagattagttttaacagtttaagaagtatggaagagttgacagactcgtgggtctctttttaaaaaaatctcttttgtaaccagcctagacgccttggctgaacacgataggagggctgtggaggtggcataagctctagtccaaggctcccttttgtggaaacgtgggtagacgcctcctggcggatgcctacagcaatacctggagcatgccagcaagtaaaaataaacctggaagagcactgggttcaagcccacgttccgtccatcccagagggccctcgagcaaggcctcctgcccaatcacatgtttttatcataatagattcttccaggtggtaagagcagtaatacaatcatcacacagtttgccaaagcattttccaagaataactgccagaagtgtgcattcagcttgtgtgtccatatgctcctggtaagatttagaaagcagggaaaagggatgagaaaagattaagtcaggaaaattgaaaaagaaggagacaaattgaaaagggaagaaatcgaaaaagaaagaaaggtgattccactgatgagtgggcgatctgctactctttgaaccataaatacatttcctctaactaaatgcatcataggtattctcaattcgatgtattggttttccacaacctaatctatgaattttcaagtgtaattgtacactgctgtctgaacaacacaagagcaagtccttcagcattgtacatagtgtagccatttaggactgtgcactcaaaattggttggcaaacatagggcattatgaggctgaaataactgtagctcactcttcctgaacctcattacttttggcagtgcctctactggtaagtgaaatgagttggatagcacaggagcagatatatgtttttaagaataaactcagggaccttgagtatcacaaaatcttagttaatccacctcttttcctttagaactctgcttcagcctcacccctctgaaagacctggtgccagctctgcccgcctccactggctccatttatcaatgctggcccctgcatccctgatcctctcactaatcctaagcttagagtggcttttcctctcccatggggccaattcctattgaacttcagttagtccaggtggagtggggctctcggtctaggatacaagcaagctcatgcccttggtctgactaacactatattttaaaattggacccaagaaccaatagaaatacattccttccatttaccttgggatgcagaaatactctcttttaatgatcttgaggtcattttgttccttgcattgcaaatcctacaaggataaaacttttatcttaaatctacttacttaaacttctttttttaacaagacaaaatttaagccatattcccatggctgacacaaaaactgaagcggttttctccatcctgatgtccttggaaattgtacttgtaattcagagatcaagtatctgtcttcgtttaaagaaaataagcaccaactggagctctagtaagttttcttttctctctccaggggaggttgttgccctatgtcatgagaaacacagaggacctgacatgtagaatgactatgaagcagtgttcatagaaataaacccccccccctttttttttttcttgagacggagtctcgctctgtcgcccaggctggagtccagttggcgccatcttggttcactgcaagttccgcctcccgggttcacaccattctcctgcctcagcctccccagtagctggggctacaggagcccaccaccacgcccgctaattttttgtatttttagtagagatggggtttcaccgtgttagccaggatggtctcaatctcctgacctcgtgatccgcccgtctcagcctcccaaagtgctgggattccaggtcccatcccttttaatttctgcacgggccctactttaagtatcgctgcagtggcgaaagcattcatcattgccgacctgtgtggaatgtgaacctgagtattttctattggcgggaacttacgtggctaaaacgtctcctttataatgtggagctaaacagttcaaaatcttgaacagatcttatcacccttaaagtattatgtaatatgatcctcacccaagaatgacctccaagtttcctgacatacttgacgggggagactggtgtcacatgaggaccagtaaaaaatctgtactgaactgaaatttttatgcctcaacatttttttacaaaaggaaatcaaatgtgaaaatttatctggatgctccatacttcaaacaattcccattaaatgcattaaggctttccagtggcctcccatagcaggattcctccaacacttctgtgacggttcattttacatgtcaacttgactgtttcacaggagtgcccaggtatctggttaaacattatttttgggtgtgtctgtgagaggctttctggaagaaattagcatttgaatggtggactgagtaaagcagactgcccatcccactgtgggtgtggcttatccaacctgttgagggcctgaacagaacagaaaggtggaagaagtaaggattctctctctgctggagtgcttgagctaggacattggccttggagtgggatttacaccagcatcatttctggttctcaggactctggaatcagactaattacaccaccaacttccctggcctccagcttgcagatagcagattatgggacttaacctccacaatcacacaagccaaatctttataacgtgtgtgtgtgtgtgtgtgtgtgtgtgtgtgtgtgtgtgtgtgtgtgtagacacactattggttctgtttctctggagaaccctgactactagaatttctttttttttttttttatttttattttttgagatggagtctcactctgtcgcacaggctggagtgcagtggcgcaatctcagctcactgcaacctccgcctcccgggttcacgccattctcctgcctcagccttccaagtagctgggactacaggcacccgccaccacgcctggctaattttttgtatttttagtagagatggggtttcaccgtgttagccagggtggtcttgatctcctgacctcgtgatccacccacctcggcctcccaaagtgctgggattacaggcgtgagccactgtgcccggcctgactactagaatttcttataatggcctacccaaggtcacatatgatctcactcctgcagacctccccaaattatttcctacagcttccccctccccagcttcctgctgtcctcaaacatgccaggattactaccaatttagggcttttacacttgtttcttaagcctagagtgccttcaactatattttgtcatggcttttgatttctgctcaaattatggcatctcatatgtgctttccttgaacagccaatctgaaaagaagttcctagccccatctgtatccaggctccctctagctgtttttccagtggttgaggtctttaagtttaatatctctccaaatatttctttcttctcaactcccattttcctctcttctagactccagttacctgtgattagataatttgatattatccacaggtctcaagtagcctttttcattttttcactcttttcctctctattttgcaaattggataatttctattcacttgttcaaatttactaatcccttcctctgctatgccatgtttgctattaaacccatcaaaaaaattctccatttctgatattgtacttttttttccagcacagctgtttgattctctatcatttctatctctctaagatttcctttactttttcactttttcattgtccatttttctgctgatctttaacatatatacatatgtatgtgtgtgtgtctgtgtgtgtgtaatctgtccaataattccatctggtccattccttggtctgcttctgttgactattttctctcttgactttatgtttcttcacataattcatcaatttttattgtggttcagatattataggtaaagtattattacagactaaagtaaataataatgaacccccccccccaaaggatacactccttcttctctcaaggctgagttagctaatctgcagctgagatgtgtctgaacttagtctagctttagttagattcagttgaccactaactataagtttgaagacatgataggactttctctttagcaagattgggtatctgcacattgtcaagactctgaaaatattgttctccttaacagcccagccaccaaacttctaagctctggaaatctctatctacttgtcagtccatctgttagcttttttttttgagggagatggagttctcagggaattgttttttgttcatttgtttgttttgtttgtttgcttggttttggtctagtaccacttctagctttgtgtgcctccaagtagtgctctctcttagcattactgtctgactgccagcctttagggtctctatggtgtgttctgtgaagaccaatattactttggtggaattattctcagctttcctgcccaactctagccctcataggacttctgcagtgtacttggtgaggcctaaagtgcctcaaagggatttctttcctctctcctgctctacccctagacttcagcagccctctgccttgtccttaaaaaaagtccctcatatctcagggtaaattagttcagcaaagctgctctgattccatcatttggcactgtaccctgtgcatttagtgaaggtccctggaaaagagtgggcagacagatgcagacttttgtgtctggagctccttgagattctaatccttcctgccagctcatatgcagccaccaaaagttgggctggtttctcttctcctattagtccaccaagaataaaagcaactgtggatctcttctctcatggaaatgtcttgccactttctggaaattagttaattgtctctttttgcatactcagctctgatgggtttgagatgttacaatgctgtagagtgtctggcttgatattaaggttagagtggaagtgatagtctcttgtacttcctacatctatccagatagaaaagttcccaccacatctttgtcatctttatattttcagcatttgtactggtactagtacttggtagtcactcaataaattttttgttggatatgtaaaaagagaacagtgatattaactagacacctaattggtagtattaaccagacacctaactggtaaaagattagttaaacctaaatatgcccagaattttttgaagaggcaaagattatacaaataaaagaatttttaaagtaatttatagtaatgctgccactctaacacaactatgtacatggaactaatattatttattacgatcttataacactgatgcctatctgaattgtgcagatgaagaaaaataatataatctatgcagatataattatgacattagctgaggcaggaaaagtaaactctaatgtatttaagtggaaaacacacaaattaagttaaaacaaatttttaatggaagagtagaactggttcactattcacgacttttccaggtttaaaatgaatacaattatattactagtaaaacctcattacggcccatggaaatgccctgtggttacactcagtgtttcctcccaatctcatgattgactatggaaaactgcaaatctaggttttccctggttcatatcagcctgagaaattagactgaattatctgtaacatctcccttttaaacatgtgctttcagataacatcacgaccagagtactgacgagatatttccttatccaggacggactgattattcaaattaactttggtagagtaaacatgattctatattatctgaatagctacttggtttaactgacagaaatgaggaacagggtcagaacagtcagtgtactataagtgcacttatggcatcaaataccacaagcaagccaaggctggttcagcaaagcaattttggagacatccctccccataaagcctgaatatagctggcccctgttcagctctggttgggggaaaagtggattattaagaaaacacttcagatgtggccacagccacatattaatagccacagtccagcaataatgctttgacctgaggctgataaaacatggtggagtacctactaatttagattatgagctaagaaagttgtctattttttcactccgaggaaaggtaatatttagtaggaacagtttgtgcaatgagtcattttcatccataaaaatatacactatagcacacccctaacaggatacttgtttagacgttcttagacttggtcgccttggcttccttttggcatcctatggtaggatcctatgacttgattctttagaatcctctatggtaggaaacgttggtgacccttgaggccgtccttctctctctcatagcaattaagatcaactggtagatctttactagtggactcagatgggaaaacaggagttaagggcaggcaggatatttattcatataagcatgtcaaggaacttctttttctaatgattccacagagccctattttgaacaacagctgggagagaatcaagcaagctcttttaacaaggcaggctgcaagcattgccattccaggagacagtttagatgcaactattcactcatctctaaccatcacttgcgtgaacattactcaaagagatacagcaaccaaagaaatcaaaccagtaaaagaaaggtttatttgtttaatagaggtctggcagctgaggcaaaacctaacaataattctgatgaagactcagtcatttatttggagcttctaatgaatctaactaggtaccttatacaggcttgcgtgggttaaatcacagctgtaaagtgccatgctaacagatgagagagtatgtgattgtatcagagatactagggcatccaattatatttatcacctgcctcctattaaagcttttttctgttcttaacgtttgtgttggtagtggcaacatagaggttacagtgagctttgtcctaaagaacctggaaataactgaagtatgagtcagactttaggagatcagctcagaatggatcagagctcagaggaaccttgggacctcattcgtccaatgtcctaatacagatcaacgatcaaaacagtctatcaagggttcagcctaaacacaattaacatggagcaactcttgccattagtatatttagctctcgataaagcctgagaggttaatatgattctagacaaccattcataggcagagatatatcttcctagccaaaaagaaaaaatatagttcttaaagaagagtaggaaatggcttagaagtgatagttttatttccaattctcaattccctgtctcattttgctaaatgggtttaaggagcaacgatgacaatctgctacgatttgcatactcaagcaacactatgaatcactgcaagcatcctcttttgttgcttcattttagcttagtcaacgtccagacaatcagggtgtattgagcatcttctctgataaaagtattttgaagaaaaacaaaagaatggaatgttccttctctcccaagggacttaaaatgtactacctggcatacaagtatttacatcttaaaatgaaaagcagtgaataaaatcatagaccaaaactaatggtgaatttccagcctccagtaaagaatttttcttgaataaacaagtctattttatttcttttcgttctttttaattttaatagtacaggcgacagttaaaaataaaagagagagagaaaggaagagagaaaaaaatggattgattgattcaggtatccttcgtacctctgcccagagacaatgtccatcgtcagcttttaaaatgcatcctaagatgtgcatacaaaatagcatcctactgttttttacttaaaatatatctttacttaaaatacattccagatcactcctgttagcgttgctacatttttaaaatagctatgtactctcctattgtatgcattgctccaatttcttctatttctgctctacataattctcttgaaagaccaaaggctgggctcatctttttcgtcttgttatgcccaatgaattattttttcaatttttgaagtcaaataagtttaccgcaatatatatctgtattttgatctttatgtaaacattagtttggcactcacaatcaagcatgcaggccaggcgtggtggctcacgcctgtaatcccagcactttgggaggccgaggcgggcggatcacgtggtcaggagatcgagaccatcctggctaacatggtgaaaccctgtctctactaaaaatacaaaaaattagccgggcgtagtgatgggcgcctgtagtcccagctactcaggaggctgtggcaggagaatggtgtgaacccaggaggtggagcttgcagtcagccgagatcacgccactgcactccagcctgggcgataaaacgagactccatctcaaaaaaaaaaaaaaatcaagcatgcactttgaacaagccagggtgtaagcattgccatcccaggggatattttagctgtgacttttcactcgtctctaaccatcacttgtgcgtacattactcaaagagatacagcaacagaagaaatcaaaccagtagaagaaagatgcatttgtttagtagaggtctagtagctgaggcaaaacctaccaataattctgaaagagacttagtcatttatttgaaaccttttatgaatcttctggttctgtaaagttttactgagttgcatctttagtttttctccattttgttatttgattctcttcttcaggaatagcaaatatctgtttgtcgattcactttgtcttccatatttaccattgaaaaactcattttaactctttgctcatgttgtctttgttttgcccgctgttctcagtgccgtcacagcgatgcttcctgccatattttcaataatctttaatttcccttgggttatttccaaacaggactttatatttgatgttcgtatttttttcttctacttattgcctgagcttgatcagctcatgtttaatcttcttccattgcttcaccacatttttcatgacctcttatattcatggcttaagtttttgttttctggaaattattgctttctttaaaaaatgaacataagccagtattttaaacacagatattttgcattgggaagattttttagatgcacgttttctatctgccatttatttttgttttttctaatctattctacattacttccctgcaggacctgttctttgttctcctcaccctaccccaccactcaatttatcacttgtctttgcacgaagtgagttgtttcaggcgcagccattgttgttgttagtgaggttctttgcggtgcagagttgggtgaaggcagctacaggaggctcaagggcagatcctccttcaccacagagctcacaactatggcaatggctgtgtcctttctcattcacccaaacccactgagtatcccttttccaccagcccacacacctcaccactgctcccaacaatgggtggttgttttgcccctcctgttgcgccgctagcattgaagatctacgttctgttggctttgtctacgaactgccacgtggcgcatcctgactcggcatctctgcacacctccttttgacttctttcactgcacttgtccactcctgttcagacactgacatttaggatggcacacaccttctagttccactgaaaataaatcttatgtttcctgtttctaatctccttattttctggagaaaagaatggaagcaggatccctttactccaccataaaaggaacacatacccacaactattcatttggggacttccaaccatatacacaccttccccatagttaagtgccactttaagtggttccttcgccattgaagacaatgtgaaaggcagtgtgaaaggcagcaagatctcataaattcttcataacatatataatatatataatataacatataactttataatgtaacataatataattacatagtaatacactggagaacacggaaaagaattaggaaaaaagattttactcctttcagtatccaagagagctcacagagcatcattcaggactcagaaagaggggcagagctcagttacagtgaagaatgggttccccttgattttcctactgtttctatgttctttgagggaaagtaaagaacaaacgtattttgtgtaaacatgctcagtgttgaaattgtatgacaaaaatagtcttctaacaaagataataataacatctgctgagcacttagctatgtatcatgtacctatgtcctatatattttttgtattaaaactttattgtgacataaccatagattggcatgcagctataagatatgatacagagggagcatttgtactctagccaacctcttccaatgctaacatcttgcaaaagtatagtaaaatatcacaaccaggatgctgaaattggcatagtgaagagaatttttccattactacaaagatcccatttattgccttttttatcaccttactcaccttcctctacttcatcccctacatcagtcctaaaaaccactaatctgctttctgtttctataattttgaaatttcaggaattttacacaaatatagaattatatgatatgtaaacttctgagattagttttttcactcagcccaactttctagagattcacccaggctgctgtgtgtatcaacagtttatccctttttatagctagtggtattctatgggaaggaggtaccacagtgtatttaaccaatcccctgtggaagaacatcttaattctttccagtttggggttttttgtgggttgagttgtgcaccaagaatttacacggtgaagttctgattcccagtttctctgagagatcacctcagaacaagatcttacttggaaatagagttgttgcttgtatcattagttgagataatgtcatactgtagttgggtgggcctctaatccaatgtgactggtgtccatataaaaaggggaaatttggacacaggtgggcacacagggaaaatgtcatatgaaaatgaaggcagagatcatggtgatgcacctacaagccaaggaatgcccgtgattgccggatccctccagaggccagaagaggggaatggaacacattcttcctcatggcctgctgatacctcaatctcaggtttctagtctccaaaactatgaggcaatacatttctgttaattaagccacccagtctgctgtactttgtttaagtagttctagcaaatgaacacagaactactgccagtaaagctgccacacatttgtgtacaagtttttggtctttgttttttgagacagggtcttgctctgtcacgtagactgcagtgcagtggtgcaatcacagctcactgcagcctggacctcccatgctaaagcaatcctcctgcctcagcctcctgagtagctgggactacaggtgtacatcaccatgctcggctatttttgtttgtttgtttgatagagacaggatttcactgtgttgcccaggctggtctggaactcctgggctcaaggaatcttcctgcctcagcttcccaaagtgctgggagggattacaagcataagccactgcacctggcatgtgtgcaagactttttgtggatatatgtcttcagttctctgggctaaatgcctaaaggacaaaatgatagttgcaagtttacttttgtaagaaactgccaaactacagctgactcttgaaacacaaggtttttaactattcaggtccatttatatgcagattttttcaataaatatactacaaagtttgttagagatctgtgacaatttcaaagctcacagatgaaccacatagtctagaaatataaaaaaaaataagaaaaagttaggtatgccataaatgcataaaatatatgtagatactagtctactttaacacttactaccataaaatatacacaagtctattaaaaagttgaaatttatcaaaatttgcccacacaaacacttacagatggtacgtggcaccattttcagtcaaaagaaatgtaaacaaacttaaagatgcagtattaaattataattgcataaaatcaactgtactccatactgtactgctgtgataattttgtagccaccttctgttgctattgtggtgagctcaagtgttgtgagtatccacttaaaacgctctttgtccccacacagccagttcgtctctccagtaaattgcctatcacagcaaaaagtgatagtttctggttcttgggtatttttcatcatgtttagtgcaaaccgtaaacgctgaataacaccatgggacccacatgaaatatcactagtgatgccagaagtgctcccaagaagcagagaaaagtcatgtgagttgcttgatatgtaccatagattgaggcctgcagctgcagttgccaaccatttcaaacagacaattcatcttgtaaacagacaacataaacttaaggcattgatatatacagcatggcactgtaaatgtactttttcttaagattttcttagtaacatttccttttctctagcttactttatcataagaatataatatgtattatatatacaaaatatgctttaatcaactatttatgttatgaattgcattcaacttacatgtcagcttggcaagaattgacatcgttactatgttctcaaccaatccacgaacatggcatgtctctccatatatttagttaaacgttcaactacttatgttatcagtaaaacttctggtctattagtagttaagttttgtgagagtcaatagctgtactcatattttcttttgttttccctcaaggagtacatgtgcaagtctgttacatcgataaattatgtgtgctgaggtttggtgtacaaatgatcctgtcacccgagtagtgagcacagtaccctgtaagtaggttttcagtccttgtctctctcccatcctcctcccctaggagtccccagtgcccagtgtctatcattcccatctttatgcccatgcatacaccatgtttagctcccacttataaaggagaatatgcagtattttcttttctgttcctgtattaatttgcttaggataatggcctccagctgcatccatgttgctaaaaaagacaattgtaagtggtatgtatctttaattttggtgtcctcacattcattactataatatagaaataaaattgatttttggatgtgtatcttgggtttcttctttgggttccgtgaccttgctggactcattcgttagttctaagagtttttatgtatatttcttggaattttctacatagacaatcacgtcatctgcaaataaggatctcttcctttctgatcgaaatgtcctttctttttcttatcttattgcactggctaaaacctcaagcactctgttgaataaaagtggtaaggatagacatagttgccttgttcccaacattaggggaaaagcattcagtctttcaccattaataataatgctagctgtagggtttctgtaaatgtcctttattaagttgaagaagttcacttctattcctagtttcttgagagttttttatcataaatgggtgttaaattttgtcacatgcttcttttgtatagattgatagaatcacgagctttttcctctttagctttctaaacaactcctttgtttcctttaactaatatgtgtataaaatttcattttccatccttcacctcctatctgcttatcattatatttgaagtcggttctttatagaagtaatactgttgctttagtttttacattatatgtacataatttatgacaatctactagtgtcatcattttaccagtttgagtgaagtacagaaatcttacctcccttcatgtccttttatcctgtcctttttataaaaagctgtcttaaatatgtcctttatatatatttagagccacatcagacagtgctgtagtttttgcttcaactgtcaaacatatgtagaaaactcaagaggagaaggaaaggttattgtatttaacaatactttcacttactatagtctttgctcctttttcatgttccaaggttctgtcttctatcacttcctttctgtttagagaatttcattcagccattctcttacagcaggtctgctggcagtatattctattagttttcctccatttgagaatgtcttgattcctccttcattcctgaataatatttttgctggatatagtgttctgagttgtcaattcttttcttttagcacttaaaaaatgtgtcatttccttctggcttccaatgtttctgatgaaaaatctaatttttcccccagtaggtaagatgtcactttttaatgaaaatttttaagattttttctttaatattcataagtttaattatggtttgtttgacatcaatttctttgggtttcttctgtgtgaagttcactcagcttcttgaatctgtaggtttaagtcttttgccaaattcgtgaatttttcagtcattatttctttgagtgtttttctatccaacctctttattttcctccttacaggactctaatgacataaatgttagatctttaattgtagtcccacagatctctaagtcttcctatttaatttcagtctatttcctatttttcagattgggtaacttctattgttctatcttccagttcaccaattctttcctgtgccttcttcattccactgatgagccaatccactgagcttttctttggttattgtattttttagtccttagacttacatttggttcttttttgtaccttatatttctttgataagactttgtatttatttactgaggctttctattttctcatttgtttcaagtgtgtttgcattgcttattgaatcatttttttcatggctcctttaaaatctttgtcagataattttagcatctttgttaccttggtgttggcatctattgatggtcttttctcattctttttgagatctttcttgtcctccatataagtgattttcagttgaaacccagaatttttctggtcatatgttatgaaactttgaaacttatttgaaccttatgtattagttggcttttctaatacttctttggcagggaagagaagaggaaccaccccatgactaccagttggaggtagaagtctagttttgcaacatggcctccaatgccacctaggggtggggggagtgtttggcagggggggttgttctggttccctacctggtgttcaatgataccagagtggtgatgtcctccttaacctggcaataaagtcctgactctccactaagtaacaccccaggaacaatggtgaaagtcctgacttttctctgacaaggagagagaatggggcaccttgctactgtcaggtggagattcaagtccagctatccacatggtctctactgacattgtggtggaaagtgaaggaagtctcaatgccagtgacaggaacaaaagtcccagctccctacttggcctctctgacatcaccctagtgagagtgctggggaaccccattatagcttgtgaaggtagaagtctagcctccccactcagcctttgctgatatgggtgggagtgatgctacagttttttctgtagtgtttggctggagtaaagtggttattatccaaaagtttctgtctttctttgtttttttttgtttgtttgtttttgtttttgagatggagtctccctctgtcgcccaggctggagtgcagtggcacgatctcagctcagtgcaagctccgcctcccgggttcacatcattctcctgcctcagcctcccaagtagctgagactacaggcacccaccacaatgcccagctaattttttatatttttagtagagacggggtttcaccatatttgccaggatggtctcgatctcctgacttcgtgatccacccgcctcagcctcccaaagtgctgggattacaggtgtgagccaccgcgcccggccaagtatctgtctttctatgctgccctttttccagggctttgactagagagaccaggcttttgttggggacttgtcttgtctgtgcccattggcattgctgggttgtgggtttcttctactccaaatatgggatatgagtggaaaaaaacacagggaactcattagcatgttattcctcatgtcctgagtccccagctaatctgccttgttctcttcttctttcatggcctccctacatttgttttatgcaatatatacagttttttattgtaattagaggatctaatagaggacgctattcctactccatcttcttggaaacaagagtctgtcttagatattttacacttactcatttaattctcacaataaccttttaaagtagtattattaaggtctcaattttacatttgaggaaactgagttacagagaagttaagtagcttgtctatggtgacatgctaacagcagcaaagccaggtttcaaacccaagaagtcagcctccagagtcagtgctttcaaacagtatactagaactgttttcaagtaataaatgttcacaacgaagctcctcatttgtcttggttggtctctccctgcagggctggactcccgattattgtacaatagttgagagtgccctctgtggaacatagtcctcaggttacacgccccatcttttccccacttcttacccacaagtatatacctagttttaaaggtgcagggttataagcataaaaatgatcagtcatgatcaatcacatcccttatttttgaaaatccatcatgagtgcgcataataacctcaaaatgagagccatgaatgtaatcatcgtccctgtgtttattaatcacatccttttgaattcaacactttttattttctgccaacttcttgctgcattatctacaaggtaatcattctttcaagggatcttctttaagtctcttccattctctcagcctttagcccaagtcacctccatcactttcaataagacttcaccaattctgtaatgttctactacatcaaaagccacagaagcattgagatggaaagagcctttagggaccattttgctggtgataagagaactaagtgacttggacaatgttacactgcttcttcgtgacaaacctgagactagaaaactactacatatgacatcctacacactgactcccttcttcagctctgtctgataaagggatgagagatcgtttcttattattacacatacacgccacttccgttccttccatctaaacctagttcagaaacaccgctaagaattcccacccccaaaaaaatggggatgggggaagagaaggaagtgaacagtggtgtcatcccaccaacaagcctgactgcacaaactatctgcctgttccataacaaagagattatatcaaacctacctccccaggaatcagtctgattcaacctcggaactcctccttctcctttccatttggcccaaactagggtttttctctcaggtcttttgggctttctgaacaagtgccagcaccctgtggcttgctgctgccagcccaactatagtaattttccagaagtctctggttatgccacactgctcaaggaagaggaatatcattaaagtgacttcacagccccataaacatgccacttgcagccctcttattctgtctggtggcctacaccacacactacaatcaacaagggacatctagatttcagggccaaatccctgcaaagactctgtctgaacatacttttgtgaaagcctgcagaatatagatttctgtgtgtcataaggaaataatcggtccttaaatctcaaagtacaactagctgcagtatttaaaaagcccatggacaatgacaaatatagacatcacaaaattattctaaactgatcaatgctgagaaaagtcatgatgtgtcaggagtctcagctccaaaggcagtctgccctttaacataatgaacttcagtaaaagtagaaaccatttctgagggtgtaattgacaagtggcaatgaggtcatcagtagagtttatgacatttaaatccctgtgatatggtttggctgtgtccccacccaaatctcatcttgaattgtagctcccataattcccatgtgttgtgggagggacccagtgggaggtgattgaatcatggaggcgggtctttcctgtgctgttcttgtgatagtgaataagtctcacgagatctgatggttttataaagcggagttcccctacacaagctctctcttgcctgctgtcacttaagacgtgactttgctcctcctttgtcttctgccatgattatgaggcttccccagccatgtggaactgtgagtcaattaaacctctttcctttataaattacccagcctcaggtatgtctttattagcagtgtgaaaacagactaacacgccctggatctacttttcccggttttatttttttgtaacccacaagctgtcctgcctcgtgtaatggtcttaggcaaaggaagacctctctggttatccttaattctatagatacctacttcacacacacacattcaaacacacacatacacacacacacacacgacagagggacttctaagtaaatatcatatacattatgaggaatcaagatcttgcccttttctaaagcaaataactgtcaggcttgggcaaatgcaggggccatattttctaatgaaaaaataaaaatatatgacactggacaaattattgaaaatggaggtatacattataacttcccttactttagcttgctgacaggtaaccttgggctctgccacaaagtaattttcccatctggactaactggggatcagacagaagattctttttctttcaaggtgtcctagaaaattggggacaccttgtagcaaatcaattaacattttatttgatgtagaaccttacgacaaatagtgagaatttccacaacacaaaaattgtgaagtttttggcaatgcataagaaatgaacattggcagatatgtttcacgtggccaagaacttgatgtttcatcagccatgaggctggtagtgtctctattttacacacgtgaaacatgggctaagtgaggtaaagcaagttgcctgagatcacgtggcttgtgatgagaagattcaggattcgactccagctctgtgctactccagagcttccgttctttctcacatatctagttcaggctccttcatctccgagtgggtatggagaccaagtatgcctgttattgttcctcagagaaggatttctggaggacatgagtagtctgaagagttcagcaagtcctccaagttccacccaaatctgataaatgtgctgaagtacggggcgctgttactatacaacatggtgagtaaagggaaccttctctctgatccccagacaccccagatggaaaaaggtgctttgctgcagagcccacggttatctgtctggaagcaaaagtaagggaggccacaaggtctacttccattttcaaactgagggcgcctaacaattgcaatcctgtaaagaaataaattcatttctggaaagttggaaattgtcttcatcgtgccctgcccaaagcctctggtcaagaaattgaggacttgcagaataggactcctcctcaaactcaagcttttgtgttccatgttcaatgagagattctggccacagaaatgttccctacctgctccagcaggaactaagccttcctggaacatgattatcacaaggatccctcccagtgaccacattttctgacatcagcctaaaccaaaacgactcgcctgctcagtgattatataaatccattcagtctctgcaaatgcccaggcttttgttaccactactgctgttttggctgtacaaggcttaaaatgcaaagtaagtcacgatactaacctttgcctccagtaaggaatgctcttcttggagcagcccccatacctgggacaatgcaagtcagcctttcaatgagatgcttagcacacaagccttctgtgatccagctcctgcctctccatcatgcctcagtgtccaacactctctcttcttcagtcaattcaaactatttgtaggtccctaagcacagtttcccctctttctgccctgcagacctgctttatctagcaaatgcccactcattattcaaatttagtgcaattatccagtcatctgggaaactccccttgatccacaaccttgatttagtggtctcccctttgtgctccctgaatagcatgtccatgcttctccgatagtgctcaccacattttatagtaacagctgatgtatctacttgtgtgccccaaccaaaaatcaggttctacatatcttgaggaagttttctcattcaattttgtatgagaatttacggaacttccaattctataacatagttgttaaataaatgcttaacgaaaaggtacacttggttcactcaccaaacaaatatttacaaaggaactacaaggtatatttagaaagcacatgagttcctgagcactgatcctaagttgaagaaaccctcctcacctcaatctcttgggcacatgagaggtctcctcacagactctcaaacaattggtgcttgaagagaggtgggaagtggtacgagggaagatggagggagagcatgactgcctgctgctacctgagtgagaagaggaaagatggagatgagggcaagcagaagcatgtggtccacagcatcacctagtgcctagtgcggaagaggaaagtcttggttccatcactcattctagcttagagtgaatcttctgttgcaaactttcttattgctctaagacagagatcatcagaattgaggcaaaggctaaagcagtactacactttctatgtcagtatttttatatactggttagtggtatacatgcatgcaaatctccctttaaattcaaatgtcatgttagaaagtagggtttatatgtacaggtgtttgtaaatgagaagtttgtaatttagggagtacatatttaatagtgcctcacccagaactgctataggcaagatgatcaggaggaaaaacagcagcagctgatgccaaaatgtgtgattcagatgatttggaaattaagagacattccaaagaacgtgtgcatatttccttcagacatagtctactagctaacagattgaatttttaaaatatatgaataacttttctgacaaaagcttaccaaaatacagcaatgacttagaaatttagcatggttatatgtgatccgtttatctctcccatcatcccactatctcagagtacaaaataaaaatcattcgtttcatttttctttatgctaagtagaaaggaaattgtgtcctgttctcatttcaagttaggttgcttcttgattaaataagagaatgaactcgcctagaataataaatgatcctctcaactgcacgttaactgaacactctagcataaattaacaaagcagagagatcaggtggaagtatagctaaaagactaaaattagtttggcatgggtttggatattagttttgtcactctgtagctatgtaagtttggacaaattaccataaactctccaaatctcaattttctcaactgtcaacagagttgacagcaaatatctcatgaaatggcgagacagatttcaaacttgtcatttacaaacacctgtaaatacgaactctactttttaatatggcattacaacttacaagatttgtatgtatgtatgcaattaaccatgatacaatggcagcataaaatggcaccggtaaagtgtcaggcacacagcctattgcagagtgaacactcacattttgtttccacgtgccccacctcttttcttgatttaaaggatttctactgggcaaatgataagagaaacaagacacttttctgtccttaaggaacttagactggtaaagaggataaaataaacacagacaaagccaggcaggatatacattttgagagcagaatgaatccaggtgatataagaacacaaaggaggaagaccatgtgccaagttccctgaggacatcaggatcaacttcatgaagagaccattttaaatgggtctcagagaattggtagggaccttgtcaatgtgtggtttttatttcctaagtaagactcacagttacaatacacatgtaaacacaggagaagacagaagttaaggcagatgatactctggtttaaaaatccttagaggaattttcactggtcaccaacttttagagctacattgaggatgacaactagggtggaaaacagtatattgtccagatatactattaatataaaatggggcaatgttgcctactgaagggaaggtaggggcaagccttatctttccctttctggctcagagaattcccagctttttttttttttttttgcttttttgagatggagttttgctcttgttgcccaggctggagtgcagtggcatgatctcggctcactgaaacctctgtgtcccaggttcaagtgattctcctgcctcagcctcccgagtagctgagactacaggtgcctgccaccacgcccggctttttgtattttttgtagagacagggttttgccatgttgggcaggctggtctcgaactcctgacctcaggtgatccacccgcctcagcctcaaagtgctgggattacaggcgtgagccaccatgcccagccagaattcccaacattttaaccaaagcactaggagctttccatctgtagtacaatcaccgaacaagccagaaactgtgtcatggcctctttaatccatactattccttctacagagactaattcccttaaaaactaagagacagatgcagccttagcctcggcctacacagggtccagatcatccatatcactgtttccacctccatgtcttgtcctactggaaggtcttcagaggcggtaatatgcatggagctgtcgtctcctgtgacaacaataccttcttctggaatacctcctgaaggaccttcctgacgctgttttataactaacttattacatacttctacttacataagtaaaaatacactctaaataatgataaaaactatagtatagtaaatacataaaccagtaacatagtcattatcattattaagtattatgtactgtatgtaattgtatgtgctacacttttattcaactagcagcttagtgcaaaataaaaagagaggactcaaaggggatcatttaggaaataaactactcccgggaaagggacacaatctcaacaagcaatagggcggcttgtgtagtgtagtgggctttggagaagatccctggtagcagtggagattgggagttgtggttttcacgtacttagtcatttagtcaaccagagagacaaatagttgggataaaagaggatctcataaatccaacagaagagtacagaacacagagcttaggctgttcacagcaccacctcctaggaaaacactgtgagcactcaggttaacagtaggtagatctgtgcacaagccatttactctactatggccaagcagcctaatctgtcgtgaacattcctcttccccccaaaaataaagaggaaataaagagaagggagaaagggagggaagaaggaaaccatgagtcttaaaaagatagcacagaaacaattattctgaaaatgtagaggaaaagtatagctctttaaaattatttacgacacaaatcagaagagttcaaataaattacaatgcattcatatattttgcagatgttcactcatgttctcaaataccattaaacgcatcagaaaatttgtagaatgtaatatgaagtgaaaagagctgggtgcaaaagctgtatatatcaactttacaaaactttgcacatgcggtacatataaagtcatcaattgcttaacaacatttcagtcaacggtggactgcagatatgacaatggtttcatgagattataatggagctgaaaatttcctatcgcctagcaacactgtagcagtcataaagttgtagcacaatgcattactcattgttgtaaacaaacacactaagctgctagttgaaaaagtgtagcacatacaattacatacagtacataatacttactaatgataatgactatgttactggtttatgtatttactatactatactttttatcattatttagagtgtatttttacttacgtaagtagaagtatataataagttaattataaaacagcttcgggaagttccttcaggaggtattccagaaggcattgttgtcataggagatgacagctccatgcctattactgcctctgaagacctttgtggaggtggaaacagtgatatggatgatcctgaccctgtgtacgctgaggctaaggctgcatttgtgtcttagtttttaataaaaaaagtttttaaagtaaaaaaaattaaagcacaaaaaggcttatagaataagaatataaaaaagaaaatatttttgtaaagaagagtcaaaaagttaagaaatttaaaaatgctcatcatcactggtcattagagaaatgcacatcaaaaccacaatgagacaccgtctcacaccagttagaatggccatcattaaaaagtctggtaacaacagatgctggcaaggctgtggagaaataggaacacgtttacagtgttggtgggagtgtaaattagttcaaccattgtggaagacagtgtggcgattcctcaaggatctagaaccagaaataccatttgacccagcaatcccattgctggatatatacctaaaggatataaatcattctactataaagacacatgcacttgtatgtttattgcagcactatttaccatagcaaacacttggaagcaacccaaatccccatcggtgatagactggataaagaaaatgtggcacatacacaccatggaatactatgcagacataaaaaagaatgagttcatgtcctttgctgggacacggatgaagctggaagccatcattctcagcaaactaccacaggaacagaaaaccaaacaccacatgttctcactcataagtaggagttgaacaatgagaacacatggacacagggaggggaacatcacacactgggacctgtcgggggtggggggcaagaacaaatacctaatgcatgggggcttaaaacctagacgatgggttgacaggtgcagcaaaccaccatggcacatgtatacttatgtaacaaacctgcacattctgcacatgtatcccagaacttaaagtaaaataaaacatacaataaaataattttaaaaaatgtaaaagtcaaaagctacagtaagctaaggttaatttattattgaagaaaaggaaattttaaaaataaatttagtatcgcctaagtgcagggtttataaagtctaccctagggtacagtaatgtcctagaccttcacattcactcactactcactcactgactcacccagagcaactcccaggcctgcaagctccattcatggcaagtgccctatatgggtgtaccatttttttcctcttctataccatatttttactgtaccttttctatgtttggatacacaaatacttaccatggtgttacaactgcctatagtattcaagagagcaatacgcttccaggtttgtagcctaggagcaggctataccataaagtccaggtgtgtaggaggctacaccatctaggtttgtgtaagtacacgctatggtgttagtcaactaaagaaacaaatagtggtgagagaagagaaatcacctataggtgcacttctcagaacatactctggttttcagcaatgtatgactataaatcagcaaaaataaacggaggtgaaataatagttcctctaactgagtgatgtgattatgtaagaattttagttccttcctactatttttctattttcttccaacctttctgtgaagttactttcataatttaaaacttgtaatgttttattaaaaatagatatgtttgcggccgggtgcggtggctcacgcctgtaatcccagcactttgggaggccaaggcgggcggatcacaaggtcaggagttcaagaccagcctgacgaacatgatgaaaccccgtctctactaaaaaaaaaaatacaaaaattagccaggcatggtggtgcatgcctgaaatcccagctacttgggaggatgaggcaggagaatcatttgaacctgagaggtggaggttgcagtgagccgagatcgggcctctgcactccagcctgggtgacagagcaagactctgtctcaaaaaaagaagaaaaaaaaaagatatgtttacaaatatacagacattaataatggagtctgaggataagagccttcaaagcaaaggtgaaatgtcccaaaagacaagtcggtaagaaaacacaggccacgtcctaaaggcgttggagaactgggatgtgtgagagcaaagaaagggccttgaatgccatgtttaggggcagagattttcttctgtctgtagcacatattttgaattagaaagggctgttgttggagctgtctttctagagattccggagtcggcaaatggcatctaaaattaaatggattagaggtgagtggctattgtgatagtccaagtgtcaagcagtgtcagcctgactatgtggtctcagtgacaaaagagaggacatggtagatgtgagtgttgagtacaagactcagccaatggttgggtataaaccgcctgggagaagacaggactgaagaaggctttgaaggctagattctgggtgatgaatcagagatcaatattagtcacaaaagttggaggaagaatatgtgcagcttatttcgaacatgttgagcttaaagtgtccatggagtatcttgagaagattctgagaagttgcaacttaagagagaagcctgggctggtggtgtggatttgggaattatctgtatagacaggagaggtggtcagataataaaggaggagaccaggaaaggaagagcaggagagggaggaggaggaagaaggggaagaagggatgcacataagacagaaagagaagataggagaagataccagaggaccacactacagaaaagaagtagccgctgacacagccagaagcagcaaacagaaagaggagtgcatatttcaacactgcagagtaggaaacaaacaccaacaagagagtcacccttgatgtgaaatgttatgcaaagttcaaagaggctgcacactgacaagtcgctactggaaatagtgattaggcgctcaagtgacataaaaaaattttaagtaaaaaataagaaataaaatcaacatgtccaatgtcattgcaatagacactttcctgtgggaactaccattttaaaaacacatctggagtccaatatcctaagtgtcaagtcattcctcctttgtccacatggacggaagacgttcatctcttgagtgctaatggtttgaggccaccaccacagcaaccaacagagcaactgttgtactttaactctgcccagcactaactacattctagtctgtggcctgcatggaaatgaagttgttctttcagacactgctgtgtgggactcagtctggctgcaggtgcctgcaagcactgtctgatttgagatattttctataattactggaatgatgaaatctgtcatgcagtaaggtagcaggcaggagacacaaattcattcctagcttcctgaattaaaaataaatggttatcaagtccaattgaatttgttttaattagctgggttttttttttttaagtcacaattttcgcagctcctttatcaaactgactcttccttaatactaaagaggaaacttttcacacctaaaatattcctgtaaagacaaacttgctgggtcttgttcatgtccctgttggcccctaagtatattttacttatttgtctcatccattgcctcatgtctttccaatgtgaactccataaagaaagtgatttttgtgcatgtaatgaactgctgtatccccagaacttaaatcagggtctggcccatagaatgagctcaatggatgctggtggaatgaatttatggaagaatggatggaaagaaaacatacattataagaataaatcctcagaaggatagcagcaccattacagaatcaggtgaaggtgagtagactgaatatgaagaagatatgatgagtgtcccacctatgtggggagaagatgtgaattgctgtaatgagatataggaatataattaattggctttctttatatccagattggatgcagctttgattcttcagcattactgtaaggggatggggcggggaaaatccataataagctctgtgatcctacaaatttcatttcagaaagttagaaatttattaagcaaataagacaggccatgtcaccagcggatcggcatcaggcaaaaacccaacagtgtaattggccaatgctcggaagaatgacataacgaagcttggggttgccatgagatctacatgaaaacaatttctgtgctgaaccataggtagctcttgagtttataaaccctcaagtctcccattaatccagtcttcaataactggatgatttaagtagttacagtattttttaaaatcttaatcctgagagctaagtattcaatcgttttctaaagaaacgcagcaaagaaagtaaaatcaaacaacctgcctcaaaatggcagcatgtccacacactggcttcggtctgaaggcaccaaatgacctgggcatcctctagtatgttgcaaagtttaatcaccactagatcgaaactaaataccagaacacaggtgtgcatcattcaaattggcaaatcaatatattaatactttttttaaaagtcagtgagaaaaccaccaaaatcatttattaaagggaactcaagtggcacaggaagatcttcaagccaagtcccattcatttcccattaaatctgctacaagaaccttaaactgctcccctcaaagaaaaagttagttggacagtgaccagtgagatacaaaagaagaatcacaacgcccaactactaaaacccaggatggttttttaaaaaatgaatcccttgattgagggtcaccagagaagacagatattaactaatcacagaaagaattaattagaagctaggaggagaccagtattccaagccaaagtagtaatctgtgtgaagactttgctggaacttgtattatgtctgaaagattgaaataaagtgccttaatccaaactgggattttcctgactgacatctactagttcttcaggtccccagcctacacataaccacttcaggaagcccttctctactttatcttttcaactaaatcacgccttctgacactacattccctgacgacaccttctaccattgcttcattgaactaaaagaattatctgtaccctcgggtatgattatagagatgcttagtctaaatgcaaaccaagatacaactttagagaaaattctggagcctacagagtagaccagagaagcatctcacaatgaatcctccccaaataagtcttattctttctatatatgtcaagcattaagtaaacacttgagcagcacaagtcacaggcgatccatgctggccattaatcggcagtggcaatatcagtaaagtcaacgctcttccagcatctcctggactaagatcagtgtccagtgtttttattttatttttttccacagtattttgactatctcaagataagcttctagagaaaaaaaatacaaaaacaaatgtaacaaggtcaattgagctgcgcgtgctatgtctggaaacacatgtgccgtcacataatttagcacctaaagaacaagaggctgcaaaactgcatccccagggaagcccagagctggcaaagtaatctctgcagacatgaggaactctgctcacccactttaattttaacgctactatgtacaagcttaaatatagaatcaatcacaaagaaataatacatatttaagcagacacagggctaacgaatctgagccagtacaattctgaaaactttcaagtttccctttctcactctgacatttctaggcttgctaatagtcctcacaatgtccaggaagatccgtgtttccattattccctcctgttatcatacactgaccatatcttgtgtgcctcctagatgattcatacattttcttagctctaaaaatactacagttttagtgctagaataaatgtagagaacttagaagtaaaaaaatgttttgaaggtgagataggaaaaagccaactatcttgaacaattcaaaagactttcttagcaaatctcatttctgagagctttgtatagaaatttcatcatcagctttggctgctatggcaactagatatttcagaaatgatttgaaatgagtatcactacatatccagcatcttttgcaagaaacagaaaagactatgaaatctaatccactgtaaatttcaaaatatagtgttaattttcatttttgaaatctatttatgcttctatttgcaaatcaatagataacaacctggtacgattacatatgagcacgatggagaagtctttcattttagtccttaactgtcacattaaagcatcatttaggtactctcgtcccagttttattaggcctttaaaaaaaaaaaaaggctgggcacagttgctcatgtctgtaatcctttgggaggtcatggtgggaagactgcttgagtccaggagcctaggtaacacacagatacctcgtttctccaaaaaaaaaaaaaaaaaaaaaaagtaaaaattagccaggagtgatggtacacacttgtaataccagccactcgggaggctggggtgggaagatcgcctgaacccaggttttcaaagttgcagtgagccgtgatcacgccactgcactccaacctgggtgatagagcaagaccatgtctcaaaaaaaaaaagacaattttttgggcagttttaggttcacagcaaaattaagtggaaagtacagtttccatataatccttgtcccctccccaacctaccccactatcaacaccctgcatctaagtggtacatttattacaatcaacaaacctacatcgctacatcataatcacccgaagttcatagtttacgctagggttcactcttggtgttatatattctatgggtttggacaaatttataatgacatatatccaccattagggtatcaaatatcaaaaatcaaatcctgtgttccatctatttatccctcccactcttcttaagccttagcaaccactaatcttttcaccatctccatagttttgccttttccagaatgtcaaatagttggaatcacatagtatgtagacttttcagatagacttctttcacttagcatgcatttaaggttcttccacgtctttccatagcttgacagctcatttcattttagcattgaataatattccattgtctggaggtaccacagtttatctattcacccactaaaagacattttggttacttccaagttttagcaattatgaacaaagctgctataaacacttgtgcacaggtttttgtgtggacatgtttccagctcatgtgggttataccaaggattgtaatgtcttgactgtacagtaagagtatgtttacttttgtaagaaactgccaagttttcttccaaagtggctgtaccattttgcatttccaccaacaatgaatgagagttactgttactctacattcttgccaacattcagcgttgtcagtgttttggagtttggccattctaataggtgttaatggtatttcattgttagtttaatttgtaattccctagtgagatatatgtcaagcaccttttcatattcttatttgccaggcctttccttttagccatatctatgccaaagcccaagtcccactgaatcttgcacaacagaataaaaacaaggtcttcaatgatgagttagttgtgatttgatttaatcaatgaaccagccatggttttcacattctaccctgcagagctactattcctgggtcactgaaatagctcatagcaaatacatgctagagcaaagaaagctgtgtggaaatgtaaagtaatgcaatgactggataatttaatcagcatttacacccatgcaccttaactacatatatgtaaaagcatcaaacgagttctcaaattccctgcttaggtcatgacactgaggggttcaaatagaatcatcagtgtttgcttgaaagtccacaaagtaaggagatttattcttgattgaagttttcacagcatgttaccctgaatatttagggatgatggttaagggttatggaggtcaagatgaactggtagagagagcagcatgttaagttgtgtaagtgtttgctgaaggacaatggggaaatggagtgagagacattctgcaagtgtgccacaattcaaaagaaccagcatcctcattaaaaattgtgaatttattaaaataatggcaaagttattttggaagtaaactgatctaactataattctttttcctcttgaaacttatcaattttaagatacttacaatagtgtaatctcttaaaagttttctacctctgcacttaagtgtagaaacaagcttatgctgaccttttgaatagaatctaaagcaatgtgcattacctttatcaattctaaaaggcatttccaacagctcagtcttccaaaaatatactttaaatgtagtagttagtgcaaatgatatatcagaagtatcgagtaaagaagaaaaatactatgacattcatagatgtcaaatatgttagaaaatcatcagcactgtggatcaggagttctgggccagagctgtgggcagaatgggacattaaatggggcccttattaggaagttgacatctgagcaaagacttgaagaaagtgaggaagtaatattcatggtttatctgggggaaagtattctgagcagagacagcagccagcgtagaggccctgaggtgagagcaggcctagcacattgcaggaacagcaggagggtgagtggaacaaagtgaagggggaggatcagctgcaggcatcttaaaactttggcttcggccggccgggcgcggtggcttacgcctgtaatcccagcactttgggaggccgaggtgggtggatcatgaggtcaggagatcgagaccatcctgggtaacacagtgaaaccccgtttctactaaaaatacaaaaaattagccaggcatggttgcaggcgcctgtagtcccagctacttgggaggctgaggcaggagaatggcctgaacccgggaggcggagcttgcagtgagccaagatcacgccactgcactccagcctgggcaacagagcgagactctgtctcaaaacaaacaaacaaacaaacaaaaaactttggcttctactcagatagggagcaccttgggaattttcagtaaaacaaattactttgaaaaatttttcttatcatacaaaattttaaacatgagcaaagtagagaaaaatgatagtatactctagtgtacgtatgattcagtctcaaaattactgattcatggtcattactgtttcatttacactctctaccctaccctcaccccaaatcattttgaagaaatcttctgacgtcatgtcttttcaaccataagtatttcagtagggatctctaaaagacaggcattcttttctttctttctttctttcttttttaacaccactgtaatactattatcacgtccggtagcggttaaatcagctcatacctgctcagccaaagagaaactgtgtatgccactcttcccactcacggacccatgacttcatgaacgtggcttgaaattaaccatgaagggagtgtatacaccatgaaaatccacaaatactaacagcagggcttttatttctagtaataaaattgttaattctttactatctgatatggtttggatttgcgtccctgcccaaagttcatgtcaaattgtaatccccagtgttgtaaaaggagcctggtgggaggtgattggtccatgggggtggatttcccccttgctgttcttgtgataatgagtgagtccccatgaaatctggtagtttaaaaatgtgcagcacctcccactgctctctcttcctccttctccagccatgtaagatgtgcctgctcctccttccccttcggccatgattgtaagtttcctgaggcctccctagccatacttcctgtatagtctgcagaactgtgagtcaattaaacctctttttctaggtgaattacccagtctcaagtagttctttacagcactgcaagaatggactaatgcaccatcacacctctgactcacacgtagaagattaacaatgcttacttaataccattagatgtctactctacacaatggtcatatttctttggtaaacctttttttcagtttgtatgtctgaatagtgatcaaaataaaatctatactctgtgactgtttgatatcccttaaatctctttgaatccataggatccccaacatctctcttttttctggcatttgtttttattgttgttaagggaactgggttgtttgccctgtggagttcttcacagtctgcaattgctaattgtatgcctatggtttcatttaacatgttcctctgtttcctataaattggtcattagatttagtggcttgctaagatgcaggatttattttggggggcaagacttcttcataggtgcaggtggtgcacgtccatcagaaggaactgtcatgctggttgtgtttcatttttgtagtaataatagcctactgatgattctttcaaaatgataatattttgcattctatcacttattcttcatttactattttaaatacatctataagagaaatttatattaatcaatcatttggctaatttacactttattttattaattttttgagagatgagattttgctacgttgcccagcccgggctcaaacttctgagcttaagtcattctctattctccctggctcagactcccgagtaactaggactacaagcctgtgcctaatttatattttaacaggatcactctgattgctgtggtagaaaagactctagaggcaagttcgcaagtgtgaaaatagagaaataatctaggagggtgttatggctacctgggagagccatggtcacggctaaaaccagagtataactctggaagtagagagaagcaagtagggaagtccaaggactgagttgacgcacagccaacagcagttgtgagtgtactggagttatagatttttccacttgcaagtggctcagtaggttcctgatggttaataggttttatcatagctgagatgggaatttgggctctgggtgctacagctgggtataaaagcaaatcactcagcaggagggtgaggtaggggccgggagcgggtgttgtgaagagaactgatcatacaggtttcttgtcttaacaaagctctgagttatatacttaatgctaaataggcagttagtttaaaattccagttatgtacttttgaaagacagcagtggacattaatgatagttactgcgctggcttaaaaataaagaaaaagtaaagaagtctaagaaaaaatatatttgcacatatgtgatgtttgaggaagtcatgagattatcatgttaaagacctacttaacacattttcatcagcactctattattgcctatatttaggttgttcatgattaaatcacaattactaattgtagtaattataatctgttgtaaccctctcttgagctgtcaaaaaaagctgttgtattatttaacaacctaatttgacaagaaacttcagctactatattatttcaaggttttaaaattttcagaccatctgtttttaaatggtacatgcttcatttctttgaagacatctcatattttctcaggtagattcttttacgagtttttaactgctttcactggctaatttccgttcccaagtttttatgaaataatttacaaatgtattttcttttccagtgcttctaacgccactgattagttttctctaacttttgaatagaaaacaagtcgatggagaaacacattcagaaaaacacaaattctgaactccacatcatattgaatctccagtttctagatggagtttaatgtcgtcggtcacccatgccctcgtgggttcaggcatcagcgacgccactgttgctaataagcatgtcagcttcttagggaagggatgcagagaatcggaggacacgtttcccctgagacacttataaaaagaagagcataatcttacagctgggtgggccatgaaggttttccaacaaactactcttcccatcttttttttttttttttctgcaaaggttttcttatgcaagggggaaggggctcagtccctggcagctgctttcctcagggcggggccgggacattgcacaggctctctcactttctcttgggggggaagtgtgccccccacccttttcctgatgaacttgagggcctgtttgtcctgggagagcttgagcaactccacagcacaccgctctatgggacaaagccacacacctctcggggcatgtcttgcgcgattttggtgtttgctgaggcgcccgcttggctgtgccttggtttcctcacgttcttggtcaccttgtggcctttgttgaggcccacggccatggggtagtgcaggaccatggctgttgctctccgagggccgccgcagaggacccaccttctcttttgtagaaggaaaaaggtgtagaaaggggaagtgactttctctaaagtagagagtagccagtagacatgaatttggaaaggtttatgggggctgaagcatggaattcacatcagaataacgagaagagaggttaatggttaatatattttccaagaaaccatgagtagctatattctttctctcatctctttttcacacacacacacacacacactcacacacgtccacacacattcacacaccctcccatgcacaaatacacacacaggtccacacaacacaagcacacactactacacaccctcacacacataagcacacatgtccacacacatacacacacacccttacacacataccctcacatgtacatatatacccatgtccacacccttacacacatcctcacatgtacatatacacacatgtccacacacacgcacacacccttacacccttacacacaccctcacatgcacacacgtccatacaccctttacacacacccccacacaggcacatatgcacacgtccactcacacacacacgcacacattgttacacaaacaccctcacatggccatgtacacacgtccacacacatgcacacacccttacacacatacacatatgtccacacacgtacaaacccttacacacacaccttcacaggcatatatacgcacatgtccacacacatgcacgtaccctttcacacacaaatacatgtccacccaacacatgcacacactcttacacacacatacacccttatacacataccctcacacacttatgcacacgtccccacactcgcacacatacgcacacacctttacacacacatcctcacacatgaacacaccctcctgtgtgcacacacatacacacatctatccactcacatacacacaacaccctagatgcctagtttggaacagaagcggttaactggcaaaacatgttatgtgaatggcgtcccagtattttctttcaaatcacactaacaaccaggtaatgagatagtttgcaagggagaaagagtgtaaaaatgaaagaaaagtacttgcaggcaaatcagtatttgttcacctgttgaatgtgttttgtttgaatagatttttattgaaagattctattgtatttcccatggtttagatatttttccagcttttgtataaatatgaccatacaaaatgctcttgttcccgcccaatctctatttgcaatttactgaatgagtcatttacagagaggatcctgagaccatctaaaatactatgagtgggccctgaaaatgctctctttctactccctcctaatgaatttaagtgtttgaagaaaaacttactaaattcatgcgcctattaatagttccacaatgaagaagaatctaacaggagttcaatgtaaccactgtcatggcagagaaataacaaatgcatattatattttttaaaatcaggcttttttgagtgcatcaattatcctggtacttcccacttagtaaaagcagtgagtaggccctttaaatctatttattaattcactgagcgatctcaacaaactgttaaaaaagctttaggtattcattcaaaccaactaaaatacacaggtatcctttagaaaattaaaatctaggtaaagagaagataaaaagaggatactgattattgatcacccattctacgacgggccttttaataggccctatttataaatcaggtcaacacacgaacgtctccaccattaaatagaaatttgacaggagtaagagcattgtttctctgatgtatcgcccagcacctgcagtatctgacacacaacagatgctaagtcaatacttttgaatgaatgactgaatgaatgaatgaatgaatgagatgtcttcccagagaagtggttagtcccaagctccataacattgggtgggtgtcctcagccaaagtcacatcgcctcagggtacagaaatagaagacaataaggaaatgtgtttaatgaggatttcggtcatgtgttgatactcagctcttcacctcactccatcgactgacttcattcttatgattttatacttaaaatgtttgtgcatttggatgcaaacagccttaccaaggggaaattaggtataactctggagacaatgatctttattcttttttaagggcccgtttcaggcaatgatgccaggctttgctgttgctagggagatagagagaatgtggggggaatgagggggacattgagtgttttctttagcctgcaggccagggcacagtgaccagaatggagaaatagggccagcctgttctctcaatcaaatcccgtacagtccattgagaatagaagtagtcatgattacgttttggtatttagcctagaaccaccaaaaatatcagcctaaaacaattctattccaaatactgccatgttatttaagttgtcaattgttaggaagcatgggggcaattttgtgttttgacacggatatggattaagcacctgggagaagcatctgctctgcaaggtgacagcaacaagcctgacagagaaccagagcaaacagtcttttatcagctggtctattacctgagagacccagagaagactgtgcccagctgtgtgaatacttcagcaggcttgggctagacagctgctgagtgttcttcgcagtttctgtcatggcctggatacaagtgctcttaatctagtagattttaccatgagtctggctgctttttccagcacgctctccaggcctgttcattgattcatgctgcaagtacttacagtgagtctactgtgcggggggccctcttagcttaatatacacagaaaagacacttggttcagcaaagaaaagaaaggaggattcattaatagaaagccagctaatgcacagtttttccccccaaaatgtttgaattttttaaaaaattgcaggaactcacttcttagcacatcaggtctcccttgtctttttgccctctgtcatcttctctaaaccgaggacagcgatcagctacgtgagagtggtattcatgagtgaacacatggccaaaagaggaacacacaaactggtcatggtattttctttgcatctctcacaataacctctcctttaattttcaaggaatgcaagtcatctttagaaaatgacaagaataagtccaggcgcggtggctcacacctgtaatcccagcactttgggaggccgaggtgggtggatcacctgaggtcaggagttcgagaccaatctggtcaatgtggtgaaaccctgtctctactaaaaatacaaaattagccgggcgtggtggcaggcgcttgtaatcccagctacccgggaggctgaggcatgagaattgcttgaacccgggaggcagaggtagcagtgagcagagatcacaccattgcactccagcctgggcaacaagagcgaaactccaactcaaaaaaaaaaaaaaaaaaggaaaaagaaaaagaaaatgacaagaataaacaacataaggtgtctatgagaaacagaaatcacccaattgccctggccatattgtaggctgctgtaaagaaagttcactaccaaaagaaattcttcaagtgccgtggcatctggtgttaagattccaggcatctgacatttgccactcgacaggaaagatatagacaataaagtcatcctttaaggtgttactagaatgctctgtgtaaacttggtagaatgtaaaggtctgaggaacattgtgttataatgttatactttgcagtaccttttcctgtaaaggagtcctggtttactgaaaatttaggaaaggaatgcagattgtgacatttgcttctctggcataggaggcaaggcaaaatgcaaatgttagaattaatctcactttacagcattgcacttaacacacgcgttgaagtagcacagattcaagaatcaccatgattgccttcgttcaacagcttatgacacagtgcccagattccttttaatttcatgtaaaagaatcaatgtgtcaaactggcagagtatcctgaataaccctagtgagtggcattggaacactatggtcggtgctattcacaagacagcattccagagcaggataagaaatgtgtcagctcaaaaacgacattaatcctgtttcgtaagcaatattccattacaataaggtatactgcccaggaagacaacatgtttgctacttctagatgtctaaaaggtcattttctccagtcaaactttcattacaagaagacaataaaccaatatttgtggtcatctttctctttatgaaaaaaagtcaagaacttgagaaattgactgaagtagcaccctgtcttctaatgtagtcaagtctaccatgttctgttacgtacatttatctcaggaaacagtgtatatgaagacctagagacgaaggtgtgagagtgtgtgtgtgtgtatgagtgtgcgtgtgagtgtgtttgtgtgtctgtgtgtgtgagagtgtatgtgtgtctgtgtgtgtgagtgtgtgtgtgtgagagtgtgtgtgtctgtgtgtctgtgtgtgagtgagcgtgtgtggtgagacagaggaagaaaatatatgcaacacaagaagacaggactatgtctttttttttttttttaaacaatgtactgcccacgacagtcacggaagtgatgaaaatccagaacaatatgatgggtatcataaaattaccagggagtcaatgactgcccatgtaaaggagcttatagcagtgactgatgagtgaatcattctcagccttaaatgcttctcttacccaattcagaactgtcctacttcctgttaaatgtgttgttaaccagcaatttttaaattcttaatttaagatccttgccttgctttttaaaattcactattcaatcaaaggggttcacttggctatcaggaatatttttccccaaagaaggctacacaatgcacatttgcaagacagtggtcaaagaaattagccaggatcctttcatctcgatccctggagttggtggaatgcaatggaagacagaggactggatctgactatggttctgacacggactaatttttgaccaacaaggttttcatcttttgtcatcttttgattcctcgcttataaaatatcttcctcaaagcagttataaaaatttaaaatgagataaaactgaaactataggttgaaaagcataagacaattaaaagtattgctactgttagatattttgttagcaccttttgaaaacacaatttgtttttctataacaacttaggcattcctgaaaatcacacaccacagaaaattgagcaataaaaaccacagagcttaagagaaaagaaacagggtgcaacgctctaaaaattttatctgtgccacataaaaaacaaagataggaacctaataaaaacggcagcacagtgtttcactagttaattggctaagaaatacatacatactacaatagttttgtattttcaagacaatacattgtttctatcctgacaaagacctgaaagttggctcatggaagtgagcaccggaagagctaaagcttgtgagttattggaaagtggtagaaagaggattgtctgaagctggagagctgtcatgccagtaggaggtgttatgctcatatccaaggcctgaactgtgaggtagctggtagatgtttgagaaatgggcgttttatatatttctatagggctcaattcagctgggtgcagtttttttcattcactcacaaatgaaactatgcataaacaatcacgaaattcacattgcatgagaattgctccctaagatatcaattgtgttggaacaaatttgtgttttcaaatgagcattatagcagaactgactgtatcatgatatgtgtccccaaattggaaaacaaaaccccaaaataattacatgaaaatcaactggttctctttgttcctgctacttaaaaggagtatatacacggaagaaacacctcagcgcagctctgagcttctctccttttatcagcaaatagatgaacatttgatggtttgaaaaatcaatgacttcagacatgaatttcatcacacctctgtcttcctcagcatattatttgaacctcacaaaggacatttgattaggaaattaagatcaataaccagtagattaccaaatacagggagattttactttcattctccaatcattcatcagattttcatttccaatcttgattcactcagtaaatatttattgcacatttgtaatgtgtcaggccccattctaggcactggagatgcactggtgaacaaaacacaaaaaggtcactgtcttcacgcaacttacattctagtgagagaaacagactacaaacaatggcacattgatacatatacaggccttgtgcttgctttaatgcactttgtagatattgcattttttataaactgaaagtttgtgacaactccgcactgagcaaggccatcagtgccattttcccaacaacaggtgctcactctgtgtctctgtgtcaaattttggtaattcttcccacagtgtttcaaacttgtttgcattattatgatatctgtgatggtgatctgtgatcagtgatctttgatgttactattgtaattgttttagggtaccaaaacccacacccctttaaaatggtgaacttcatccatgaatgttgtatgtgttctgactgctccaccaaccagccgttgccctgtgtctctcccactcctcgggcccctctattccctgagacacaacaacattaaatttaggccaattaataatgctaccatggcctctaagtgttaagtaaaaggaagagtcacacatttctcacttggaatcaaaagccagaagcatgaagcttcatgagagaggcatgtagaaagctaagataagccaaacagtcagccaagttgcaaacgcaaaggaaaagttattgaagaaaattaaaagtgctactccagtgaacacacgaatgataagagagtgaaacggccttattgctgatatggagaaagtttttgtggtctggatagatgatcaaacccgccacaacattctcataagccaaaccctaatccagaacaaggccctaactctcttcaatcctatgaaggctgagaggtgaggaagtcacaggagaaaatttgatagctagcagaggttggttcatgaggtttaaggaaagaagccatctccgtaacataaaagtacaaagtgaagcagcaaatgctgatgaagaagctgcagtaagttttccaaaagatctagccaagagaattgatgaaggtagttacactaaataatagattttccttgtagatgaaacagccttctgttggaaaaagatgccatttaggactttcatagctagagaggagatgtcattgcctggcttcaaagcttcaaaggacaggctgactctcttggtagaggctaatgccgctggtgactttaagtttatgccaatgctcattgaccattccaaaaatcctaggactcttaagaattatgctaaatccactctgcctgtgctctatcaatggagcaacaaggcccaggcaatgctcacagtcacccaagagctctgatgaagatctatgaaaagattaacgttgttttcatgctaacacaacatctattctgcagcccatggatcgaggagtagtttctactttaagtcttacaagttaaaaacaaaatacattttgtaagtctatacctagacagatgtataataacatctatccatgtagatagtgatttctctgatggatctagcaaaaaaaattgaaaaccttctggaaaggattcaccattctagatgtcattaagaactttcataattcataggaagaggtcaaaataacaatattaacagaagtttgcatgaagttgattccaaccctcatgggtgacttaaaggagttcaagccttcagcggtggaagtcactgcagatgtggtagaaatagcaagagaacttggattttaagtggaggctgaagatgtgactaaattgttgtaatctcatgaaaaaacttgaacagatgaggacttgcttcttatgaatgtgcaaaaaaaagtggttttttgagatggaatctactcctagtgaagacgctatgaacatttttgaaatgacaagaaaggatttaaaatattacataagcatagttaataaagcgtagtagggcctgacagaattgacttcaatcttcgaagtccttctgtggataaaatgctctcaaacagcataacatgcaatggagaaatctttcgtgaaagaaagagtcaatcaatgcggctcacttcactgtcgtttatttgaagaaattgccacagccactccaaccttcagcaactaccaccctcatcagtcaacagccatcaacattgaggcaagatcctccccaaggaaaaagatttgctgaaggcacagacaattgtgaacaatttttagcaataaagaatttctaagttaaggtatgtaccttgtttttttagccataatgttctttgacacttattagactacagtgtggtataaacttaacttttatatgcactcagaaaccaaagaatttgtgtggctcgctttattgtcatattcatttatcaaggtgatctggaaccaaacctgcaatatatccaagctatgcctataatacataaattatatataatgttagaaagtaataaatgttatgaacaaaagtagagcgcagtgggaatcagaaatatataaattccctttcttgcaggggatttggtaaaagaagtagagctgtggtcgggcccagacaccatcggaatttgtaggccaaaggaaggggaattcactgataattttgtgtaggctgtagcatgagctaactcaaatgtttaaaagattattttcactgtactgtagggaatagatagaaggtaggaactatgagagccacttgggagccctttgcaatagtctgtgcaaaaactgatagtagtagcagtagaaatggtttaaagtgagtagagtcaagatatattttaaagttagagcccggggaacttattgatgttgaagacagagtaagaaaaaggatggcatcaagaatagcttcaaggtgttttattcaaacaatgaaacagtagaagctttttttttttcttcttcttctttttttttttttttttttttttttttgagatgcagaaaatggcaagaactgacttggggctgagggagagaggagtgccagaaatcaagacagtcttaataacagccaaagatcaacctaagaatgaaaagggaagcttcagcttgaattatttgaagttgaatagtggtcagtttttgttttttgtaattaaagtggacctcctacaccttgcatcttccccagccgtgctctcctgtcaacaactgtctgatatctgataatagctaatccctatagccttgcaatttcagaatagggggaaaatacatttaaaaaatttgatgattaaaaaaagatagtgataaccaagccactttcttgtggtactaaacatttgaatgtagtctctaatgttattactttttactaattttagctaaatacattccataaaaccaacaactcccacttactgattttcctgctccaagttctaacaatttttgtgaagtctctgggatcttctacatataaggtcatgtcatctgtgaaaagagagaattttactccttgttttctgatttggatgcatcgtatttccttttctagcctaactgccctggctaggacttctagtgctatgctgaatagaagtgtcaacagtaggcatcctcgtctttttttctgatcttagagaaaaagctttcagttttttaccattgagtgtgatgtcagctgtgcccttttcatatacagccttcattatgttgaagtaaattctttctacacatatattattaggcatttttatcaataaaggttgttacattttgtaaaatgctttctctgtatcttttgagatgactgtgtgatttttttccttcatttgttgatatactgaatcacattaattgatctgcacgtggtacagaagtagaaaaacaaacttagtttctcctactctactttcataacatgcttctgacactcattgcggggggttcttccccacacatcaagcaagcaatcaattcttgagcagacactagctgtcctccagtacagtcctgccactatctacctagagatagtgtttccatgccctctgcaggcatgccaccctccaggaacctccaagtgttcacctctctctgaacccaggttttgggggtttggggagagtgctgttacacagtcatgattgactaaatcaccggccactgaagaccagctcaacctttagcccttctcctctccctggaggtgggggagcaaggatggggctgaaagtccctaccttctaatcatgccttggtctttccagtgaccagtccccacatcctgaagctacatagggtagccagtaatcagtcaactcattagcataaagagatacttaatactttggagattcccggatttgaggagctgtattcaggagactgatggaagaccaaatgtaagtatttcacaataccaaacatgtggtgaggcattcttgcatcccaacgacaaatcccacttggtcctggtgtatgatccttttaatgacctggtgaagacggtttactagtattgttttgagaatttttgcatccatatttatcatagatattggcctgtagttttctttttttgttatatctttatctagtttttgtattgggttaatgctggcctcataaactgagtttagaagtgtccccttttcttcaatttttcagaagatgaatgtcaaaattccatttgtttatcaatgatgtgagccacttttttgttgctgaatcagatcatttaatagttttcagatacagaataatatatgtgtttactattatgtaaagtaatatgtaatagtgaaaggcattaatgcacttttaagtttatatttgcaatgttaacattttctccatcactttctgaagtcttgacagctaataaaataatcaatcaagcactgatttgtagtgtttgctgatttccctggggtaaatacaaacaaaagtatttgcacgtttggaagctgatttcaagcttccaatgtttgatatggagcccagagatgggaagaaatgagcagtttatttacaagatgtaaacaacctcaaaagcacagataattgtaaatggagtaaaaaactagaaagttacaagttttgagtattgcttccatttaatataatttaatgaactataagtttatataattgaatagttaatatatactgtttaacagccaacatgtgaattcctgagaatttagcaattggctcctgtgaaatactacaagccagctccagcacaccattgtagcttggtctccagaaaacaacttgttagaattatttggagccaaatatggggaaaggaccttacccttactttctgcattcctcttttcttacgtctccctatgtgcacaaaggaagctactgtcaactcttcagctgaatcaaaccccaaatcctgaggcaggcttctcaaggtctcactgagaacccatggcaatcaggactccactcccagccacccgggattccagtaatgaatttggggaggaaagatcatcagtggttatctgcacatcaaaagtatgcaccctttgaaaatatcatggaataaacatctctgttgctgacatcattagatgtatctttttggattatcaaggtttcagacttcagcttcttggccactcatcagttgctgctgttggatatatttttaggttctaaatatatcttacagggacaataatatcatcatctcctttgccaaagcagaagataacatttggcagtaaacactgaatcatacgccttcccagttcttccgagatttcctttcaaggccttggcttttccacataaacaatatcctgtcttgggttttccacaggaaaaccatctcctgccatcttggtgcccctcactcacttcaccttctcaactgagaggctgagcataatacttactccttgaataatacatttgtctacgtgttacagacatatcccctgtcactcaggaggtcctaaccagagagtaatcattctgatagaaatgggcaagtaaagacatatatagacaaaagattaaaattgtttggtcaatactggaatccagcaatcacacactaatggaagtatctcagtttttaagataatggtaaaattatagacatctataatatttcacattaaatataaaatgagacttggttggaatctatcacgtagatgacatcaaagagctctccactgtaaaaagtcatttcttatatttgacatcattttaaagtattctatgtgcatatatgcccttgccagcatctaaaaggcttctatcctgagaaatttctttcttttttctttttttttttcccagacagagtttcactcttgttgcccaggctggagtgcaatggtgcaatcttggctcaccacaacctctgcctcctgggttcaagcgattctcccgcctcagcctcccgagtagctgggattacaggcatgtgccaccatacctggctaatttcttatttttgttgttgttgttgtatttttagtagagacagggcttctccatgttggtcaggctggtctcgaactcccgacctcaggtgatccacctgcctcggcttcccaaagtactgggattacaggcataatccaccatgcccagactatcctgagaattttcaatgtagagctattgttttataagcaaaaatgatcaacatttatattttaatcattataaagcaatacatattcgatttgcttcatttacaaaaggcttcctggacttagccctttaaaaatgcacgacacttaatttttttttaacaaaaaagcagaaaaagatgatcaaacgaaggatactgatccatcaattactcctcaggaagacaggtggatcatgtgtgatttttcaaatgtttcaccagattgttaaaatgattaaatgaacaacctaagctcaacttgaaatccatacagatgtgatagcaccataaccatttcttaccctctggacactgtagtatggttgcctctggcatctttaacttggttggctgataatatttaatataaaaatcttcatggggtgtcaataaatgttagctttctactccctttctacaataaaagccattaaatcatgatttattacaaaaatgtgacttgactgattttcccatgttatacatccatgaaatgtaaacatgaaatgctaatataaaagaaaaatacaagaatatagattttactgttaatggtgcctattaaatgttggtataaaaataccctaagaaaatgcaacaaaatattaatggtggtagtgcctttaactggagggattaaaggtgatgtttccaagtttacataatgattgtgaaatactcctgggatagagaaataaaattttattaaaaatattattatgtttagagtcagggtcttactttgtcacccaggctggagttcagtggcaccatcatagttcaccgtaacgtcaaattcctggccttaagtgatcctcctgcctcagcgtcccaaaatgctgggattacaggcatgaaccaccatgcctgacccaaaagtttatttttaaaaacataaattttaaaaagataacataatcatatctcacttcactcattaaacatattctagaaaatgttttataatttaatttttgtttttaaaaagttcgaaggccgggcgcagtggctctcgcctgtaatcccagcactttgggaggctgaggcgggcagatcacgaggtcaggagttcgagaccagcctgaccaacatgatgaaaccccgtctctactaaaaatgcaaaaattagctgggcctggtggtgtgcgcctttaatcccagctactcaggaggctgaggcaggagaatcacttgaacccgggaggcggaggttgcagtgagctgagattgtgccactgcactccagcctgggcaacagagcgagactccacgtaaagaaaagaaaaaaagtttgaaaatgtcccaaagaagctaactactctccctgtgttttcccagccatgctgaattacttgtagttccctgaagcatcatgctaattccaactctgtgccctaataggtgctgttgctgatatattaggccccttgctctatgttcctcatgtaactatgagttttccttcaaaaccttccccaggaacactttctgagttctccactacaatataaatgctcatccttcggagagatccctcaatgaatttatcaacagtaagcactatcacactataataactgtggaaagtgatttaacaaagcacagtgccttctgaataaagaaatgaatgaatggataagcaactttgacactcccataacttaaacaaatggttgacctttttgttttctctcacttaagtgactggctgtttgactcgagtagtaaaaacaaactaggtgtcttgacaccctaaaaagggtgaatgttatctacataaattcaatctatacatttaattaaatagtatcattcaataagcattaactgatggcattgtaagtgccaggtttggtgttaggcactagaacatggaaaggaggaacagtgcttctttcctcaacaaactgagactaacaggaatagtcaggcaaatccacagttgcagtagtgttattaagtgcagtgttgaagcatgcactttctgtagcaggaacaaaaaggggtgctgtggggtgtggggacaagccttcttggttccaacactgtgttaaactaaaatgtagttgtatttacaatacaaagcttaataaaggctgcactggacaattgcctaatatcatcaatgtaaatacccaatgttatgtgattagaatgggcataaaaaataacaaaatctgctgttattaacaatgattcccactggaatattggaagacacactgactatcactcactacagaaagtatagaattggaaaagataattttatgaagatttataaacttttaaaactggtgtgaaagtattatttcccaaattcagtttgtagctggggtggggcgagtaggtagtataaatttcttcttaaattgtatcatgacagagaagtgttctttaggattccattgttgtggactaacaaagtcacttttagatatctcaaatttgaactttattgctcttcctatcttccaaagaaatgcactgaaaaataaaatggtctctctacagaagaaccaaaaagcacaagcagttttttttatcctcacagctttctgttttcaagcaatttggagtccccaggcggattcaaactcgatcccccttccacctcactcgggctctatgcactcccacagataacgagattgggtgagcacatcagattcactttccaaaggcacactgaaaaatcttcatgcagattaaaagatttttttaactatttcagcttccacatcttccaaacttctctttctcaaaccatagaacactatcatttgtgcagaacaacatgaagatgggaggttatggttccttcaattatgtctgagaattaagacatatgttatatatttactatgaaccttaaagaataaactgcacctagatctaataaccataattctaaataaccttctataatctattatatacatagtagccagatagacttctaaaaacatagctcaatcagcgctcaaaaatgtggcactgattgacagtgtataattctcactcattagttgtggaataaagtccaaaccgccgttctagaattcaagctcctcacaaactggctccaatctgccttcattgttgattaaccacatgtcccttgcaaaatctacgctccatccccaagagactctgtgttgttctctgagcattcagagaactcttccacctccatgtctgccctctcacggtttttcccacttgactaaccttcctcccatttcacctattcaaacctaactcatcagaagccctcctctctgaagcctgtctagattatcccacctgagagcaatgtctctgtcctctacgttctcactctgctggcatacatgtctcttgccacctctaccacatcttgctcacctttgtaagtaaacctcaccttgctcacctttataagtaactgttgttagcacatactaggtgtacaacaccacacctataagtgagtggctgaatctttttacaaaatgattcagaaggcatctcaggattatttcatttctccacataatcacacatatcgactaccattatttgatagattcagaggttgcaagatattggttgactatatattcactctttaactgatactaaaagttgttttagccagttaatctctaatagcagcttatctgccacttatttgattctcatataaagaaagagtattaaaaatctgatgtttgaatatcctacttacataaattcaagaaaagcaggggtttagcatatctgccaccctgaattcaattatctactgcatgtgttgtctctcatgtgtaacctgggccttgatgctaagccacccctcagagattctttaagttccaatgtcagaaaatttgagggtcctatggcatagaatgataagtaccaacatggttactactgaagatgttagtttggaaatacttttagatcatggagtgcttaagtgctatacagtcatatcaccaatagccttaccttttccacaagattttttttaacaaaatgtaaaatacaggtactgtaattcatgaattctcacataaaggacaaataaaaataggatcatgaatattgctcagactttgaatttttatactgtaatctaagaatactctgaaggacacaaatcaaattggtagggccaggaaataaaataatttctaaattctactaacagtaaaaaacacaaatataaatcttattaaggcagaaaataaaaaacaagagattttcaccatttagtttcatcgtttaaatatcatatttattatcatacactgcaaactccccaaactgctttgatattttcccttaaaaataagagagaaaacatgaaggcatctgattttgtgataatagaaaatttcttgataatatgtttttgtggctataagtgccaatgaatatatcaagttctaaataatatgcaatgttttaaataccaatgaatgttgtgacaatttttttcatttaaattgtgatgtatgtttgcaagatacagtctacttcctttaagctagagaggcgcctgtcagcgcctgtggaggcctaagaggaggaggcttacaactgcagtcttctccttcctccctgaccccgttgtaggaataagaagtaaatcttcagtcagaatcagcccatgcacacacaagccagtggcaaacctctgcccaagtattaaaggataaactgggcaatcagatttgaatctcaaaactctggactaggaaatcagaagaatgaactactgtaagtcaatgatatgaacgagtccaagagacaaagtagagggggaaagctaatcagtagaaaacaggcagatgaagatgcctggagagaagcagagctgccaacggagaacagacgcgagagctgtccgaggtcctgataccctgaggttctgattccagtcaacctgcagactcacatctatcctgaaatgcaacccaactccaattccacagagtcacaatgtacctaaattatttggacagacacagaagtcataataatataatttaacctactgataggccctgtgacaaaaaggcctaggcaaatggtaatttttaaaagcccagtctgcctgagactgaagcccagctctgtcatttattacctctgtggccctaagcaagttatttagtctctcttagtctccaatttatcatgtttaaaatggatataatagcaatgcctcaaagggttgttatgagaaatgcgtgagatgatgaatgtgtagtggttagcacagacggctccaatgttagacgatgatcaggagcatgatggtgacaacaatgatgataatttccttttccacacgggcatagtagctcaatagagaaataaattagctttaaatttaaactaactctatttacttattaccagcttgttcacttaagaaataggtagactattatagttaagattttaaaccttagatgttttgccttggagacagtttgggatgaaagaaaaatatataaaagcaaaaaaaacaaaaaaaaaagcaactttttacttaaaacctagattctttatttttcttcctaccaccacaattgattctaaatctcatgtataatccattttctctgcaaaaagtataactcatgcactcattcccttcatggagactttatgagggcctcatcattgaactttctgtcttctaatacgtgtaccctttttgcattgcatcagaagaaaaacttctaattcacagtcacctctaattaaatactcttctggaacacaccactgtctgctgaataaagaccagatttccttagaatgaccatggcaactttttacagtctgatctcagttcctcaattcatcccctactcatccctaccagcttttcatggtccttcctcatatctattcattttctctggcttttttccttgcccaggatctttttctgacttacaggtctggataaagacacaagtttttggcctaagtcttaaggttcagttcaaaagctctttcttaataaaatgcctcttatctttatactctgacctaatgattttcttttccttggtcatagagtattctgtatttctattaaaagacatcacattctactataaagctatggacacatctttccaaaaaagcagtagctatattttaaataaacagtgataaaaaataattgtgaagttcataaacaaggtaaccctgatatgggaaaattgttggtaaacacatttgaaactattccataggatgtattttaattcctccatgttcccatccacgacctgactctaaggagataaaatagaatcctgttgctacgggggaaacccaattatttaaacaacaaagattttctctagttcaaggtgaaaaactttcctaataagttggtgctcttgagcacaaaaagatgaaattagatataagggggaggcactgaaacccttttcaatgaattcttattgagcgatcacagtgatccaaactagcagaggatccttgtgcctattagttacacagaactcataggccaggtactattttgctattgaatctgcagtttggctctccacagttactcacgctaagctataaacataaaaatgaaaaatgaccataggacggtaaaaagggtactcatattgatgatatgagaggcatctttcatgtatgcctaacacactgccagtcacaggtgcacacacttaaacctgctttcaaataaatctctactgactttcactaggaaaggagaaacgtgtctgttggcaagaggttctcactccatttgggttattggcaacttttatacagagaccatttggcagactccatgacatcatgcagggattttagatctgatacttgttgtgcatgcatctctcatgttttaggacaacattctgatcacaaactattctcctttttttcagttatcatcaaatattgagacacatacagaggggaagggaggaggaagaggaggaggaaatagaataaaatatctgtaagtctcttacaggaaaatgtaatttttctcacttctccaggcaaacaggatgacttggaacaaccgttacattttttcttttttttcactatgctcctctgctctctactcaagaggctaccctgttaaataaactaaaatacagagtgatcggatctactgataaaacaaagtaagctctttgttgcttcacccagcaaaggtcactttcccagtggctttcagcttccccaggaaagtcataatactttccaaagcactcacattcccccgcctaggatgtgtactcaaacagaggtgtctctaggaacttcatctccggtttcactactaattggaaaatactgagggacagaagaaatccctcagcagtttcctcctgggaccctggttgcgtacgtacaccagctccttagtgagatgcaaaggatgaccactgttaacctggcttcctctcaagatcctccagaaagaattggataaaccataggctaccttcttgctctaaataacctcctcttcaattttcacatcagcttattaaaggtagagaatcctccagctataccacctgctttctttgtttctccgtgtatcagtaggcctgtctacaacagcattaccaaattgtgtgtctatttattgtctgtacttcaccttgttctttaaaaactgtgtttaatatttacctacattattatttgccctatgttttatcttttaaaaacatggaacaccaattagaaagacacattaaatgtcaacaattagtaaatttcagagaatcaaaaataacagtagaaaaagtaggattaagccaggtgtgatggatcacacctgtagtcctagcactttgggaggcaaaggtgggcaggtcgcttgagctctggagctcaaggccagcctgggcaacatgttgaaacccatctggcacacacctgtagtcccaactactcaggagcctgacgtgagaggatcacttgagcccaggaggttgaggctgcggtgagctgagatcatggaacagctccccagcctgggtgacagagtgagacactgtcaaaaaaagagaaaaaaaattaagaaagagagagagaaataagcaggaaggaaggaagagagagagagagagagaagaaaggcaggaagaaggaaggaaggaaggaaggaaggaaggaaggaaggaaggaagggagggaggggaaaggaaggaagaaggaaggaaggaaggaagagaaagaaagaaagaaagaaagaaagaaagaaagaaagaaagaaagaaagaaagaaagaaagaaaggaaagaaagaaagaaagaaacacacagactaagatcaagccataggtacaggtaggtaattagaaattagaatacctgccatgtaggcccttatactctgttagaggcaggccatagatatcaacttctgaacctcctggtgtttaaggacacatgcctataggaaatatagcacctgaaataaacttcataaaactgtttattatgaatgttttcatattgcaatgatgaaggcaatgaactaaatagcctaaagagtaaaaacatgttattatgggattccttattaaataatacataacaggcaagaagaaaagccaacagcataagttttcataattcaaccaagtatagggacatcagttgttacttgagctccatcatgtgtcattattataatgacagaagtagcagcatcaagaactagatccccacaatacatctgtctgagagcctgtatcattcattgccaaatgtgataagaatgtgaaagaatgctacactgataatagttttcatggtggaaagaaaagaaaagccattaatccagagcaaaagttagaaataatcaagaataaacgtatgtaggtatgttaaggttttatgactatacatttacagatgttttttaaactcttattattgaaattcctacaggaaaaatagctataattacagatctaaattatcctttttcccaatacaataattatgcttaaaactcaatttttgatagaaaaaggcttcttagagtacagctaccacattctagtacagactgtaaaataaagtaaccatattttcaaagcagaaataacatatggcttgaaaaataatatatgaatttggaagtttgtttttataaaagagtacaatttatgtacatattaaattacatttgattttagatttaatggctttttggaaaatttttatgaagtcaggattgttacaggaaaatttggaatgtagattttgctagaggtggatgctcttaaggactgtttaaaaaaaaggtctcacccaagtttttcataggaatctattcctgttcacatttttttgatatgtggtaagggattgtatttggagtcagggctttgccactggctagtaaccttgttccaatcatttagcttctagaaagttttatctccacatatgtaaaataaaggaagacctggtccactgcatgccttacacttttgtgatgctgtggacttttgagaagaacactgctcacttgtccactttcagccacagtacagctgcttagctacaagaaactacaggcccagctccactcctaacatgggattcatatctgtcctagtggactggaaatcaagtctttgtgccaatgcaaactcacataaccatactctgatggccagcactttgaccaggttaatttaacctgtctaaattttcaccttctgcctgctcactcctctaattttcaccttcccatgaccagctggtatcatggctgtctgttttggtgactgacagctagggactccagcatggttttttatctcctaggcatggctactatctgggatgcttgctctaataccttacactgtcttcttgtaacacagtttcttaaggcttgtgtctctatagaaacatgtcagaaaatgctatcttattatccctacccccaaataaatctacagtggggtcatttcatttatgaaaatactctggaaacaaagttgatgctcaggcaactggtctaccagggatagcatgattttttttttcttctctgcaatacctatgcacaaacttgtatctagaaatcaacaataaatgtgaaatggaagtcattaccactcaccgtcacaaataatgttttctttcattttccatatgggcaacataaaggagtgaaaataaccattgctgttatgcacttggtaggtttccatctaataaaaagcttcatatctgtaaaatgccaataacattcagtctatccttcctcatttccaacttcgagatctcatttatcccctactgttttcaggggttgactgaacttgtatccacaccaaaaccttccatgcccaagatactagtgagttacaaccaataagtattaagagaattacagaaattttgcatatttactttgacaggatacaaagatactatcattagaaaagtgagaaaagtctgtttgagtgggaagaaaagcattctgtcaataagatcagaacatgtacaatagtcagttggttgcttacggagtttaaaatttccaaatgctttagagcccagttatactgcctgggagtcttcagagatgggatacccatcactaatattaatattgatggtaataaaacctgtctccttccagcattaccctacacaaaagagttcttcttgtgataatgcaatgaagcgctaatcctctacaaagggctcggtgatatcagaataccatacgttccctttaatgttattccataatgaccataaagtgcctaattgtcaataaccacttaagaaacaggttctcttgggtccttaagtgctggataatgtggtgctgtcctcagtaccaggtaaaaggaagattttttttagctctaggaacttaggtgaaatcctggaaacatttgacaatgtttcttgtgtgctgctggtggatggatcatagatataaaacatacatgatggtttataactaggctttcccattgtatagcagcaagtgctaatcaataagtcaataaaaacttgatggcaatttttctttgttttttttttgtttgtttgttttttgttttttgtttttgagatggagtctcgctctatcgcccaggctggagtgggtggcgcaatcttggctcactgcaagctctgcctcctaggttcaagccattctcctgcctcagcctctcgagtagctgggactacaggtgcccggcaccacactcggataattttttgtatttttagcagagacggggtttcactgtgttagccaggatggtctcgatctcctgacctcgtgatccacccgcctcagcctcccaaagtgctgggattacaggcgtgagccaccccgcccggcccttgatggcaattgctaactcaagtgagggcccataactctctcatctgatatgacctgctattagtggtagatgtcacacatctgagggtgaaagggaatataccacatgatctatcagattcaaaaaacaacatgatgaaaagccaaattgaatttaataacatgtaattaagtagatttatgtataaagccagtgtgtgggtttaaataacccatcacttgaagacataccagttatacagaagcttatctgaaacaaacctgaagtctccctttgactgcaagctcagtgtgacctgaaagtgtaacggggacaataaaacaatgaagctcttgaaaacactcatgcattaacagaattagagtatccagaaagtgggttgtaaaagttccactgtacactctattagtcaagctacccctatagctatatttgtttatggaaactctcttccaccctagaatctaaaggcatatattcttccacaccacacagcaaaataaaacgctgtttctcaacagactctggggactccaacagcagggagggaggtgtcaggggcaagggttgaaaaactacctattgggtactatgttcactatttgagtgatgctttcaataaaagtccaaaccacagcattatgcaatatactcatgtaacaaacctgcacacataccccctaaatctatttttaaaaaccctgtttgtatttacatgtaacattgattttcattggtccattagtacatctctatttagcttgacttttccatgattcctatattaaatgtgttcttcagtagaattttccttctatttatttaaactctttgttccagcaaatgtcaaaagccaactaaagaggcactttaaagatgctgccaacttcagatcctctctatcaaaaatggaagaaagtctaatttaagaaagagggtatttccactcacccattgtgctgctgattattgaactggaagtaaccacaaggtctgcaaaacctctgaacttcattttgaggaagaagaaatgctagtcaaaatttacttagaatctattaaatttaaagtattataatataatgattgaaagaatggacttaaaaaaaatctaggtttgaatcctggctctgctacatgcaacttagctttggcatgttccttaacttctccaaatctgtgagtagtttaaggattaagttattaatatatagtatatgtaaagtgcttagcatagtgactcacatatgataaaggtacaatatagtttcactattatgttgctgccattgatattatattattattattacttattcacttgcatactgtgagacaaagtttagacttgagatttagcaattgtgtttgttactctagttctgtatttacttactagttacacctaatgcagtatttctaacaggaggaatgtaaataagccactcttcaggggtagagctcttgacaattttactgtcagctggaaatttgaccaggaatgtttcagagagaagcaaaatgagcaatacagcttctattcagatatccagagttagggaggcgtaaggtgattattcattcattcacagcagaaagatgtatggtaatgcagagacgaaaaatatcagtgtcactagagaagcatcaataacatgctgagggatttcagcagatacaggaggaaacctgctggcctgggaatgtttaatttgtaatggactaagagaacaatcgagtttccaaaattgtactttggctacttccattgctgaatttcctttccagccactgccccctcgacctctgttacagtctttacatttttatgaggttgactttcaaacatttattccaaagagcaccgtgtagtttttaaaagtaatcatgcaaggaacagtaatggaaatcgtaagcacaggactggagttaagtgaagcatcagccagttaggggctgtctagaggaggcccacaggaaggataatggatctgcaaaccacatcatgtgacatatgattaaatgaaacagaaacattaatcctggaaaagagaaggcttagggaggccatgattgatgttttggtgtaggtgacgtgatcttgtgtgaaaggagattagatatcctatgtaaatccagaaatgtacattagaaccatgggaaagaatgccagaaaaatagattttatattaatgtaaggaactaatttataatcgtttgaggtgtccaaccaagacttcctcctgaagatgtggactccttcccactaaaagaagtcatagagagggagaaaattctggcatgcgggagagggaggactgaatgagacaacttccgcggccccttcaccatctaagagtccatgaagtatctaacacaacgaaacatttcctttttagagaaaacctaattaattgtggaaagctgttaggaaaacttgattgtgttttatatctcccatctgcatatctgtaagcaaaccaaaagcagaaacttactggcagcttcaccttctttggcgagtttagtattgtcaatacagtaaagcctctcaattctgcatgcaatttgacatgaacagaaggaagaaaaaaaattagaattccaccttcagaaccacctaggagggtgtctgacattgaacaggtaatgaacaatgaacaggaccatttccccagcagcctttgttttccctgccacctgcaagggatggacagttttatttcacaatgatgaacagtgatgtcgggctgagccctccactctgtctcaattcactccccacctggagggaaagggataacaaatacaaggtcttattttgtttttgaagggtctttcagggacaggaaaagcagctgttgtagtttagaacagacttcaaaagcagatcaatagagagccagacccaggtgctccttaaaggcatcgactgctacaatattgtcatttgcctcccttagctttctctaccactttcctctcaagccctgctagactactggttttgatagagtaacactctgttgtgagatgggattgtttaaatgagagaaagttcacatgtggaaatctgccatggggaatctagcagtaactagatatgtcccatttgggtcattccaatttttatttcaagtctgttagaacagatgtattcaaaatgacatctagataaggccaggcggataagaagagacttcagctgggacaagaactactttgtgagttagaaaattgggttcatgtttccatgtttataatcttggctaagtctgtaactgatattcctcatctaccatatacaatgaggactgctgtgaggactaaaaggaaataatatctctggaaacactatgtaaaatccaaaacactgtgtaagtcttagatacggcactcttttactacacataatggtcatggtttgactgaaatctcaacaattttacagcgaattaagggaattcactgtattttcttattttcattaaggatattaaaactatttatatagataatatactctattagcaagattattaaaaagcaatttttagctttagatatcttctccagtacaaagcttttctctttatttttgcatcttagttgtctcttcttaacagaaaaatgatcctttgtatttccgtatgttaataagtttctgtgaaagttagatgacttccttacaaatagtaattaatattattgtaatagcaattataatattatagttttataaacattggtgctgtgatgtcaaaccagattaatatattgatctgtatatacatatatatagtatatacatacatatatgtatatgtatatgtatatatgtatactcttgaaagtattttagtactccgtcgcttccccaaaaaggtaaactagatattaaaactctacctaggataaacagataatggacaagaagagtaaaagctttttcacaattcttagcttctgcactgaagttatgaagatcgtggttaactaaaaagttaaaaatctttttcccataaagagtaatcaagatttccactaatcacaaggccggtggttgaaatagcaagattcatcctcaggcttgcactttcttgttgctggagagcaatggggatggggaaactctcggtaccacggtcctgggattggctgggtcataaagatcattccacaacatgggattctttgatcatctcagtgatactccccccagcctcaaatgctcagggcctctgagccagtccacctctcagaagaggaaacctaatatcccgcaggggcccattccacagtgaaaggctgttagttggaaagttctttttaccttgcagggcaatacagtgggaagggactatccagtaaaactcctccaaaacagtagtaaccactcaattcatgaagttctctttctatactgcagttttctaaagtaacataaaaatatccatggatttttcactttcctttgaatgcggtgaccattccttacctttaccaaagaaattgcaagaaaaaaaatagaaaaaaaagagcatctcttggcaaaaggtcccatcagtaattctagttatagaatcccttcaagaatcattaattgtgttacactacagaataaaccaaatatttatttctgcaagcatcattaaattatgacatattagaagtcattaacaatcagcaggcaagggcactgggttctgccagtttaatgttctgaacaatcaaaaataatatccatggggcaattaatttcctgcacattgattattccaatctccacactaataagtggggctaaaccaagtaaaatcaaaacagcacagcaaaaaactgcagactgatcccacttgtaaaggggagtctgtaaccttgacagatgaattgtatttcctaagttatagggggagaggaggaagttattccagcaccctaaatggtatcttgaggagctagcatgatccttacatccactatacccctttcacacacagagatacatgcacatttcacaaatgtaagaattaagattcaacagattgtccaaatcaagcccctagtaataatgtcgggaccaggatctttggattagttctatgtactttccactctgtgggcaattcaatggatgtttaatgattctggaattggagaaaaaacaatttctattaattcaacaagttccacagcaaactgcaaaactgccacttttctctgggtttgaggaactacttattcataaaatattagtcaaccaatgtatcaaatctgttgttaaaatgttatccagaattctaaccctttcttccttcatacattctttaatctgtcaggcatttaataaatatccactaaatttatcaagtgatgtgttaggtcctattggaacacacaaaaatcacaaaaagatcctgttcttaaagagctcaaaagattttaaaacacacacacacacacacacgcagagtgatgtgctggtagatgctcttcatcaaccagttttccaggggctgcaggagaagccttgatttacagcatttgccacttcccatgatacaaatactccaaccatggctaatttcaatttttcaacatcaatatggggttgtggattcagggagatattaaaaactgtctaaactggctctagtgcaccactactgatacactgctgatatgagtgtgtgtttcactatataaaagaactaatcaaatattttagagttgttatgttagagtagtgtgattatgattgcttcttcttcttctttttccttttttttatagcatccaacattttttatgaagaagactttttttaaagataagtactagtagcaagattcttatcccagaccactttttctacatagccttggtataaccaaaattatctgaggagtagagaggctaaaatattttgatggcacatcagattcgctttagagccacatgtcccagtagaactaagaaaggaaatgctgcagagagtgtccaacttctaagaggcatcatcagacttcatttagcactaagtcttcctgagccccacctatgtgaccatatgaccacctagatcttacaaaatatatttgcagagcatgccacctccacacattcttaagattttgaaatattcaatcataggatgtatgtgaaagaaggggaggaagtagaaactaagagaaggataatccctaaaacataggaatccagacagaaatattattgcttctgcagaaaccctaggacaggattgaatgactcaccacctgtttggttttatggttacatttcaacagtgtctgcagctgtaactcatgcttcctccttcggctttcttaacacacagatgcactctgttttggaaccaaacatctttgtcccattccagaaactcttttctttcttaggactatatgaatgattaaccctgtaatcttcaaggttatttattatcatttttaatgtgaagaagtggaagttttgtggagggaaaataaaacgccttattgcttgcataacattttaacatttatgaaacaattgcatgtaacttatcacagttatcacaataatcctctggaataggatattcctggcaccttcatatgtgaagataaagaggctcagagagtttaaaagactcactcaagttcacaaagccacagagtggtctctcactgccttaaacacatgggcttcagaatccatattccaacccagtagggaagtagcttggtatagtttagagaaaaacaagatgtggagttaggcaggctagatttcaaatcttgacaccaccattttccatctgtgtgatcttgggtaaaatccttacactttctaggcctcattttcctcatttgtagcatggagagatgacactcaccttactggactgttaggaaaatcaaacaaaataaaatttggcataagatgggttctcaaaacatttcttttctcttttccaccattctgtactccattgttcatgcctcttgtccttgtatcatccttagttcaaacatactcattttgtttcttgccctgactcaaacggcctctccagttgaacaaccagaagttgaacaatcatttaatggacagtgtgttctaccagagtatattgctgtagcaagaattagaccccacacaattgggaaatcagggaatcactgcagtctaacatggaagccccactggttcctgcacaatttttcttagcatactgtatgttgtgccaccaagacacagcagctcaacacaaagtacacacagctaggaggatggacaagtcatgcagagatacagtactgaatgtgcggcccattataccacgctcttcctcttggctccatctcactaaatgcacggtttccaaagtatttattgcacacttcaatgcacaaaacacacaagcaaacactcaagaaggagccagaaccgttttatactaagcctgtcactgctcctccacctgcaaattctggtgccaatgctcctctgacttcattttcataactcaggcaactcagtacttccgtacatactcttccaccaacctaccttccccttcaatttgaaaggtaaactcttttatttactggattatttatttgcagggacattaacatgttcttataattgtgctagtattttccataagctcactattgttttggttagtgtttaattataacattaaatgttttgagtgtttaaaatgttttgagtaatctgttccaattctattttcctcaaaacgtcagttatttttagtgagtgatttttcagaatgtgagatttttaaaaggaatacatgcattatgtgatggcaagaatgctcatattttgctttgttgtgtagctattttttatatattgaggtgccacaaattgatgtgcttatttgactctgttaaaatccaactcaggaggaactcatctccatggttaagaatgtacaatttccaccaaagatagtaccgaggggggaaattcatactacttttcataaatatgctaaaccaaatgattctaaacataaaatagtgtatccaatatagcattgaaataaatctatccagtactggcctatctctacaactttaagcagcttttgctttattatgtaaaagcattccatttttaaatcagctaaacttccaagcaagcaaagacattacaagaaaagattcttcagctacagaacctgtcacatgaggaaccaatttccagggtaagaaaataagctcaaatattttaaaaaaatgtttcttcttacccctagcatactgagctggcagtataatgaatcagaacattttcatttgcatttattctttgacatgggcaaatgacaacctttccaggctttcactgtaggaaaatggcaattttaaaaacttgaataactatcctattaattttatgaagttgttataagagataatatatagtatattatatacaaatatatgtttatatcttatatattaaatatatatatgtatactggaaattacttgtaaatctgtttacccttcaatcttgagactgtacagtactctgataaagaacatattatcatcatcactgattccttatccccagccacttttagcaaattgccttgcacatattaattttttttaagttctgtgatacacatgcaggatgtgcagatttgttacataggtgaacgtgtgtcatggtggtttgccgcacctatcaactcatcacctaggtattaagcccaacatgcattagctatttatcctgatgctctctgccccccaaccccaacaggccccagtgcgtgtcgttcccctccctgtgtccatctgttctcattgttcagtcccacttataagtgagaacatgcagtgtttagttttctgttcctatgttagtctgctgagattgatggcttccagctctatccatgcccctgcaaacgacatgatctctttcctttttaaggctgcgtagtattccatggtgtatacacaccacactttctttatccagtctatcactgatgggcatttgggttgattccatgtctttgctactgtgaataggccttgcatataataattattcaataaatgtttgctacattaaattgaaccatatgcataatcaaagtcagagtctcgctgttaagttgtttaaaggactagatttattcctagagagcaaatagattgttcttaaaaggcactggctatggctgttgaattggttaaaattcagtttggatgcaagtgacagaaaacacagattgtaatatcttaaagaaagtataagctaatttttctgtagcaaagaagtttatgtaggcaggtcaggtatggtgaccctgtaatcatcagggaccattgttgttctaccgtcataaactctcagcttgtatctcctggccaagatgattgcattctggcctgcaagaaaaacaaaagaaaaacaagaaaggtgcatgccctttttttaagagcgctttctgaatattacatcccagctgtttgcatcccattggctggaatatattatcttgccatgcctagcagtgtaggagcctgggagctataatctttattctgatggccatgttcctagataaatggttagtgccattactacagaaaaagagggaaaaaataccaaggacagaaaggtttatcacagtttcataaattgacagtgagctttgagtcaaatcaatacagagcaagtaaattaatttgtttctgataaactttcagggcaagaccatcacatgtgttttaaggatgtagataattctagttaatgaggagagttagaacctatttccaacagataaacttcttttgttggaatccattcaaattcccatccctaatgatctatactaaaacttaatactaagccacaccacatcgattaaaagaaatattatgaaaagaatgcataattgcctgagactaagatatcaggtgaaaggagagagctggttgtaataatcttttcacacaaaaccaagtgaatggtaacttttttggttataatcaaatacatctctcttcttaccctcagaatagagggaatgctgtatagtcactaatgctgtccaaacttaagtgcattgggaataaaaggatggggagactaaacaaagccaaagaaataaaataataataataaaataattctgagagcatctgggatattccttaaagaatttataagattcttcaggagatatgggtagcttgccccatccgaaaactccaaaaacagttatttcataggtctaaaacaactaaaactgaatttattttcactgtactattatcttagtatttttcttaattacgcttcatcactatcatcacccaaaagggtcaattattgaggtttcattcaaactaaaaccctgaaaactaaggatggaaagataagaataagcaaaagataagagaaacattcaaatggaaagaagataaaagaaaaataaattagaagaaaaagaaaatactagatagtgactcagagaagtagaggctgaatttggaggaaaataggagaagtaagaaagtaaaggagagagagatgaaggcaagagcaaaaacactagtgacagaaggagttacacacaaagaaaacaaaaggcaaagaggatattttagcagggagatagaaatcctcttacaggatgggactgccagggaaatctctgaaacgggaggcaccatctaggcagcattattcagtaggagaaactgttcaaatttaaccatcgtttggaggacatcaagccctatttttgtgtgatcctgattttccacattaaaacacagaagctcatggagatattccaccccatttacacaatcacgaaatcgtagaaatggtttggtttcttctgtcattgaatttgatccttacaacaccatcgtgaagcagaaattattatccctacttcccatggaggctcagagagagaaactgacttgtccaagattatcttgaacaatgtgagtcccaggtctgcaacttactcggtgtgttgtggaaaagtcacttagcctccataaaaatcatctgtaaagtgaaaataattaataacaagtccacaggttttcacatataaatgggaatatatatacgtacatgtaaaaatacttggtaaaatgaaaaacataatttgtcatatttactaaaactaaaatgttcagtgtaaaaggctacagggagttacatgctgctagtcctttaaactattaggattgaaaatgatggaaaaggagaaggagaagaaggaaaaggaaggaagaaaggaagtaaaaaggaaggaaggagagagggaaagagagaaagagaggaagacaaggaaacagaccaacccagtaacaacggctaacactgtgcattattgtgtgccaggccctgtactaagtctttgctcatttaatcaccatagcaactctaagacgcaggtactattattaccccagtttgcagacagggaacgtgagccttgaagaggtttagtaacttgaccaatttatacagctggttagcgagagagcctggattcaaatccacacaggtacaagtagacactcttcaactcttttttttttttttttttttttttgagacagggtctcactgtcacccaggctggagtgcagtggtgcaatctcagctcactgcaacctctgccaccctggttcaagcagttcttctgcttcaccctccggagtggctgaaattacaggcccgtaccaccacacctgtctaattttgtatttttagtaaagatggggtttcaccatgttggccaggctggtctcaaactcctgacctcaagaaatctgtccacctcagccttccaaagtgctgggattacaggcatgaaccaccacacctggtctctggtactcttcaagtcttatactgcctggatattagtcagctagaaataacagtcctatgagaaagagcgaatatcataaaaatctcactataaaggcaggaataggaaaatattaggcccatcagcacaccagcagctaaaaatattacccccaggcagagatttagcacgtgctattttaacgtccagtggaatgaaggagatctcagtaaatgaaagtaacatcagtcactctaataaggtcaaatggtgctacaagaagagaaaaaacctccatgagattatttcaattgctaatgaaattacaaattagcctttggagctcagttcatctttcctcagcggatagtgagctaataagtaaatgtaaaaagcaattacaaaatttacacagactttaaaaacctccccatgatcaaaaagctagctcagaagtttcaacaaaaacaacagagttttggttagacagaaatcttagtggttgtatagtccataggccaaagcccttcctaaagtgcggacaatccgacctgccttttaaagctgatagattgtccgaagaatatatataaatgccagtgagcacttgaaaagatgctccatcattagggaaatgtgaatcaaaatcacaatgagataccacttcacacccattaggatgactattaccaaagaaatggaaaataacaagtgttggtgagcatgtggagaaattggaacctctgtgtcctgctggtggagatgtcaaatggtgcagccactagagaacacggtatggcagttcctcaaaaaattaaaagtataggccaggtgcggtggctcacacctggaatctcagcactttcggaggcagaggcaggaggatgacgaggtcaggagatcgagaccatcctggctaacacggtgaaaccccgtctctactaaaaatacaaaaaattagtcaggcatggtggtgcgcacctgtagccccagctactcgggaggctgaggcaggagaatggcgtgaacccgggaggtggagcttgcagtgagctgagattgcaccactgcactccagcctgggcgacagagcgagactgtgtctcaaaaaaaaaaaaaaaattaaaagtacaattaccaggtgatccagcaatcccacttttgggtgtataccaaaagaactgacagcagagactccacacagatatttgtatatccatgttcactgcactattatatacaatagtcaaaggtagcagtaacccaactgcccattgttaaatgaatgaataaacaaaatgcagtaaatacattcaaaggaatattattcagcctttaaaaaggagaaaattctggcacatgttacaacatggatgaaccttgaggacgttatgctatggaaataagccagtcacatataatacaagtgaaataagccagtcaaaaaagaataaatactacatgtttctgcttatatgaggtacctagagcagtttatttcatagggacagaaagtcaaatggtgattgcaatgggactggtaggggaatgggaaattattgtccaacaggtgcggagtttcagattgggaagattaagttctagagatggatggtgataatggtcgcacaacaatgtgaagtgtacttactgtcattaaactgtgcacttaaatatagctaaaatggtacattttatgatatatatttttaccacaatagaaaaacaaaaaaaagaaaaagtaaagaagacttctttgtgtaaatatgaaaagaaattaaagcacgttgagtaagaggtgtcccttacctaaggatccaagacaaataacagagtaattttatttacctttttatatacctttatcttctttaaaagtgccttatgtacaaactaaaaaaatttatatcctaaatgatatacgggatttgcttcaaaataatcaactggggcatagaggaagtggggaagtagaaatgaaacaagatttacctgtggtgaatcattgttgacactatgtgatgtgtgcatgaaggttctttatattatttcctccactcttgtattcgtttgaactatgccacaatgaaaaattgtaaatgttgctttatatttaccatatacaacagttttaaacaaaatatcaagccactgaagagcagtgaattctaaaataaggtaaagaaaatttttaaaagaaaatattccttagatgtcatcacttccattggtaggaaaatccatgtcccttttctggacaattacaatgaacagttcacatacactgaagaactgttatttatacaagctttacatgcactgttcacataatactaacaatataccactttacagatgtggaaattcagactcacagaggtaaagtaactggattcacgttaagtgcattttaacccagacagtctggctacaagcccttcagcttaacaagtacatttcttgaattacgagggtatttttttcttctttcctgctagccaatttagacagcctcaacaatcctgagttgccagaattagaaaagcctgattgagaacctatgaaaagaggtattttgttttttaagggatatgatcaatacctttgcctcatctgtcacagtaaatccctgaggagtttcaacattagcttaggtcaatttagttcatttactgagcacctactaagtgtcagaggctgttaaaccttgggcactgtgctaggcactcagattcgcagaggaatataaattattcgattatgaagacagatgcatgcgaatgctcattgcagcactgttcacaataacaaagacatggaattaacataaatgcccattaataacagactggataaagaaaaatgtggtacatacacatcatggaatgctatgcagccacaacaaagaacaagatcatgtcttttgtgggaacatggaagtagctggaggccatgatcctcagcacactaatgcagcaacagaaaaccaaacactgcatgttcttacttataagtaggagctaaatgatgagaacacatggacacatagaagggaacaacacacattgaggcctatcggagggtggaggatgggagagaggagaggatcaggaaaaataactattgggttataactatgcttaatacccgagtgaagaaataatctgtacaacaaacccccatgatatgggtttacctatatatcaaacctgcacatgtaccccagaacctaaaataaaagtttaaaaaggtagtcagtgaactacgacatgatactgtattgaaaactaaaatgtaatcatgaaggtggaatactagaattccctgagaagagtttttataaaggtaaaaaccaacatattaacatgattgtatatttatctggaaataactacatttctcaacgcctatttttctattataaaagtgagtaaaatgaatattgctcctacttaaaagatacattgaattagagactattgcaatataaactgcaaggcctggtatggcatcttggagaagaaaaaatcacaaattccaatttccaaatcaaagaagcaacaaatcacaataaaaaatttaatacttaaggccaggcgcacctgtaatcccagcactttgggaggccgaggtgggtggatcacaaggccaggagattgagaccatcctggccaacacggtgaaaccccacctctactaaaatacaaaaaataagccaggcatggtggtgcgcgcctgtaaccccagctactcgggaggctgaggcaggagaatcacttgacccaggaggcagagattgcagtgagccgagatcacgccactgcactccagtctggtgatggagcgagagtccgtctcaaaaataaaataaaataaatacttaaatgtttctatttttcaacttgcagagtttcaatacaaatgtaaaacatacttaaaataggtgtttctattacattatttgctatcagagagcaataaaaataaaatttgataaaaaaaactgtcaacagaaaatagaggttaacatagtatttattttagaaaccagaaaaccaaaaataaataatttatatcagtcagttcttcctctttcatggtattaatcatcctatgatgaggtgcttggcatctgtgtttgccatggtaaataagctccgcgatggttcagacctatctgcactgtccaaaactctatcttcagcacttaccatacacatagctgccccatacacagccaaggccaatgcatatgtaatgaatggacttgaattcgaatgtcctgtccattcactcatttatctagagagcaacacagtaaagaggcaagagtagggactttggaccaggcattcattcactattttattcattcattcatgcatctatgcaaccaatattcgaggacacctattttgtgccattgttctaggtcctgagacactgcagtgaaaaacaggtgtttccagcctcacagagctcgacagttctgccactagtcttgggaggtcactcagtctgcgtaagttgcctttcagctttttatttttagaaaaatagaatactaataaccaatatggaagattattttaaagaaaacaagtcatatacataatggacctggcacacagtaagtaaacactcaataattaacaatcaaccaaaagcctaaaaacaaaataccaaatataaaatttagaaccagtgacaaatgacattgatttccagagcgaatgcacctagaaaagttcaaagagaaaaaacattgtaataatattaattatgtgttaatagccatattagtatgaatctattctctctacatggtaccaaattttcttcaaaatcccttggcatacaccatcttaagcattaacaatgaaaaaatgtccacagatttctgtactagaggaaaaaatttctatgaaaccagtttggctgacatggagagctttgtgtggacaatgaaggtcatgtagatttgtattgttcttgacatcttctaccaatgagtaaatggaggaaatcatgtcaactgggcttctaaatgatctacagccttggggacacacagcaagcagaggaagacttggtcaggaagtgttttgcaaagatggcttttgcaaggacactaagggaagttgagacacttgcccaagcttgcatagctactcaggggtggggtgagaattcacatccagctcttctgactcgcggtcctttgacccttcatgactactactctgcatgggctatcaccctcctttaaaagttcagagacttagacaagagaagagagattataaaaaatagattccttttataccttttatacctcaatttaaaattctcagaaagggttctaaacactttaaatcccttttacccagaagcttctggtttttgctcagtcttgttaggaattggagtggctgtgatacatctctgagatgctatgaaatagagatgaattgaaatactttcaacatcagcaaatcatctgaggccccataaacaccctgcacagtacattcatggtacatgcaggcctttgtcttactgaaagacaacctatgtcatctgatgttaggagagtcactcacttcagaccactgaaagtttcaaaaaaagagaaaaaaagtcataaaccaagtaaataatcagtgtcatttaccattatatctaccattcccttacgaggccatggtctatggtcttcctttaaaagttctgttgtattctcttgaaaaaaaaataatttgttgaactctactttgttttaagcactgtatgcaactgtttaagtatagcatattgttttatctcttgtcttggacttgatgctatttgttcaaagtcctttacttcctgccactgtgctgtccaatccaatggacactagccaccaagaccatttaaagttaaatttgaattaattaaaattaattacaatttaaaatccaggtcctcaataacactcaccacatttcaggtgttcagttacctcacgtggctagtggctactatatcaggcagtgagcatatagaacatttcggtcatgatagaaagttctattggacagcatcgccatagagcatcaaatccaggacttccagctaagatcagatatgaacagaacgaccaccagaataggtcagactaagttcccaatcttatcgttcctggggttccaagagctaaactacaggtcagagaaaaaaaagcatctaatctatttagaggggttgactagatatcctggtataatccacgatgcccatgaagcaaccaggatgctgattattcactgacactaaattacaaacacaaagtcttagtggatttattgacagagaaagaaagagaggccatagaaagacaaataaataaagacctgaattcaagctgcgtgacttcaggcaaattgtgttacttctctgatcctaaatttcataatctgcaaaatgaaaaagtagattaactctgagtttcctttcacctctgaaattcctggattctaaggctttatatagtttgcataatacccaaggaactgtgcagactgccaagatatataagacaagatgccaaagactttcccattaatgagtagaggaagctgtctagatagggctaaacaatgtaagacgggacattttaagtatcataaaaatggtattaccaatgcatcctacagaagcctcctctttatcttaccagaaaaatatgactggaggtagtggaaacattcacttttctttcattatcaaaaaatatggtaacatagggtaccccacctggcatatatcgggtgtttaataatttttgttgaagaatagtaataagataaaatgataataatattaattatactagcaggcatgtattggaaacctaatatatactaggttctatgcaagacattttccccaggctatcccattctagcatcaaacagctctatgaagaaaacattaaaacattttttatttttttatcactttatagattaaaaaactgcagtgaaagaagttaggtcaccaaaccacagccacacaactaaacagtggcagagctgagatttaaaaccaagacttcccaattctagtgcacatgcttcctccatttccacccattgtctccttaagaaaacttttacttgtcaatcaccagaaaggaccaaagaagactctcaaactttttaggaacccagctaatttcacaaaactgccatttcctatatatttttccagacgacaaaacaacaatgtatctttccagataggccactcagccaaaatattttctagtctagaccaggtggcaatttcagtggagctggaattgagttcatgattgcctgttagtgttccaatgtcctgagacttttgttaattagacacaagacaaagggcattaaaaagaagccaagttaaatttgcatggctgtgggcaaatggcagaaagaagtgggcctttgtttcctacggaactgggcacccactctatcatctacaattattttataattgggttgatattttgtaggatagaagcctgagtaaccctgacatccatatgcctccttatcactgtcatgaagtggaaagcaagggccaattatttgtgttgctcgttttccacaatcttgttttcaaagagacttaacattaaagtcactaaactgtccaaattcaaagtatttccacattctctgcagtgatcacattctgtcacccacacttcctaaaaataccctgctttccatcactcactagaaccacagaggctattagaaggtaataaaatccctcgagggcttctcttttgcacatttgcactttcctctgatcaattagattcagggagattggaagtgggaaataaaagaaataaaattcaggccacaaatccttctcataatcccacaagtagcactgacaaacaacaactggcaaggaaagagctcaaccctggaagactctcctgctctaaactcaattattatccaaaattcatcattaaatgattactcataaaatccttctatctacttctcatcaagaaatatcatcatggaaatatcaatgatggtcctatcttatctcagggtacatgtcagtattagtatcactgagataaaaacagatctgaatatgtttagggtagacaacatcctttggtccagaaagtttctttcaaataatctgatttacaaaagacactccatttaaaaatttttcagaaatggcaagatccttctctcagtgcctgcctcccatctgagcccttaatttagaaatctgagggcttaaaaggaccatgcctttcataatgatcttttacaaacattccttccttttctagtgcgtctttgtcttgttgtcccttgtatatattcctcactctgctaacatgtagtaaacccagacggattaagaaaactaaggttcaaaaatgttaaagatcaactgggcacggtggtgcatacctatactcccagctactcagaaggctaaagcaggaggttcacttgagcccaagagttcaagaccagtctggccaatacaatgagaccccatctcaaaaaaaaaaaaaaaaaaaaaaaaaagccaaagattatttttcacgacggggatttcggcgagaaacatcgacaccctcagcgttgaccagatgggcagtcctgcactgacaaacccactgagttaatgtagaatatgtcagctagctcaatgctaagagaccagtaatatctgtggcccagtctcttccagagaagaaatcaagccactcctctctctggcaagtatgtctcctctcataaaacaggctgacttcagaagtagctttcaaagacaatgcttagatcaagccaatcagcgtaagtactcttcctggttgggtgatagctctcactgtgacttcatataagaaaagccagtggtcttgtcttgctcttcaagaatggagcagtcacggctgggcactgtggctcacccctgtaatctcagcagtatgggaggctgaggcggaaggatggcttgagcctaggaattcaagaccaccctgggcaacatagtgagaccccatctctagaaaaaacaaaaaaattatacaggcatcatggcacccacctgtagtcccagctacttgggaggctgaggtgggaggatagcttgagcctaggagttcaaggttaaagtgagctatgattgcaccactgcactccagcctggtcaacagagcaataccctgactttatttaaaaaaaaaaaaaatagaatggagcaatcttaaccctaaaataacaaccttttgccagtaccaccatatgataccatatgtgaaagatttattcaggtacctgagcttcacaagtaacaaggctggcatctattctcttctccaaaaggcattgtttcctcctttacaactaaataaacagtgcaaattatgtcctcaactttaagtcaggtttgaaaagaaaaaataaaaacaaacgaatgcaaagcaagagactatataaggatgaagggacagcacaggagaatggaggagagaatgggcataggagaaaggtgaggggaagggggagaggggtgaggaacagtgaacttggtaagtctgctatttccaaaaccatgtttactgcagtaagataatgaatgaggaaaacattttcattttcttttctgacagcttgagcataaatgatagctgcaataatatcagaaattattgggcattttgaggagtcttgctagtgagaagccagcattccagccaatttgaagctctggccccaaggtgacctagaaattttgtttttcaaatgcaggaatgtcagctgctggactgaaagtgatgtatactgtctagtggacagcatgctggccagacaccaaatttggagtgtctctccctgtactcagttgttctttacggccagtgctgcccccacaaaggagagttttgtctaaagccgaccaaaaacgggggtagtgtttaagatccatcaacaccaaataacactgagttttgacttgtcacctctacagattcttcaagaagctgatctgaatccaacacctcttggagttagttgggtctcttcttcctaaggcagttgattactactagttctaatctagttaggggcctgactgaaggaggcctaaaaagtgccaggaataaaagcagtcaagcctcataattttatgtgtttttaaacaagacaccctcaagtacataaaacaccacagccattgtaatttaatcatctgcttatgaaaaagacagcactctaaacagaagaactgataaggcaaataatttgcctataaggatttttaaaatgtgtctctgacatcaaatgaactctactgagattccctgtattatgccaaaaacctactggccaacatccaagactgacttgcaagtaccaaccctaatccggatcatgaagcaacattaccatcacctgtacccttcaatagggtgatatccactctaccttaacaatcagagttttatccgctgtacattttttccataagattcctatggacttctccatggaaaacagatccctggaatctttctgtgatttggaggaactcctgtaatttgtatgaggatagtgataacgagagaaacatcaaacacacacaagaaatttacacatcccagcttttctgtgtattccactttggaaaccaatagcctatgaagataaaatggaaacagcacatacatatcttgagtgtgtgtaaatcatcagagtcatatgcaataagtaaacaggaggtgtcatgaggagggaaaacaccacgaatattcccagttcagaacacactttcaagaacgatgcttcaatagtgaagtagaaggggaaatgggcatgagtcaatagaacagcaatttctctatcctttctctccactgttactaagcaatgtcctattggaactgaactttttttctaagtcttcgattgacttcctaattaataagcattgtaatctagtgtttattcctttatgaaggcagagcagttgaaatatcctaacacacatattcaaccaacacccctctccaattattgtgttgttcttcacattgaaatttggcctctactgagaagatattgaatggaaagcccatataagatagaaaaaatagaagcataatggacacacgaaatatgtgatgtcacgatctatgtctacacacagataaagaccatttgacctgataactagcaaatgataagcaaggacgctgtgtctctttatacattatctgatattatttatatattgttatttctatcacaaagaaaaacaaaaaacatatgctcagagaatacaagaatagacagacaatccataggtaagcattaagagtaaaatgtactgaaaggagttactttttccaataatgccttatcaagaaaatctttctttgacaagtaagttatatgtggtcactaataataagcaaaaagctaataaaagaagggaaaaatgagtagcacaagcagttcccagcttaatcaacaaaataatcatgctttaaaaaatgaggtagtacattctcttcctgaaatcattacagtctgttaacttaaaagtaaaattaatggcgattcgatgctatacaacactgtgtagagtaaacccaaaattaccaatatgaggctcaggtacactaaacagtcaaataactatttctgaaagccctgtcttcttattttttctttttttgttctcataataactgactgaatgacacacactagttgctgcatatttagtttatttctaatgaagataactattaggtgtccaatctactcagtccttaatcttttaaagggaaacagagagggaatacaattgtttagcctaacggaaatagcttactactataattttccaaccaaaagtctaactcttcacattgtatacacccataagatagaattcaaaattctcacagcttgcatattacaatactcagagtcttaccaaacacaaaatattatgacttatttgaaaccaccgaactccccccaaaatatttcttctcaaaaccaactctaaatagaatagacaggtatccagttatttcaattaacttaaaaatacaatactaataatttaaactcaagtagattattttcctgatttatgcagttggaatgctttaagactaacatagaaagctaagttctgatttatctttcccatcatactgttttatctcagacacatataaatgcattcataggtacacagtatagtactgttcgcccaggctagagaataaaacagctagcattgtaccaggacgcctgtgcatctttccattaaagccatagcaatattccctcaaacacatattcatcactaccttttaatgattctgggctacacggatgaaaagttttgatttagtgcaggttaaagtagcacatagtctttcatctttattcataatcagctctgatccccttgctgaaaaagaaagaaatgcaaacatcttgaactcttcaatgggcttttctctaattaaagcctttaacaattttggggtgtttcaaagcatgacttcctttttaccattgttagtgttaactaaagaaatattgcccaataagcactccagataatatactcaaaaaatcatctataaaatgcaataaaaatgattggggcagaagaacactgcatccttaattttagtaagattgttgatgataaccagagtgaagctgcctaagcaatcactcaaaagcacatgtaatagttaaacgcatctttattatggttgctcagtgtctaaaagtttgttgccagtagcattgctattaaatgtataaggctgtcaaatctatttgtggccaaaaaaaagcaactctgcaagataaatattatttaatgatttaataggcatacggcactagaatataaatacccataaataccccaagtcataaaagtaacagaaagtaaaaaataatttaggctaagacaaaaaaagactagaattgtttagtcaagaacgaaattagtaaaccacatacatttacacagacacagtctctcttgccacaaaattgcaaagtggtctacttttatttctaaaatgtgatatgcttatatcattattataacctaaatgtttaaagggggtataagaaaaagcttctaaaattattacggatgctactaaatcatgtgtataacaaccaaaatatctggaatgcccaaacgtgctgtcattgctcaggacagaataatctattcaaaaccagcagggaacacgtgaggaggcctcatttacttcagtgtgtttccccacatatgcatcatttgagaatgtcagatcactttcacgtatatagtacataatcactgatgatctgggaaatccacaaggccacaaagttgatacatactctgatctagagggggaaaaaaatcgagaaagccggaagtttcccgttttccaagaaactgaagacattcttacctttctgtacaccagcatgttgggtgattcatcggccaccccgttgctggtctgcccataattattcccctgggccatgtcacccaaaacttggtccactctcaagatacaagaattatcagtgtgccctgcaaagggtcagagagacttcagtgagatcccagtgggactcccctgattcatcatcatcattcacagcacccaccccacatggcgcgttcttacaaactggggctggctggagaaagtgacacaggacatggattttttaaaaagtgagttgacacctacaataacctcaaggaattgtaagaaattacaatcttccaggtagaaatagccatttggttattgttttagctgacttcattttctggatactcattttgagaagtgtttgatgctcaccctaaaaactcgtgggtagcattttcctagtacagagttctcttctctcccaatacttgcatctgaacttggtgatgttttccccaaagggtggaaaggcaacacctgggggatgcggtgggggagtggggggcgggttagcacactttctcctaggtatctgtctagtgtccccacctgcagcccatcagagaggcccattcccggtgtcattctccagcgcacgggcttcctctctattcccccgggtctcccacacagagccggagtatatgcttcgcctactttcacctgcctgcgctgccagccaccggctgctctcctttctccccacttcgcttcggaagtccggaggtaatcctgcctaatttttgcaagaagacaccagaatatgtcccggcaacaagaactagtgggaggtcaagccttcaggccattttacccgggtcaccgtgggtaaaagcctaactgcagaagcctccagagcaaccagccaaagaggagaaaacaggcaagcccctgctccccttgctcgctctcacggcagcagcaaatggcaggcgagcctgtgccccgcgccgcggcggccgccggagccgggcagcagtttcagcaccgtggaccgcggggtgcgcgcggcgcccgtagcccagccccggcgcggggctcccgggggcggccgccctgcgcccgcggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggtagcttcatcacactcgcggcggatgcggattccgcgccgccccggctctagctgctcaggcgaccgccaccctcgcctcgccgccgcccgtgcacaggcggctccggcagccgccactcgcgcccgctcccctgggccgcctcgctggctctctccctcctccgcttcttctcccggggact

SEQ ID NO: 2571 - DNA, 228263 bp, Homo sapiens
atgtccagagacaacttctaagtttctctttatttcttttggaaacaacctccattcttcatctctcaatgtagtcctggcctagtgaaaaagaaggcttttctttctggcctccagagactgcttcctttgtaggaaaaggaacaataaacacttcccattaggtttctgtctccagataccaatcagggaatgactggccaggactggaacttaacggccttgagaacatgtgggatttgtctttgagccccattggcttgtgatgttttcctctgtcctccctgagacagttgctcctgtcctggggggctctgcctccacctcccagtccaggatgtctgaggtggttgcaggctgcttgctgcccagtttccagtctgttctggtccagggaagcaccaccccatggcccttgctgcttctggcaggggtcctcaagagctcaccatgtcccagtgctggctcatgagtgaggactcacatgggttgacgacgatttccttgccgttctcggtgccatcaccgaacatatctgtatcgaggcagaggtgggatgctatgtgctcgatgtgggaaccagttttggtccattgctggtaagacaaagaagagagtgaatgaactaggtgccatcagtaacatgggagttccagctttatcagaaaggtaggtgcctcatgtctagggtcactgagagacttgatttcatggtttcataagcactaaaactgcaactaattgctctaccaggtattattgttggtttctttttttaaattggattaaaaaaagttaaaagcaaaatcaatatgtttactaggaaaactcattaggaggcaataactttccaagcagtagcccagaaaacatgaagcgagttagtcacaggagcaacctaagaaacgatccacactcagcatctgcacgatggcagagaagtggggaagagctgggagcagcgagtgtgatggcaggaggggctgggggcttcttcaaaatgtgtcagcacacgacgggccagagcagagaggcaggtctcatgcagcaggttctcacacttgacctcgcatgacaaaggagggactggacacatcaggggaagcaccccggagagggcactgagcacgttactgccaagagacagtcacagctgccctgtgtagtggacattctcaaccccatttcagagaggaggaaatggacatccagagaggtccaataacctgccatgggtcacacagcctgtaaaccataaaacaggcatttgaatcttgttctctctaacaccaatacccagttggcaagaaactgaatggagacatcactttgctgctagaggaactgggcatgtggtgcatccagaatgctaggaagtttgggggacatactgccagagcccagggccctgaaggcaagggtcaagtcttgctcatccttgtgaccctgagatccttgtttgggatcccacgtggggaacagagcaatgacaggaaagtagaagatgactgggcatggtgtggtcagtggaaatcaataggctttcatggggcaggctgaccagtgagggtggatgttgccattgctgctagcatcacagaggggatcccaggcagcactttccctccctctcctgacctctcttatcaactcttcctcttctaacaatttctctcttttcctgctcatcagactaagccctcaacaggcagtcacattacggagttggccacatcccagggacctgctgagcacttacctgtcggtcatctccattcttgcaaaggacaagaaccactggggcgccagggaacaaggtgatgactgacaggcacagctcctcctggaggatctgctgggtgtatgtgaaggcccatacctggggagaaagagaccaggaaggtttgttcaggatccaggaagccaccactcgtgggatacaaccacacttacgggtgtgattagcacaggctggtaagaagcaccaagggtcccagtaggcaatgatcatcaaggttaccttggaaaatgctactcaagtgccagagactcggaggtcatatctccatggaaatctccatccaccccatgaaggggcctgggcctgggccattcaggctgcctctgggagtcctgaacaattctgggctttgggcaggagtctgaacaacaaccccagctgagctgtgtgctccacagtttttgtttggagaaaacatctcgagggggtctgttcccagcacttgacatttcaagcagccatctagcaggtcaactccccacccctccataccagatatctttagactctcccctgttctttgaaaggcagtccaagtcagtgtccagagcacatgagactagagcacatgagagttatgacaagaggcagatggaaggataaatggaacaagtgttccaagggaatgaataaagaagggtctagggaaagaagaatgttatgaggattcaaattatttcaggagggtgcatgtgccaggataatagatcttttggcccctgagctctttcagggagcgaagctgagaaattggattgacaagcagagttctgttggcatcaggaagaagggcatgctgtgtcattcattatgaggaatgattccaacatttttcctccaaagtaccagagatcacagagtaactggattatgaagccacaagcacttcccagttcttaagtcagtggggcagaaagtactggcataagcgttttctcccccaggttgtaaaataaggtaatatttaccctttgcctccgtctgggggcaaagatgattcctgaattgggtcccctggggaagctgcggaggatcctttgagggctgtatctgtttccaccacatccctgaaacaagttgaccctgagcctctggaccaggttactcattggctacttccccttggcccaagaatgaaaaagtccacttagcaggccagcctcctactctaggacaaggtgtcccccaggcagacatggtggtcatctgtctctcgttctccatcttccctcctggtccctggtcctctcctgacctccatgggctgctgaaagctttaattgttttctgggacctgggtggttcggaggaaccactcccacaggctcaggaccttctgctgtcctgaatacgtccaccttgagtcaacctgacttgctgtacaatgacgcctggctctcttgatctgggactcaccggcctagtgggagaatggctcctgcattaggattcttttatcccttttcaaactgttggtgttgggagaagacctagatcagaaagtactccctggggagagatgcaaatatagatgaaacaagactgtccttgagtcttgttcttaacagcagggcaatgggtacatgggcgttctttatactattcgacttctgtatctatagatatttgaaattttctataataaaaagtcatgagatacattccttgggacatatcaagaagttcttctctggccttgtgaccatcacattctacacatcccatttgcctttctccaagataagctgaaaggggaaacaagtctgtccgcacagaggtggtgcaatgaccaggctgctgctgctgctgctgctaataagagctgacatttattgagcgcttatgatgtgcccagcattatcctgacaactttacacagattgattaattttcataagaatcctattaagtaggtattactattatcctcattttatagatgatgaaaccaaggctcggagaggctatccaaagtcatacaccagcaagtggcccccacaccaactttctccagcagctctgctcttgttgatgctggagagttagggccggctctgagctcttttagataaccttaatccggggagaagacacctgcccctgagattcttcttccaggttgtagacattaaaaccaaagatcagctccaccttgacaggggagagtggcaagagattcttcttcttggccagttcccaatgacaacctttatgaaaagatgaacaaaggttgtacccccttgccaaggtctggggtggggcaggccagagaatagtgccctctctaatagagtaattcggccatgagtatgaatggaggcccacactcctgattctacaccaaaccataggatacacacagtgctggcttctagcctgagccgccccgcctttttcttcccctaccttggctgcatatccaagctgagtcattcccctctaaatggtctcccttggacctggggatgtgtactagagacacagtccaccctcggaggacaaacccagggatgagacccacgcagggttttgaattaggctggggccatttgggtgggggattctgaagtcctaaatatccagaatgtgatctagaaggtgggcctagaatattccttggcctgtggggaggagagagaagggccaaaaggtcaaatgcaacagctggactaccaggaagccatatgccctgagatcagtacaagggaaagactaagttcattccttctgacccattacctgactatagagtctgtagggaaccacaaattagtatttcaaaaatgaatcctgccattatcttacaatcaccatcatacaatgacattgtgttttttgtgttaaaagcattaactgattaaatataaaagcctcttttgagagcccactttggcatttcttcttttttaatatcctaggggtcccaaaactggaagtgctggatgggtgggtgggtgggcagttattttgacatcctctacccttgttgtccacagatgcctttcaggaagaaatgcatttgggcatctggtgtgtccccaggccgggacttgatgaaaacatctcaaagacccccaaggagaatgtgtgaacaggcacagctaatgaagccctcatgctaagtggactttccattagctggtatttcctggcatttcaataacttagcctcgtcatgtcccagaggaaggctgatgtctggccacatctgaaagaggagaggagggaggagaagcaggaaacaggagcatacaggtgggaagcaaggagagcattttcggatttccattctgcagcctgtcagacttcccagaagggccatgatgaatgagtttattaaaagaatcctgcagtcagaaacagactccaggaaggcagcagaggttgctcagcaggtctggcctggattcgctgagtgctgggccctctgctggtggcttcgtttgggggcctggcaaaagcctagcccatgatggaggtcctgtggcaggccaggtctccctaacagctgaacaggcaggcctctaagacaactttcagccctgactgagtgggtaagttaaatgttaaaggctgaaagggccagtgcccttttacaaaagcttatatgtaacaaaagcccaccaagagtttgtctaggcttttcctgggccttgaagcatgacaagataatgaaggaattcttaacaggacctgtttaggattaaacaagttttatcaggggtctgaagaaactccccagacctccacaaacaagttttattggggtctgaaggaactccccaaacctccatgatttagcaggagacaagataagagtaatcaccccagcacctggacccatctagattaagtaaatttactgaggctccaggagaaggtcttcaggactcagaccttagttatagattagaagaagttaatcacttatgtctttagatgaatgcacactcacacgtagacaaacagcttagaaggtatataagctctgaaaaactttgtaattttgagttggtctggtgataatttccaggttttctctctgtgcccggttacagaaataaactctcttctttcccagttcatctgcatctcattattgggccatgagaataagcagctcaaccctcggtttggtccgggaaccgtccctcctatcccaaagctgtagccatggaagggcaacccagagactgtccttagttggtgtgggtgaccctgccccctccactgggataggccagctgggggctgaggaggaggggagtcaccaatgaatgaggaggggatcgactgggtcagacagccttaaaaccttctgtgcttggaggacacgtctggagatggccactgctggtgggagcagggaggggacaggcaggggtcagtaaccttctctagcagatgccagtctggccatagctgtggaagctgggatgcagacgggccacagcacccagcctggggcttgtggtcttgcacaggatggcgaagcagggatgaaagattgtcttaagaggtaactaaaagagggtcaggcgcggtggctcttgcctgtaatcccagcactttgggaggctgagatgggtggatcacgaggtcaggagtttgagaccagcctggccaatatggtgaaaccccatctctaccaaatatacaaaaattagccaggtgtggtggcacatgcctgtaatcccagctactcaggaggctgaagaaggagaattgctggagcctgggagacagaggttgcagtgagctgagatcatgccattgcactccagcctgggcaaaagagtaagactccgtctcaaaaaaaaaaaaaaaaaaaaaaaaaaaaagaggcaggagtgaggacgagcctgggcccaggcagaggagctgctcttggaatggcccagggcccctgcctctggtaggcaagaaacaatcagcctggagcagcggctctcgactctccccactcagcggacctctggcagtgtctgcagacatttttggttctatggctgggtgaaggagtgtttctagccaccagtgggtggggtcatggatgctgctaaacatcccatgctgcacaggacaacccctcaacaaagaaggatctggccctattaccagtagtgctgagggttagaagccctagtctcacctgaagggcttgggctctgcaggtggcaggcctgtatctgaaccatgccctggcattactcacataccacctgggcagtctctccaagcctcccttaccccatctgtcaatactctctccaggaggggtgacaccaccaggcatgggcaggacagcactgctggttttgttgtagttagacagccaaagtgacaactgcttgtaagagactctttcaagggccaggcctggtgctagttgcttcacattcattgtctatttaattctcataaccactacggttcccgttttgtagaagaggaaactgaggatcaaaggggccaatggttactctggcaatgccagaagcagaccccagggttgattctgaacttggcctctccttggtgaggtgagacctgagccaagtatccagggccttgaacatcttagtccatactgggtacctccacggtccctgagacatagccttgaagctctcccttcaaacaaggcatctagaatggatgagcctgaattcaaatgaactgccctcgtgatgcctctggctctctgaagcatcagctgcagtgattgtaccaactgtgacaacagcacaagtgagctgatggctgtgctggggtctgcctcagtccctccctggtggaggctttttctccagaggcagcaggatgacctggtgggctcctagacacacctccttccattggaaactttgatgaacccacttttggggtcttttctttatttccagcccattctgtcctttcctcccatgtggcaagattacacttatatgtgtgattaaagcccacactcagtacatcttcgctgggtcatgttgttggatcctggggtgataccagggctagaatccccacagagctgcctattaacctgtgaatttgagcgagttactcaactctgtaccacagttcccttgcatgtaaaatgaggatgacatcagtctctaagagggtcactgcaaggaacaaatgggttaatacctatcccagagtggtgctttccattagcaaatgctcaattgctgtctgctgtgttcacgatggtgaccagggggagccaacaagaagagagaggaccttacagaccttcctttggaatcctgcccaggagctatactggaggcagggatggagccattcccaagactgtgttgacaaagcacaggaaggaagggtggcatcgggcagggagggtggcattgggcagggaggatggcatcgggcagggagggtggcatcaggcagggaggatggcatcgggcagggagggtggcatcgggcagggaggggggtatcaggcagggagggtggcatcaggcagggagggtggcatcgggcagggagggtggcattgggcagggagggtggtgtgtgggctgggagggtggcatcgggcagggaaggtggcatcaggcggggaaggtggcatcaggcagggagggtggcatcgggcagggagggtggtgtgcaggcagcctgtcccaccggcagactcaggctcacacacctcgaggcaccagtgccagtccagattagggggagactttatcttcacctgcccacccagggtacccaccttgcatgctccacagccagtagcccacacactgggagacaggtaaaaggacgagctaaaaatatatcttatgtttttcccctttctttaaattgggatggaaactagattggtgcacctgtattctttctacctttcacaaatatttttctagagtccaataaagttaagaggaaacttgttaaccttctcgggcttcacatgtttacaaacggatgatgtatttctctcgcatttcacctaaggcatcagttttctgacatcttcaatacacactcagattaaatattttgctcccaaggttgacaagtcagccaagagaggaagggaaggcaggtgaggaatggataggactgggggtggagcagcatcgggagccagtgtcagaaccagaggacaaaacagtctcctttcaacaacgaggacgccccagagcctggggctcacctgcctgcagagactgtgggcagctaaagctgaactcagcccttggctcccattctctggtgcttttactccacagttgaggaccctagagtctccagggcaaaaggaccaagccttatttaaaaacctatgtagatctcatccctgggttcatacatggtcctgtatccccagccagttactttacctgcggctttgcttcttcgcctttgagcgtgtcctctgagggtagactatatccctagtacacagccctaggcccaagggggaccatttagttgggagtgacccagcttggatatgcagccagggtgtgaagaaatggggacaggcaagacaggaagccagcatggtatgtgtcccacattctggtgtggaattgggagtaggagcctccattcatgctcttgtcccaatgcccataacataagggaggggactactctctggcatggtcctccacccgagaccttgacatgggggtacaaccttcgttcatcttttcataaagattgtcctttgaaactggccaagaagaagaatctcttgccactctcccctgtcaaggtggagctgatttatggttttaatgtttacaacctagaagaggaatttcaggggcaggtgtcttctcacctgattacacttgtctaaaagagctcagagccagccctgactctccagcatcagcaagagcagagctatgatatgcggccagattctccaaatccatcttcaccgttattggtaggatatgactttgggtaacctctccaagacttggtttcattgttttggcctcggcctgtatctgtacgatgggataatagcaacatctacttaacaggcttttatgtcacttccctgatatggcctctcagaggcaaaagaagtgggagcagagaagactgaacaaaccatgtttaggggtttgaggggcagatgtgactccctctggacaggccaagaggcaggacaagtaggaggacagaggtaggaagaggtgatgggggcaaagcagccataagaggagagaatgtgacaaagcccagtgttagcagaaggggttgggaagtgggaaaacaggacatttacatgggaaggaggagcggacactgaaaagaagagaaaggccatataagtcagtcctatgagagtgtatgctacacacacacacacacacacacacacacacacataggcacacatactcagggagattatcttagctggcatggtcatgtggatttctttcagtcccatgtgggtttaacacctccagattacttggaaatgtatccaagtcgtgccgtaggccctggagggcaggggctctgtctcacccagcatcaggccaccttgcatcccagcaggaatggtccctgggccgtggtacagtctgtgaagtggactgagcgtcatcctgtctaggagtattctcccagcaccccacattcacactgtggtgacaccaacccagttgttctctccaaggcagagaggaggggcatctcagtaccatcttccagagaagatgctttactcacccacaggccatgcccaggatgagtgtgagttgcccccagatgactgctgtccctcccctttttcacatgacaggaaggtcagctgggatgggcactattaccttctggtcaaataaaggcctgacaactctcctcagggccagagcattgcagggcccctctcggaggcccacagagacctggctcctcttctcccacttctttatgcagccaaaggtgtcaggtaccagaaaagtcccctgttctgctggaaacagaccaagcacactcctgccccagggaaagggggaagacaacactctggctgctgcccaccagcactgcccacacacagattcagaagacagggatgtgtgtcccctactcacaacattttgcaaaatgccacttgagcaaattatgtcattctcatccaggcagtcacgccttaagcaaaatcaacacctcaatttcctttcccttttcctgtctgattcaagcagctccctcccctgccctactggagtagagatatgattcctggaaaagccaccgcaagctggagctgggttgagatgcctcaagtaccaaggccaagagtctggcttttgtgatagacaataggagccatcgatgtctgtgctgagactgggaacaatgggttaatgaccacattcaatgtcagggtaggggcagggctgcagccagggcaggagaagcaagtggaggcttttgctgtaatctaacccagtggctcccaactggcataggtttgtccctcagggggcatttggtcatgtgtgagacacttttgatggccgtgacttgtgttgagttgtgtggtggggaggtgctgctggcaagagtgggcagaggctagggatgctgctagacttcccacaatacacaggggagcccctacaacaaagaaacgtccagctcaaatgtcaagagtgctgagattaaggaatgctgatctagcatgaagaagtgaacatgggatctaagagcaacccttctgagatatgagacaatgaggggtgcaggagaaagaagagccacagaagctggaccaggctggaactgagggtcatgggagaagggggtcacatggagagagctagtgggacaagcaggcagccagggtgcctgatagatgctcatggctatctgttgtcttgagtcacaagtgagttcattgtgggcatggactcactcaatcagccagtgttgagaaagtccaggtaggagatctacacctgcagatctgcaattcccaaccctctcctgagatctcatagcatcctgttccccaggacaaaaagcaacctcttcagcacctgcaaatctgcaattcccaaccctctcctgagatctcatagcatcctgtttcccagaacaaaacataacctcttcagcacaggaagagagaccaggattcagctcctgctttctgtccagcctcaccgtctgctgctccttcccctcacatcccactctccaaccctactctcccactgtcctgcaaaggcagcatcctcactagcacccttgctcagctccaggtctttcctgggccaccctttcttcccttcccaacttggcctatttctactcatctctgagaatacaactcatttccaagtccggttggaaatcttccctgagcctcacacctaacttggatgccatctcttgcaacttctatggtatcctggacaaaactccatccaggacagagattacatcatactactttctagcttatttttacattaggccctttgaggggcccttcaggcctgcaacctagtctttcatctctgcatcttcatagttaataaagaagtatctgttgaatgaataaatgaattcatggatagatgaagataaggaatttgtgaatcaataaacaggaaactgtcaaagctggaagcatgaaaaaatctccaagaaatcgtttgtagagaaaagaacagtgagctgggaaccttgatgaatacccgccagaagggtatgagagtgggggtgaggagttagcaaggaagccatagacaaacgtgcctttttttttttttttttttttttgaaatggagtttcactattgttgcctgggctggagtgcaatggtgtgatctcggctcactgcaacctccgcctccagggttcaagcgattctcctgcctcagccccctgagtagctgggattacaggcgcatgccaccctgcccggctaattttttgtatttttagtagagacagggtttcaccatgtttgccaggctggtcttgaactccggaccttaggtgatccacccaccttgaccttccaaagtgctgggattacaggcgtgagccaccgtactttaacgcagtcagcaggccaagtgctatgagacaggctatgaatttgtcagtgacctttaaaacaacagttctagcctcagatgggagaagactgtcccaaaaaacatggcagggagggggagatactttgttgatcaatcaagtaaagcacaggaaacctttcagagaagggaccacaaggggtcctgcagacttaggagaggcaggagatgcagaggtgaagctggggatgaagaaggatgctgcccagagacagggtggcagacagagagggttttaccaaatctgatgtgactacctgccagtcagagctaaatcagctgggagactcacagagcaggcattccgtcctgtcccagaaggcagtgtcacccagcggcagtcttctccctctttgcatttcacatctgcgagctagctgtgccattggccttgcctgaccctgcccacggttgctgccagcaggtaggacaccaactacaacaaactcattaagctcctgctaacttaatgggcaatttcctataggcaggatgctgcctattaaactgtctttcagaggaactctatgcacttggaaagcaagcagtgtaagcacagtggcagagtggggggatcacacctctcatgctccactaccgatctctgggaataaatgggcatctgatgtcatgtaagagcaggtgatggaggcagagtcatctggctgcctccctctactgtgacacatggtcctgtatgcccagccagttactttacctgggactttgcatcttcgcctttgaccttggcacaggggctcaactttaggtttggggtttcttggttgttctgcctttgagattccaggcacttctgtctctgtcggatattgcccttctggatggaggactccttggggatgctggaggagagtcacagggagagaggagagtccactgctcattggattagcaagactaccagctggagagggtgggcagtgttctgagaatggcagggctgggctgttagaaaatatctgcactgctcggggaagggcagggtgccactaagaatgaggtggcaaggaaagacccaggagctacagagggagatgagtacctgcagtgaagctggtgtcagtgagtctgtaagtcagggctcaaacccaagcaggtgagaaatactgctactggctaactgtaatccttcatgctattgattcagtataaggtccctccgggttttaggggtgaacggagccaactggtcttcttacacctctgatatacataaaagccctcatccagttggtcattgtctgtctcttctccagaccaagccagctgagggcctctgctttcagccagccaaagctccaacaggtaggacggatacctgagttcagggtagatattctccaggtaccacttgaagctctggcagcgcagattcttcctcaggtccaatctgctctcaacactgggggcaacggggttgtggacagacacaaagacaaaacacagctgtcagaggcaggcgccagcaacgccagtccagactgagaacacaaagcgcgacccatgcccatgctctgtgctcacatctctctggaaggtgctggggaaattaagcaagaacagatttctataactgcagacagagctatggaaacacttagcaatatctcacaatggtgcggtaatgacagcgaggactggtgcttttacttgaagatggaatttgggggtgtttttacttttcattcaaaacaaagctgcaagaacattcagtgtgttgttaataatttaccgctggggctctgggcctgcttattcacaatttctctttggattctgcagccgaaacaccactccccgctgccccagtctcaaaaaatccttttatttggctgtttctggggcctggtcatgtatttgttcattagatattcattgagcacctactatgtgtcaggcattgtacccaatgtgggatactatggaaagcttttgaacaataggcaaagataatgaaataagccatcacagcccaggtgacataggatgagcaggagggacctatgggaacaactcagagggggacccttgcttgtcgggtccatggtggtcaaggtagtaatggtgatgctggtatctggaaggaaaaggggacattatctagacaaaccagaggtaggggcccctgctagaggcagtggggagagcaagatgaggacatgtgaagacatgaaagaagctctgcgggcaggaagagtgctgcaggatcttaaaatagatgtgtatgtgaatgtatgggtggtgatttggaagagcagaaatgggtgagttgaaagcaaagacagaccataaagggtcccgtgaggcactgccaaggagtttggacttgtttaaagggcactgggatgaaactgatgggttctaagcagggcaagaggtggtttgtactttgagagcatttcagtgctggtccacaaatgggtctgatgggcaaagctggggccagggagggtagtgaggaggcagctgtggaaactcaggtgctgatcatgctttcaaacagggaagtgggggtgggaatgaagaacaacaggctgagtgcctccacacctctcggcacccacctaagttcatccatgtctttttcttcctgggcaaacacatagagctggccttgcttcctgtccaactcacttccttccactccccacctcaagattgcactataacttcttcttacagagcaccaaccacagctcatcaccagactctaagctccatcaggatgggaaggatgtcaggtttctaaaatgctgaatattgggtgtttagcaagggcctgtgtgctcagtgcatgatggtgcagtgttaccaagacttggtgatcatttggatgggaaagagaaggggagggattcaaggatgggaaagagaaggagagggattcaaggttgacacctagatttctgacttgggcaacaggtgcaacgaaaactcttcacggggatgggaaatatcagatgaggagtaagtttaggagcgaacgtcatgagttcagtttaggatttgttgagttggaggtaccagggagacatcctggtggaggtgtctagttgataattggatagaagggattggaactcaaaggataggtttagcttagaaatagagatgcaaatatcagcagcatagatatagtgcttaatgccagagagaatatgtagtaagaagaggctttttaacggaccctccggcaagaccatcatgcaaggagtaggaagaggaaacagcctgcaaatgggaccaagcaagcagtgcctagcagcagaagaaacgccatgcctgcagagttctggaagcctagggactgggggacaccagaggggccgggggtgggagaagactcatgctgatggggcagcgaaagaggacagtccagggtgcaaggaagtcacgagggagccaggtgggagcagtctcagggcttgggggccaggagaaaggaggggagtggagagaggaaagcagaccactgcttcatgaagctgggcactggaggaatggaaaagacagagcatggattatgagcaatgttggactgaaggagggtttttgtagtttgttttctttcctccccttcctatttttttttcttaagatgtaagacactgaataagtttaaatgatgatgggaataatgcagcagaggagagaccggggatcagggagagaatggaggcacccggagggcaaagccccctaaggagtgtggttcccaaacttgtccccatgttagaatcacctggtgtggggtctttagaaaaattctacagcccaggccacaccccagagcaagtaaaccaactctctagaggaggggcacagactgcagtcagtttgaaactccccagggaactctgatatgcagactagtttgggaatctccttggtagaaccttgctcctcaaattgtggcactcaagcaggcagcattgcatcacctgcagcttattagaaatacagacctccagagtcagaattttcattttaacaagatccccaggaaatctgcgtgcacattaatgtctgagaggccctgcgccaggaggcaagaggagatgaatccaggcagtgggaactcgataaatgttgatttatgaatgaatgcagcgatgaatggttcatccagagtacaggtggagggatggagaccacagcaggaagcacagcctgtcctttgagacaagagacagagaaggatgctgcagaagcagtgaagttaatgggttggtttgttttgggaagttgatgtcatctatttcatctgtaaaacagaaggtgtcatctgctgccagcgaaagaggggggtggactaggggctgggaagagtggaggtttaatgaagatcgagggagaacgctagctaggagaggcagcagggccagtgggcagactgcaggccttgctgagactgacgaccacggtgtattattagtagcaccagctggcattcccagttctgttcagcagcctgtgtgcacaggaggacagggtgcaaagtcagattcatccaaggttgaacctggatgaactgtggggatggtgttgctagatggagaacagcacagaaggtctgaggacaagaccttttgagctcagtttttaaaagagtagaatccaagctagagagggaaggcagtgagggggatgtggttgatatggccaacagattggaagttctgatgaggactgaaaatgaatgccttggaggtttggagtgagagaacctgaggggcagcatggatttatggtttcagagatgcaaatcattttggtgggttctgatttaatcctcccactcagtgatgggatcaacctatgaatttaggctgcaaaaaacccatctgctcaacagccttcgtatgatgagtgggtgatgttagtatgacaaaaagccattggttgcccccaaagaaacataaatgatagcattagtgaagttgctatttttctctaatcagccctgggttggggaatacaaggtcattccaagttttgaaatcagacaggtgtggtttgagccaccatcccccctctgccatggtgtcatctagggcaagaagcttaacctgtagaagcctcagtctcctcatctgtaaaccaggagtcattacgcccattcctcagagttgggaggattaatgagatgccttatgtaatggtatctagcttttatttatttatttatttttaattaattaactaatttttttgagatggggtctcgctctgtcacccaggctggagtgcagtggcgtgatctcggctcactgcaacctccgcctcccaggttcaagcgattctcctgcctcagcctcccgaatagctgggactacaggtgcccgccaccatgcccagctaatttttgtatttttagtagagttggggtttcaccatattggccaggcgggtctcagactcctgaccttgtgattcacccacctcggcctcccaaagtgctgggattacaggtgtgagccaccacgccaagcctggtatctagcttttaataaacattcctttctctgtcctctcctcccatgaaacttgagcactgctgtagaggacacatctatacacatgctgttcctccaaggaaggagagagcttaggcttggatgacctagaacttggagggaagaagtcccacctagaaggactaaggctgtctagtcctgcctccttcctgtctgcaaaaagcaggaaatattggtccactgcacaaggcacagctcagctcccctagagctggcagtccaggttgccaggcagtcattccacaagagctgcctaaagccctgcacatccagagctgggcaggagctctgaggaataggaaagaagccacagccttgggccctgcgggagctgagggtagctaagctgactggcctatcggcacccatttgcatcggtcctaggagctgggctcttttgcagtctctgccctcctcaacctgaagggacacttacttcccgaagggcctctccagggcgaatggccgggcagcgtaatagtattgcttgtattcatccatccacacttcagctgtccgcttggtgttcctgggaaaacaaggagtgacaaggggtgtcagtaaggggctgtctgagaggccctgtgagtgccagttaaaatacacatgtgtgggctgagttggcaacaccacctaggtgggggccaccatggtcaaccgactatcattcctgttcccagggcactgagcccagccaagccccacccaatctccaaaggggtctttaccccaagacacaagattttagtacaggttgagtatcctttacaagaaatgcttggaatcagaagtgttttggatttggggttttttaaatttggaatatttgcatatacataatgagatatcttggggatgggactcacatctaatctaaacatgaaattcattcatgtttcacatacaccttacacacatagcctgaaggtaatgatatttttcccttggggatgctgaataaactgtgggttgtctacctgcattttgactgcaacccgtcacatgaggtcaggtgtggaatttgccacctgtggcatcatgtgggtgctcagaaagtttcagattttggagcattttggattttagatttttggattagggatgctcacctttagtaacaacaaacctttcccccaaaagatacagaccaggaaaatcatgccagaaactgaacttctgtggctatcaaagaaatagggagaaaaggctcaggaaccctactggcatcccttcactgccagtaaccaagagtgcaaaggcagggcctgcatgggcatctagcttctggctgtcctcgggctcttgctcctgggttctatcctttaccacagtggaagtactcaggtcccagctctccaaggggaaagtgggcacacacaggtcttcccataggccatgcagttagcctgctgcaggtgtaaagaactaagtaatcaggcttctctttccagactttttgctagcactctagtttttaaaatcaggttatctgccctgactctgaccccacgaatcacagaaaaggagacagacagagagacagacactaaggatccctcagccatcaggcgtaccagaaagagccccagaaaagagagaaaagatgtcagaaaagagtcaggtggctggtggcctgggcagcagtggtatctgctgaggccaagtaagggaacttggggcctaactgaaaagggggtgctctttcagatgctagctctgctttagagcagaagcattcaagagaggagcgtggcaagcccttctaagctaggacctgcaatgacagtttatgcacacacagcctggttggtggggcactggaggcagttaacagtgcctccctggccccttccactgacctagccattagcacattggaagctgtttagcagacatctgtgccacaatcttctagaaacggaatgacctaccagtgtcatgcaggatgcccactggccagggcccagtctcaaagacaatgactgtctggagccccaggctctgcccctcatttccaggccggcccccctccaggcggccacatggctcctgcagagccaccacttccctgtgccagacatccccagctcacctttactttttaaaacctgagagctgaggcagccctgcctttgctccccactgcttcctggcctgctgattttcttatcaccctacccttgcccttcacgtttttgtaaaaggtgtggccaattttcccattgctcaaacccatgtctcctcaggacagctgtgttggggtggctgtgtcaggatgtgatgacacagctccccctaccccaatggaccaaatgacagaaaaaaaggaagaggagaccaagtggaggagaagctatcagatgacaagagatagagggtgggggaaagagagagaatcaagaggaaaagatggaaagaggaatattcacgaattattctgaaaggagaagagaaagatcgaaagaggagaaatggaggaaaaaagagtggatgaagggaggaagcagggaacaggcaagtgggcacccttgggtctctgagtcccagtaagaaccaccccccagacaggaggagagcacaccagcagacaggagcccagggtctcaggccctgccccagcctggaccctttgactctgctggccaggccctggagcagggacctaagctgcatcccttgggcctccccattccctgcatctgcccaaagacctctcccctagtgacccagcccgaaggtggggcagtggctcttctagaactccaaagtaaaaagggctgcccttcccccatctcacaaaaccccaaatatctggagcccatgccctgcaggagggcattgatgggtgacttgaagcccacgaggcctcatgtggggccttccgaagcctcagaagcattagggaagcctcaggccctaacactggatgtgacaggcctgccttccctatccaagcagagtctgggtagtacgaggtgcagccccggccagttcaaatcacacaggcagcctaacagagcaccagggacggctgcaacccttaccagcagccgcccagccttggctgcctgtgctgctgcccacccgcgctgagcccctgggcacttactttatatacgtgttggcatttccatcagggaaaacgtaggggtgcttcttccggaagacgtgccccactcggctgcaggggacgatctctaggctgcccccgcacatccacactcggaaggagatttctgcaagacagtcacgcccctcctatgacctcttatcactgctgctgcagctttgaggccccaggtctaatgaaacggtgaggcccccgcagaggcgaaagaacagactctgcagccagtctgtaggctccactggctgagagacctcagtttccccatccataaatgggaatagtcctaccactttggagggtggtataagtgagcagggaaacagtgcaaaccaacacgctggcctctggagcatattcaggggccagcatggcggggcaggggctctgctgcaacttcttagcctggaaaggaggagccttgggggcactaagagagttgccttctaacttgcggaagaattcattgtggaagtctggttagatgcactccctgtgatcccagagggttagagtcaggaccaaggagaaagaaatttcaatcgagaatacgggagaattttctaacaatcagggacaaggtgaccattgtgagaagactcaggacaggctagaaaacttcacggcaaggatgcaacaaaggggactgagtccccagaaggcctcagggcaaggtgtccacaaaagttccttccacagtgaatgcaattctaccactggggaagagccacctgaatcataacccaggaggagaaagtctgtgcagttaactagagctgaaagcagttctagaaaatgctggaagcctcaaagctgttgttgctggtgtcccctaggtttgtacacacacccatttcttcctggttggctgctgctatgggccctcagagaggtgggtgggatggagttagcagaggcggctgtggtgagtgtatttctccccgggactgtaccccagcaggcttgaagtagtgcttctgccctgagaaggaagtggtggcataccaagtggggagggagggaattttaccactgccattggttaaaattgccagtgcatggtgacattcaaaagcagaatgactgtgagtgttatcattgctcttaaattttctacagataatgtaccccctaactgaccacagcgagggcaggctgcttcctgcatcccactgggcctgtcactggtagaaaaggcagctcctcatgtgtaggtattctggtctggctgatgcttctgaagtcgagcccaagcatgtggctgcccatgtgaggagccatggggaagcaggctgggtgttcaggggaagggaacaaggatacaggtattacagggccttcgtatcacatgtgtgtcctgcaccctgctctcattcccctgtccccagccacctttacctgtcacctacctgtctcctcccacgtttccttggaaaggcccctggactgaggtaagacttctttcacactagccctactccaccaccttctctgcacctgcccctctgcctactgctgttcactcccaggaagcctggattcccctcagggtggggaccatgtagactcaaggaggaagagagcacttctcatgactgctactgaatcatggcaataacatgggggaaaggaaacaggaagaatttagcttcacagtcagcaggcccaagtccgcagtaaccagctagctgtatccttgggaaacctgcttaagctcgcggaggcctgatttgctcttatgtcaaacaaatgtcataaaaacactccactggaatgccgtcagcatcaaatcaaatagaattttgagaacaactgtgtaaacgctaagtgtgattgaaagatcagcaggagttattatgagacatccctctaaagccaatctctttaaaacatggacatcacccacctgtgcccccttttaatttcttagatgacttacagatgcttcttcccatcttctgccacactgcaggagacacctgaaatgtgtgcacttcacatttgagatttcgactctccataaagtcccactgtacagagggagttggcatttggctggggcactgtttgaatcgtttttcacatgagtcattgagcaaggagtgagctcagccaactgcctggcacccacatccccatcttgcagtagcacatagaggaacctggaggtcggtgcgtggagttgtgtcagcacgtgtgaatttcagtctcatgtctgtgctccaatcaactcctctccagagactcaaaacagggcctgctccagttcccaaaatggaaaaccctccaattcctcaacactagagatggagtccttgctcgctagatataacttacacatcttgtgccagctttcttctaaagatatgtacgggtttcatctacagtctcttcctttccttgtattcaaatgagacatatgtccctttgcaaagcgaatccctccaacctgggcctctaccccatgccccaccaccgttctccactagctgtttcttttcctatgatccctcctcccagctctttatttctctctgaatctactgacccctcccttctgccacagccatgcacaggtccccagctaggccagcaccattgcctggccctgatccttctctaccttccttctggtctccccatgttcttctcctacatcccctcaacgctctgcctctgagcattttcctgacactgctgtcgcctctgctcccagagttcactctatgctgaggactcacctccatcctaccagccccaactctgccccaagctctggcaccaactttccatgattggctgaggtatctattgagatggacgggacattatcacacccaagacatctcctatgccctcagcatcttcctacagcctgctgtagccctgcctcctctaaagacattcttcctccttctaattttcttatgtctgttgccttagtacaaaaattgagtattgcaattctgcaagcattagccatgggaggaaaatgaccccttcatttacttctgggccaggcaggcagtagctgattagtcctaacaaccctgctccattgttattaatgttcttattttgcgatgcagaagcaactctgataggacaactgagagcgagaagctggtggcattcaaaagcagggaagcacatctctccaactccgaaattcatgctcttcccctgacaccaccctgcctccatactgaacatcttccaccagccagtagagctgtggatgcaaagaaaccaacttcaaggcactcacaaactaacaagagtgacaaatacatagttagctgtcacattcctaccctatcaactcactcatccagtcctgaaggatgtccatctcaggtctccttcaggctggctgctgccgcccagaggaacctgcagccgagatgagttaagagtgtctctactctggagttcagattgttatgcctggaattattggaggcacgtgtcttgacatggatcgctgtgctgctgccagagtcaagaggcagtctgagggatgcggcttggagttttcagatcagtgtgatgatttatagggatgacagtgtgggttatttaaaatgtgggatatacaggtgctctacccttatctacatcaccagcttcaaggaaatgatgtgtatcctctcaggattgcaggccaggcctggtggttcgtagatatctgctgagacctttgggacagtcacaggacctgaggtcctgtgaagggggcttggacaagtgctatcagaagtgctgtagattcacgtgtgaggtggtggaccttccaggtacagattagggcctctgatcttcgaggctgcagcacctgcacagtcatcatttctgaagtgagggaggagggaacaaaaaagaattgtgtagagagtttgctgggggttcttgctgagtcagcgcccacataatctccctggtgatgaatgccacttcacggagacccaaatccactttgaattccaggcatgcagatgtgtaattattccatcctcatcggggcactgttataatcttactttctttaaacgtcaggtaaatatttgagagcgaattgccctcccgccctccattccccccactttccttctgtctctccatcagctgatcagtagtgcttaccacccctcccagggtcctagcccttcaccagaaccaacttctacctggcaagcccatggatggtgggcaggaattcaggggagaaggagcagctttctctccaggaagcaaaccacgactattcatatgccactgcttggccatactggtcaaggttctaatttcattttatagcctggtttctaaacaaaggcaaagagaattattacacgtgggtactacattttaaatggagcctcgtataatgtatatgtgtgtgtattgtgtatacaatagcattgtccattctacttttggccaagtttaaacctctgtctgagaaacagacactcacctggctactgtcattcataagtccacacatatttatgtacaatggggaaccttgcctttcagtaatttttaagttcccaacatctactgggctagaaagcaagttctgttattactctttaatgaatgaagggacttgggtagagataatcttattggcccagaaaacatcgccttgaatctgtgagcaaaactgcatttcacccacagctgggacaatcaagtctccatccacacctcttactctagacaagtattgaccacaggcatgccatgatctgcaatgcccatacgactgcaaatgccaggtgacacctttatctttccatattctctatgcaaacagagcaactagtgtctgatgggactcaattacacgtagggaagttgagaagcagcaggaaaggacggcctcagggggtctcccttgggcatggggctttagccagtagctcagacaaggaacaaagtgctggctgcattagctttactctccatctgggggaaaagctgacttgctatcacacttgtatgctcttctcagatgaggtcatgtccctaatcttgagccaccaatcatggaaagggtgaggctgaaagagaaagtcaagcaataaactactccagcaggtcacacataatcctcgtttaacaatccctgctctctgaaagagaaggcagctcaccctggtggagaacaggcactttcattatctaattaatctttgcaacagccctgtgatgtggggcctactaccattttccactgttgcaataacaaatccccacaaacttagtgggtgggtttggcggagccctctgcttagggtctcagactgaaatcaaggtgtcaacaggatggcttctttctgaaggctctgaagatgaatccactttcaagcccattcaggttgtttgcagaactcagttttccttggagttgcaggactgaggttcccttttccacctggctgtcaacttggggcctctctcggctacttccatgtcgccccctccagcagccgtggtcggtacctctcgggcttcacatctctctggtttcatctgctacttctcttctgcctccagcctgagaaagttctctacttttaagggctcaagtgtttaaattgggtccactcagaaaagccaggataatctgctaccttcaggtcactgattaatgacccgaaacgcatctgggaaatccctttgctacctaaggtaacatcctgacaggttccagggattagggtgtggacatctttgggagggctgttctccctactatggggatcagtctccactttaaagacttaggaacaggctcagtgaggtgaagtaactttcccaaggatgcatagcgatgattacaggatttaaactcaggcctatgaatgcttagtgatgattataggatttaaactgaggcttacctgattccacagcccacattcttcccataacacacccacccaccccccaccacacacatacttacacactcaggagagccgagcctggcatagcctggtgtccctgactacattctgggacagcaggtggtggtacttcctctctgggccccaactcacctctctcttctcggcagccttttgtgcctgctgtgctttggaaatcccccattttaaattcaggaatcccatattcacccttcatatatgtgccaagggctcctttttggaaatatgcaccgcttacatacctacacacacacatacaccctacacacacacacacacacacagactttatactagggcaacagattccttttacacacacacacacacacacacacactctctctctctctctctctctctaacagactccttttatctctaaagaccaaaagctaaaagtaggatgcagctcaaagtagacacattacatgtacactgtgttatgtaaattgcagtttaagcatccaattttaatgcaaatcaacttctgaaaaaaaatctaaaagccacatttccctaacatctgctcataggctgaaatgcacatgtaatgatcaaaactattcagctcaccttagaaatactttggaaatggtggcactgaggtcagggcacgtgagtgtatgagacacggctttcacatggccatggcagccaatccatcagtggctgcttctaacccatgaaaaccaagatggggtagggcaagggccatgtgctattgagtaggtcacagacactctggccagagcctgtcccaatcatctcatgcgtctttgtgctgtgaaataaagacaacacaatacatgcaaacatgtctagaacacacagaaattctattacttagaaaggaaagatgtctctaccagctgctattattctcgtatttaaagggaaacccttaaacatgtctctctagggctccatttaatccaatgaaacttattttaaatggagcctcatatatattgcccttcccatcttgaaccccattcccattcagtctctggctttttgaacccacatttagtgagtagtttctaccactgctggctcaagaatgagaagtcaaatgaatgatcttgcctgtaaggagccccaggtttggtagaaggctgggcggcagacacagaagaagaaagagacaaacacatacaagggctcagtgcagtgatgaagagaacctggtgctgaagggtgcagaatgagggagagggtgggccagaggtagggcagggaaagctttctggttctagaggaggtggccccagggctgagtcctgtagagggtcagcttctgcagcagagtaactttggtggaaaagggaagctaggtcctaatagtgggttggactcactctgggaagagtgggaggttctgttggtacctctggacctaaggctgaggcaggagcaggctgatgaggctggagaggcaggcaaggccatgggagggagggatccagctgaggagtgtgagtctccccttaggacaaaagggagccactgagaatgccaggcccggaaggggtggggaggtttgcatttcaaaacaagcactttggcaggggtgtgagagctcagattcgatagtacaatagagatggaggaccactgaggagagtattggagcagatggagagaaggcgacggatgtgagtgatgctgagggcagttgatctgcaggacttggtgacttggtgggtaggaggcccttcctgccacactctggagccaggactcctttcttcaccccttagtgccatctccccttcgcagctggagcatcactcgtacaccccatccaaatccctgatcttcacggggaccctctttcaaattcctccttcacgcactcaggtgccttgttatccccacccgcagatgtgacactgtccacgtgacacagccaccactggaaaagcactgcattttctggcatataaaatgccaaaaaaaaaaaaaaaatccagaaatggctttcaaagtgctgttagctggctataacataatggaatgttggggtgggataaaatgaagtgttccctgtgatagctgttggcagtgctttttttgtggtttaaaaattttgtgatggattgcaaatgtctctcccacacctcccagcaccctctccaacttctctattccaatcagcccttgttgatgccaaaagagtcggaagccagctagatgagattgctacttgatttgagcagatgtgtgttaacattgctataaggaaaggtattgctaccaataccaaaatggaccagactgtgccatccttgaaattcatgctgcctgaatccaaatagaacttccatgtggaagaagaatcactttgtgcagttcaagagggcactacaagccctgacagacagaagatggggtagctaggctttgacttagaagaattctctaatagttcaacaaaaaatatatctacaacagaatatgccaaactgtgaaatagcgaatgcatcattataagaaacatttcagcagagattggatggctgctgtctataagaaatgctgtagagaggattcatctgatggctgagagaaaggctggaacaaatcactaactataagaaatactgaggttgtcaagacataaaaatgggctccaccccataagagagaagtccctaccccactgagaacaccaaaggtccacctgctccaagttctcctgggctggtggaggcagacccagcctcgaaccccacaccaacagccccctatcacattccagaaggccttcatgggctgggtcccagggaagggattcgattttgtgtgggtgttggggtgtttttctgttttgtttgctgggcatccagtctggaccctgtatggcaggagactgacttttctgatgcatttctctacactgcccagtttgggagaacagatgctgtgggtcaggccagaagccataaatttccaggaaataactcttagtgactgagggagaaagccataaaacaccctggaggcagaaacaggagaaaacaatggcagcagacaatgcatggattactgctaaatgctgggatgtgccccatggatcattctcttggcctgagcccctgctcagagagcctgtgtcagacatgtgccacggtacccagagagggaagggtcctgacactttgggaggctcccttttactctactgtgatgtgttcattcaacaaatagttacagagggcctcctacctggcagccactatgctaagcactggagacagccaggagcaaaatggaccccaacccctgccctcgtgcagcttctatcctagtgatctcctaggtctcacctgctggagggaactgacatgtattatgcctgcatggtgccaagattttacacatttacttcaatggcttttaacagccccaagaagtagagctagtatcctgacgttaacacctttaatacacaagggaaatgagtattaagtatcactagctagatggaatgggtctttctgactgtgctgtttctcctgtggctgcaagcctcagctctatcccaccatgaccagatccaaccatctgtttgtacagttttgggtcctataacccagccccattccctcatcccttcctctcccactataagataagggcaaaatatccccagaccctcctcattacccgaaactgagtgctgcaatcaaagaagccaacagactttaatggatgttaatggatgtcactgctgttcctgttcctcattctttctcttcaagctccttccaactgcaaattttcaaatgcatcactccttgctcaagcctgtatctgacccctcagacttggtgctcctccttggtcttcctggctgttgcatctcagctttcccctaacagtctgtcagagcgtgtttccctggttctcaacatccatgcagccgcctcatggagagattcccttattatcaacaccctccaacaactattcctttggcaccctacccgctttcccccaaaagagtaactcaccatctcccaggacctcatccaaagcacgtgtcactctctgacagcttggtgttggatccaaaaccacagaggtccccgccccaatccccagggtgtatagaacagcataggtcaggatgcagaggcagggactcaccaaagttctccccaccccagatgtccatgtccatatcatatttccccaggtaatcaaaccaagctttgtcgatcacgaagagccctccagctatgataggagtcctgtgcatttggaagaaaaagagaggggatcagttctagtggggagatcactctcaaattcttcggccccttgagtctgaaacacccatttcccatttggggaaagaaaaccccattgagggaagaaaactctcattttcttcccatttctgttcctctcgagaagggccagtatattttccagttacctaaaatgagaacaagctccagggtttttcctgtgattgtaaatctcctgaccttgcagacaggcaaattcactcattagcatatctcccatggggacacagggctcactcaggactcctgctattccgatgacccagggagcttccccaagcctcttccacaggctctgcacagcagggctctcttgggagctctgttactgggagaagggacagtgggctaccgaccacgcagaggagaagggctgaggcggcacttggtagcagcacatctgtttcctgaaactgggctctctctccttttttttccctctttatgcctctgttatgggttgaattccttcttaaaaagatatgctggagtcctaactcccagtatcttagaatgtgactgtaattggagactaagtctttccagaggtaatcaagttaaaatgaggtaatgagcccaatatgactggtgtccttataaaaaggggaaatttggactcagagacagacacacagaaggaagagaatgtgaagagacacagggaagacatggccatctaccggccaaggagagaggcctagaacagccctcagaaggaagcaaccctgtggacaccttaatctcggacctctcctccagaactgcgggacgatacatttctgttgtttaagcagccccgtgtgtggtatgctgttacagcagccctagcaaactcacacaccctcatatttttttccttttcttcgtcccagtccccagacttctctggagagatgccagagaaatgcctgaaaaggggctaccaaggaaggcaggaggggagcagattccaagctaataatcagtggctggataggtgggcaagccctcaaagacctggcccccgttcagtggatccagagggtgaagggagttttcttccatatcaaagaagtaattgatggacagctggtcagaagcccaggtctcctgatgctgccacatcctgctgttttctgagaactggcttcatcctgggaaacaagtgccctctgatgagcagagctatcccacaagaagagaacctgtcctgagaatgccacccctgcgacagaggcaggaaaaccccatgggagctgcacagcatcaccttgaccctttgctcttcccacacccacaccatgcactgcccctggtgaggagctgatgtgagctgtgtgatgctcagcataataagaagctcctcctccctctccctttagaaatgaaggactttgtcctgggtaccaactggctccaattttcctcttggtatctctccaaatagagaagcctggaggagcaaggaggggccatcaggtagatgagaccaaggtcctaccccacagtagagttctcagagtccccacccccatttggaaggtcaccattcacattcccattcttagctcttgctagtccctttatcctcaatttgacttcagccaactcaacaaaaatgattaaatacttactatgtggcaacaccagagacacagagatgcctttggctagtcctgggcatccctaatctggactgagaaatccagtggcctctgtatctatccatacacttcttatcctcctgctgccctgcctgaggcaggcttgttttagcttaagtattcccaagaggcccgggactggtttactgtccagtaggtaggacaccaagaccatcactcttgaagctgagaccacaggctcctctgtgtggtgaccactatgctctactctaccccaagccctcagttggtccccaggccccatgcaaagccctagccacaatatgctgtgggtcacagtggggcctgggagagaatgtgggtcagtacaaagccacccacagcctggcaaagagccagagttcatgccactgtcatcttcctgcagagaacagggcagctgtgcttatgaatatgtcacagtgaccttcatattggcctccacttacagcagtggctgactcaacatctctgggctgaatcctgatgtccaagaccctgggactttgctcctggccctaagggaccatctttcccctcactagaggccgaatgggaccactcaaccaacgttgggctccgacattagcaggaggcacaaggacatcatggcatgtgtgagggtgggcagcacacctcagcacaggcctctgctggcccccatccccttagcaagaagtccccaagaggatagaaacctcctaaaataaaggcaaaagtggagatggcctggcaaagggctccctttgtctgcttgatgctttgacatctgatattgagcacctccctacacttgacaggatccagtggtgatggtctgcccacccctgcacagactcttcccacttacctgatgggctccgtggggtccaggcgccgagccttctgctctggggagagctgctcccactggaagtggaggctccagtcaaaccctacaacacagcaccaacccacctgctttggtctctcaaaagcacttgctcattctgcaccctctccagaaggtcatgaatgtacccaggtcctggagaggtaggtctcaaagaggccggtccctgggattgcaggtttccctaggctgatcagcagcatggctgccaaagcgccgttcacagcttcctgttcttcctctacccactaccacctctctgagccttctctgctgtgtagggttagaaataaagggcagaggataaaaagcctaggggtaggggccgaggatgacaggatggacagtcatggaatgtgggccttggcactgagtctcaggaaggtgtgagcaggaggtttgtgagaggctcttaaactacctgagtcacctaaaagtcattcttgaagtgggggcaacagtgggccctatgtggagagctggggtgggtctccccaaacatgctcccttctctaaggtccctactcctgttaacagaataatcacgtctctaggagagggtggtgcccactgctggcatcagaacaatgcaggccacatgtagctgggaaatccttgctcccatcacatttttggacattaaatggggtgagccctatcttagagctggagctctgggtgctgggagcatcctgcccaccccctagcccttccatccacagtcctggtggtaagggccaagctaaggtaattatagtgcaggttgcaggctgagctttctcgacaagcaactaagagcttttccttcactctccccacttaaaagcagtgactgagaggaaaagaaaatccttactggggaggaggtgttagcccaactcaccccctctgagctccgaggcagactcgatgtaggtgaaggtgtccaggttaatgatatcgatcacagggcacaccacccgcgtgtagtcctgtaagacaacagacccgcacttagcttatggagaggagcccagctgggagtcagggagcttgggatggcctcgtgagggtagggccagagatgagttttgtggccttcatagagccctttcatctctggatcttaatttttccatctataaaagggggtactgggcaatgggacctctccagttctgatgcctaaaatgctaagaggttttccttgactgctgggacctccctgccgcagtggccatctaagaaaggtggacatgatggaggctggctggagagtattgcacacccagaaaggggcaatcgagaagaaggggctccagaaggccttcaccacgagtggggctctaggaggcagaggacatagttagctggtgatacggtttggatctgtgtccccaatcaaatctcatgtcaaattgcagtccccagtgttggaggtggggcctggtgggaggtgactggatcataagggtggatttctcatgaatggcttaacactatccccttggtgctgttctggtgatagcgagtatgttcttcttgtgagatctggttgtttaaaagtgtgtggcacctccccactcatttgctctgttgctcctgctctggccatgtgaccagcctgctcccccttcaccttctgccatgattgtaagtttcctgaggtctcccccgaagctgaacagatgccagcatcatgcttcctatacagcctgtggaaccgtaagccaatgaaacctcatttcttctataaattacccagtctctggtatttctttatagcaatgttagaatggactgatacagctgggaaggtgaccccaagactgcagccccaagaagcaaaaccgtacacccatggtgcttcattctatgcctgtggttcatggataagttgatgaatagcatctcccagagtcctaactttaattgtcccctgcagatgaatagtcacaaatttgtaccaggccccgacttccctgttagcttccagacccagatataatatgccattggccacctccatgtgaatttcactcacctttcaaaggttgacttcactgtcttctccccaaacatgctcccttccttaagttccctatttctgttaacagaatcatcacctgtcttccctccccgcagcactaaatgaagaagcttcacccagcccatcaaccagaccaaatcctgctggttctaactccaaaactgctctttgagttcagcctgcctcttctccatcccctcaagcctggagtactacaatggactcctaaacccgaccccactctatctcctgctcttctccttttattctacatatggctgccaaagttgtctttctgatttgcaaatctgactctgccactcagctgctaaaaactttaactgcctctaagacaaagtacaaactccttagcatagcatcccagaccatcaagaacaggcctatctctagctttccagcctcattacttgctacgtccctcaggccaccccatctacggcatcaaaatcatgcaggaaacattttcaaaatatgcaagcctaagtcaccagcttcttggagccatcgagccactgtacatatatttttcaaatttctcatttctgggtgagtagccctgtacctgatgtgcagtgaggaaaactccccacattgcccagagaggtgtcaaagagctgtgaacaccgaaacttttggacagctaaatgggaatcaggcagcccatcaaaaccagcaggtccctgggaaccaggcaggactgcttttccaatcctctgcaccaaccaccctttggccagcacaggcaggaacctctgtttctccttgaagccatttaatttcctggttcattctttcccccaaatgaggttgtcttcttattttaaactctagattcactgagtgcctgattttaagttcacagacttaatttggccctcagcctcccacatgtgactcattctgacagtaacaaggtgcctctgaaaaccaattggcccacatggaaagaaatgctcattttcaatgcattacttctacctctgggatgtcacagatggttcattcatagtcagcactgcacctgcccagctgccacagttcctctggggctcttgggccactgtcattgtgtgtctgtggatatgtcaacaggatacatggatacatatggatacatactgcaggcacacaaacaccaccatccacacaaatacctggacgtgcacacacaaatacacacacaattgttccttgaattctgaaatgacctcagaagttcagagatatcttctgtatgtctgacaaagtcttggttttgcctttgctttgagctttggggcctctgcagctgtactaggtccttctgtgactcttatgcaataaaggattaaccatgcccaaagatatgtttggcccttgcccagctcctgggaggtaacctctaaccccttggaatgtcctgcctagaagactgtctttgtttacctggggctgtgggctacaccagataatctatgctaacaatgtggtttatggagaagaccttgggccgtgtggtaccaactcaacttgacctctgaaaaggcatggagaccatgagggtagttagccatgtctatttactgacacccaataaaaaccctggatatcgaggcttgcggggagctttaccctttggcaatactctgtgatgttgcctcacaaccttgctaggaaaagtaagtggtatctgtacaacctactgggaaaggacaactggaagcttgtgcctggactcttcctgtgcacctttacccattgctggttttaatttgtatcctttcactgtagttaagccataaccatgattctaacagttttgctgagttctcagtccttgtagcaagttattaaacctgagggtagtcttggggacccccagactgcaatcctgttttgctttgactttaaaaaaaatctttccccagtatttaaaacctgcaatggaaaataaaatgctggttgcttactttggtcacagacttccccagaagccatgcatgggctctgtctccagggctgcaacaggctctggtgcactcctcctgtaagctctgaggggttctgtccttctattattcctgtcatagctcacttgtggtatctgcttggctgagagtcttggaggccagataggtagtgagggatatttgggtctaagtatgtataaagctatgaccttgaatgggcctgcaagaggctttataatgagtcaccaaagtcaggacacgacctctctgagtgccctgggaggtcagtacctgctccgcttttgtattcctcagctctggcccaaagcctggtgggcagcaggtgttcaatctgtgctggctaaaagagggcatctattagctccctctaaggacattgtgtcagtgctgctagcaagcaggtgggtcaattacagctgaataagatggcttctcctcctgtaggctaggggatggagggactctcaattaaagcaccgaggcacactgagttctctgtgtgcatgccccagcaggatgtatctttaaagcaaggtccatgcttaggctcaagcaggcagctggtggaacccttgcagatcctggaccacactccctcctctcccctcctccaagcaaatccaagtccctactctccacccaactcctacccaaccctcaccaggagcaactacaagaggctgaatgcatcagcccgtggccatctaccacccctgccatcaggcctctcatttctccgctgagtcatgtaattaaaaccacattgtgaatgggcaatcaaaaagctcctagagatgtccactcttgtgatcaaccagcactcctgagcacctactatgatttaggaatcgtggcaggtacaaggatgagtaagacctcacagtctagagaaggcgaggacaggtgagtagatggttctgatgtgggtatagatacacagcctaggggcctctaagctggcctgaagggaggggtggggaacacagggaggaatcctcaaggaggtgacattgtggggaaagacaaggacagctgggttgacaggacacctgggttcccattctgattctgccatctagaatatgtgtgacctgaactaaatcagccagctctggggactcggtttttcatctataaaagaaagacaaattattatttgcaaaactatcctgcctctctaactgggcttttgtgaggaaacaagagagaaaggcatgtgataagactttgaagaatatgtaagctatgatttatataaatttaccaaatgctttgcagagattggagtttcttaaaatcttttttttcccactaaagaactacgtggataaggagactgaaaaaaaaataagcttatgtttaaaaaaaaaccccaacttggtacttgtttcaagtatcatcatgtaattgaaaggaaaagaaggaaaattggggaggttttcaatgtggaaaacaccagctgaggacagcggatgacagctgaagcccagtctctttcttatctctttctatttttgaaaatcccaaactccaattacagcttaaaatttccacttccactcacaggatcaaatcatgtcctactctgagacaagacacatacaaagacaccaggaaacacaggctgactcacgccctcaccccctgtccccaaagggctggcccagaggaactgttccaggtcattaaaggagtcagagtcttagcaaaaacctctgcagccctcaaggccactgcagacctgggagggtgagagctggaccatggctcctgggtttgtctctttgctaacctctttgctacaaaagctttagctcaggtggggcaaggacccaggagcttagcttaggaagagaaggagcgtcggcagcaggcagacattgctcacattcggaaacgaagagatgaaggctttgcccgaccagcaggtaaggctggccatggatgtagaaaggagagcacttttcagagagggtttctgagatgaacttgggaccactgggatggaaagggcttcagaggttcattaagtgcccaaagaaagcaaggctcccttaacacattctgcagggacaaaatcagcctgggggtccctgcaggttaagcatcaatttaccatatgagccagcagcaattcacatatacacccccaaataattgaaaacagagactcaaacaaaaacttgtacacaaatatttataactgcgctattcacaaaagtaaaaaggtggaaacaacccaggtgttcatcaatggttggatggataaacaaaatgtggtatacacatgccatggaatagtattagccatgaaaatgaatgccaatacatgcattcatacttgaaacagtatgccaatatccatacaacatggataaagcccaaagatatgctaagtgaaaggaaccagtatcaaaaggccacatgttgtgtgattccgtttatatgaaatgtccacaactggcaaatccactgagacagagagcggattagcagtggccaggggcagggagaagaggagaatgaggagtgagtgattgcccatgggtatgaggtttccttttggggtaataaaaacttttccttttggggtgatgaaaacttttaaaattaagcagtggtgattacacaaccttgtgaatatactaaaatcattcaattgcccactttcaaaggttaaaatggtaactttcattatatgtattttacaacacaacacacaaaacacgcacacacatgcacgcacacgtgcacacatacacacatgcacactcatatgaaatcagtttgggggcagtggccatggggactgagtccactgctgtgacggctgcacccatagaggcctgggcacagctctgggcagagagctcctgggttcaggtctgagtctttaccatgacctcacctagcagcccccaatatccaaagagacctggggccccaggaacttcagttccagggtgcatggtcagcaaactgagagggtaaggggtctggtcagaggcagaggtcctgaggggtgaacagcctgaggaggggacagaagtgccaagtgtgcactgcaccgtgccctggacctcagcccctcatttctttctgagatgaacttcttgactgcaagcgtacactacaacgcatctgccattctctcggcaaggagcaaactgccttagaaaagttgctcagaaaatgcttatgtataacattaagggaaaaaagcagaatacaaaaatcatataaatacagtattatagtaactatttaaaaaagacactttctgcaaaggaaaaagatactgaatggaaagaaaggttaacagtggatgtctttgcatgatagaattttggttgattctataaatcatgctgctataaagacacatgcacacgtatgtttattgcggcattattcacaatagcaaagacgtggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataagtgggaattgaacaatgagatcacatggacacaggaaggggaatatcacactctggggactgtggtggggtggggggaggggggagggatagcatcgggagatatacctaatgctagatgacgagttagtgggtgcagcgcaccagcatggcacatgtatacatatgtaactaacctgcacattgtgcacatgtaccctaaaacttaaagcataataaaaaaaaaaaaaaagaattttggttgattcattttcattctaccagtccatattttccaaaatgtctgcaatgaccatgggttactgttgtaatggaagataaggtaagtcgcagcctactccatcccctgccaaggggttttccactatactgcagtccctgagtttgaaatccactttaaaaatatgacctgagtttaagtaaggaacaccttgtctcttctgtataaaatcccctgtaaacagagacactatctccaactcccaccagtttcttccccagctaagtactcctagactcagttctgattctgcaaccttaacctttagtttttgtttaacatactccggtttccttttaactccaggcatgaatggcagcaggacgacatagctggccctagggtagtgtcaacaactcacaggcagaaagacatttttggggaggtaaaggttcctgctgcggagtagagttcctctacttctataaccaggaggtgctcaaatgttttccatatttcttcctcacaaataatttccttcctttttttttttttttttttttgagagagagtcttgctctgtcgcccaggctggagtgcagtggcacaatctcgattcactgcaaccactgcctccctggttcaagcgattctcctgcctcagcctcccgagtagctgggactacaggtgcgtgccaccacactcagctaattttttatatttttagtagagacagggtttcgccatgttggccaggatggtctcaatctcctgacctcgagatccatccaccttggcctcccaaagtgctgggattataggcatgcgccaccgcacccagccaaatttccttctttctagagtttttgtgttgcttctacttgctgtcacttatactgtgcttccctttactggaggtcatttgtgaagcagtgtggcaccagtgcacaaagaacccagcggaccttactaagcagggtatggataccttttacacagcccattccaacccttgggacactgcccaaaataggtgctcaggaaacgtctgttgattcatttaccggtaggaagcaagcttgattttctcctcttccaaccataacacctccccatggcatccggttttttattatcatttctgaacactgagcacctactctatgacaggcagggtggccacaaggagtcattggtgcccccactggatttgtaagctattaggggaggcagaggactaacccagaagaggaaatggtgggccaagggagcaatgactgccagtagtgatcctagctggccacgcagtcaggaaaggctgcctagaggaggggagccgtggacgaggccccacagagcaagcgggtttgtggagaggaggggaagggcatccagggacaggaagggcttggtcagagctggagcagtgggaatgtcatggcatgtccagggacaaggggctgcagaagagagcatggagggaggcgtgcatttggaagggacttcagtgccaggagaggcccttcaacatttcccaatccagacctctttgcctagaagatatcaaaaaagagtaggagaggagatttttcttcttcctcttttttgtttttgagacagaatttcactcttgttgcctcagctggagtgcaatggtgcgatctcagctctctgcaacctctgcctcctgggttcaagcgattctagagaggagatttttctaaacaacactaagtggaagacgagccatcccaatctcagagaaaatggttactgatgggccttaacctctaggcccatgtgacagaactttgtaaacccactgaggttatctcattggaatgaacaatgttgggaaggatttccttgttttcttctgagcagacgacatagcttgattctttagtcctcttaacaatgtcattatgcaggtaggagtttaggagctaccatgaagagtgagcaggaaataaccacagcacagggaagatgctgttgaggtaacgccagcgttctggtgctggtggtaccaagtagaaaacatcagacctagtgatataattgccctgactgtttcctctttagtgaagtgggtatattaaaaatacctgacctcctacttcacagaatggctataggagtcaataactcaggaagaggaacacagtacgaatgctagtcattgaattgatactgccatctgcaattgccacacattctgtagatcagtagggaagtggatagacttcagggaatataaaataataagaaaaattaaatttcctttcactttttggggagtaattgagacactggaggaatgaagcatccagaattgtagagtaatttaagggcaaagaggggcaaggaattcaggtctcttagcatctagcctgcctgcttggtgtagcctttgggtgagggtagaagtaagacagaggccccaggaattaggggatgaagcctggttaagtttgctgcctcctttctacaaaagacacccataagggttcccattctggaaccttctgctctccggtagaaccggttctgggcagttcattcctgcccaggaaactgcatatgttatatcccagctgtcccaagtgcaggcctgctatgggtgacagtcccagtcacaacacatcccggtccttgctccaccactgactgccatgtgacctcacacaggctgctctaccttagttccttcatcaataaaatcgggactgcgatctgttctgcccacctcccagaagaactgggggttgcacatgtgaagtaatgagcttgagagagagcctggagaaagctggggcacgaggcccggccctgctcctcagcctcactcacctctttgaccctgtgcaacagaggctggagccagtccctgttcacctcacagtggctgtcgaggaaagtcagagtggtgccctgggcgatgtcagcgccccgaatccgggaccggaccagacctgcagtcaggaacaaatgacgaagtgggtgccactgtcactccattgtccagcgagaccagggagaagccacccagcattccccactgatcaccccaacacacacacaccatcacaccttcgaccccccgacactcacactggaggctcccgcacaacagctcagacctaccttgccgttcattattgcgcaagcatttcaccttgggcaacttgatgagctgtttacagtcatcagctgcaaagacaaaaggttaagccaattgagcgcccagggatggacctacgtgttacaattgtgtgcactgcaggtgaacctgaagggtaggtgaggcagccctgtccactgtcccctaactgcagagtgcagtcctgactccagggtgtttccaggctatgagaggctgacagatcactgctgtcatacaaggtggccagtctagggcaaagaggcctcaactgggccactttggaacaggtcagtacacaatggcacctgtatacttgcttgaaaatgttccaggtggaaaatcttggcctagtcacctggggacatttctcttttcttttttgttatttttctctttaaacaatttttaatttaaatttttaatctttaattcttatggacacatagtagatatatatatttatggggcacaggaaatgttttgatccaggcatgcaatgtgtaataatcacatcatggagaatggagtatccatcccctcaagcatttatccttgttattaatacaaacaatctcatttctcttttgtttgtttttgagacggaatctcgctgtcgcccaggttggagttcagtggcgcaatctctgctcactacaacttccacctcctgggttcaagtgattctcctgcctcagcctcccagatagctgggaccacaggcatgcaccacaatgcctggctaatttatgtatttgtagtaaagacaaggtttcaccatgttaaccaggctggtctcgaactcctgacctcagatgatcctcccgcctcagcctcccaaagtgctagaattacaggcatgagcctctgtgcccgttccccatttctcttttcttataggccattcaaagcactggtcaatttagtaggtctggtaaaaactgctggaaggccaagaataaatgagattttagactttcctttcagctcacagacctgcttttggaagggtcccactcagcatgcctcccattacacagagctggttcacttctccaccatacaggaaaccccatcctaagcatttgtccctgttactccctggcttgcctgctgctcctcactcctttggttcaccagctccctggctctgaactccatatcttggctccaccattgtggttttgctttattagtttattgaccttggcctccctgcttggctctgaactttaaagaataacagaaaagacttacacaggcttctgggctaggtactgttctaagcacttcaaatgtgttaacatgtttaatccttatataaaccatatataccatctctgttttataacaaggaaactgacatgcaccaggttgattatttgcccaaggcacatagctagtgagtgatttacaggtctaggatttgaacctaggcagtctggctccagagtccatgttttaaccactgctattctgcttgcaagtgaatccagcagcactctcttctcttgcttcagtgccaggctacccctcagcagggccagtgtctgcccacctccaagctcttcctcactggggaagggagagccgatcctcacgttccagaactcagagtcttgatctcattactctaggcctcatgtacagcccacttctgcatcacccccagaggttctgaggcagcaccaatgggtaggggtttccagccttcgtacagcagaccgcagtgtgggggtggctcccaatgcccagcttccagcctcagaactagtgggggtggactccactctgataggacctggagctgtccacagtggtcattccatttccctcagttcgtcaccaggaagagggtgttctgcttggttatgattgactgcacagaactgtacccaggctcctgggaggacggccttcaggtgaggtgtcggcactaccagtacattacttctgacaatgcttcaactattactgtacatttcaaatttgatgcacagtgtctggtaagacacacatgtttttcttggagagagtggatttgctgtgaatttggatgagactcaggttctttgataggataactggaggacacaaggtaggaaatgagcaagaaaagaatgcggaaaggttggaaggcaaccctcactgtgtcatggccaggtgacaggatgtcccacggggttggggaggtcccaaagacagggcccacctagacctcccaggaaatgataggaagagggccttagctcagactgcagattattgcagagaacccgagaaattgttttttggatataaagcttctctccttctgagcctagccacggacgctcaaagacttccgtacctattacaaacctgggcttttccccattcccagaaaaccagtggactcacctctgcctgttacagagtggctgggaacagacattcgtgtctaaagagcaagtgagcaacatgacttacggtcattgctgaagtcatccactaatatgatttcccggatcagatgcgtaggggtgcggtttaatacactgcaagatggaaacagaaaaaaatcactggaacttctagtggcaaaatatatgtactaacccgagttttaaatagataccattgcatttaaggaatgaaaaatcagagcaccaacgggcttgtccagtcatattgcttatctgtgagccaggaggaatgtaattctgccttcaccatcttagtgaatacctccaccacccgcaaagccacccagacagaagcccaggagttaacctcggcaaccctcctactccctgaaaccccacagcaaatcagtaaagactggctggtttgactggaaaatgtcactcaaatcactttcacttcttatatctctcccctgatttaacctcttctgtctagtttatagcctcaacttgccccagcctctcccaggccatcttgctcgtggtctccagagcgaactttctgacaaggagctttgattgtgtgactctcctcgccaatgcaaataaataaactgacagccccccaggggctcctcactattgacatcccaaatcctcagcacattcctaaggcctttgccatcagaagctggcccacatttccccacctcccatgcccagtgccgctgtctgaagctgtcctgctcattcataactaagagcctctctcctgctgctgccgctgcttgaaatgcccctgtgctgcccacaaggaccagtttgaatgtcacttcctccctaacagctttccaagccactacgtgagaattaattgcttcctcctctgggatctcctagtagtttgtatctgatcctatgacttttctcacttcccagccctgaagtttggttttgtacctcacccgcctgtggtcccctctggagggaaatatcccagggcaagacccttgacccattgctctctttattgccagagtctagcacagagccttggtccataactattccctcgagggatatttactgaacacctactatgtgctcagcactgggcatatgatgattctaccctccagaagcttgtggtatagcagctacttactacaagctgtgtaatctcgggcaagttactttactgctctgtgcagcaaagaatcccatctagaaaacagggataataggagtacttatttcacagtgcagttgagcaaattaaaggagaaagtgtataaaaagcatttaacatgatatttggcactttatgataacaaatggttgcaattttttattatcacttaatttggtgcatcattaatgatttttgaatctaactgactcacttacccctcctgtgctgtggatctctatccaggggcaaggttaactctgtgtcttaggtctgactgagatgactggatcctgcttctcctgaacaccccaaaccacgtgactactcagaaacatggctgggccacaccagctatcacgggattccctgtgatgttggagagggggttcagaatgggtgcaggtggaggcgctgtatgcagccctcctcccaggaggacccttctgagccctgactggagagcactaccccttctatgcaggatgcagactctactggaagagaacttagcctggagctaccatatttatgaagccttgattctcaccatggcaactagtatcagatggagagaggaaccccaacacaaagtcgtgagctcactgtctctgtcttcgggagctcatggtcagggaggggaaagaaggctgcagcctctgccagaggatggtggaatgggactgttcaccatgatcgtcccaaagaaaacacatacaaacaacaaccagccctctaatcagggagggaagcaggagacagcggaaaacctgctggaagaataacccctaatgaggtttgattacggctgtagcttctgcattcaattctgctaaatccctgccagctctttgaaattcaagagttctcttctgcgaacatcaaaaggtaaatcgcgtgcggctctgcactggttgaactgagagatgattagtgaataaaaaatgtccagggtttaaaacagaaaagaaaaaaaaaagaaatagtcagcagtgagtgctaattagaccatttcgtggtaacacctggcttgtttttgcttctctaatcagaacaattggagcgatggcggagtccccttaaacatggcctgcagctgggagggcctgaggtgggcacgtgctctgggtggtcagaggagaaggtcaagtccagtccaagggacctagcctggcctaggtggtcctccagggccctccctcatgcacacccactctcattccctccaccctgggagggaatggttgctcaggtctccctcccttgctctcaccactgcctctacagcaaagcaaatccattcgtccaggcccagcagaggatagctcttctcagcctcacccccactccagctgccttccccacacccttcctttgcctcagcatgggaataaatgctctcctcactctgcctgggattgttctagaacagagtcttctatatgcagctcatctctctgccagagggcaggtacacaggtggcttctacacctgctgcaccctaactattggccctcaaggagcccccagaggccgcagggcagcgtgggcagtgtaggctcagaggccaggtgggctgcaccacccactaactgtgcaatcctgaaccagatagatgttggttcgctcccagccttcatttcctcctgtaattacattttccttgtaaaagcaggcgatattaatacttgacctacttcacaggcttttgtgcctgtgaaataaggaaatgtatttgaaattgctttgtgaactccacggtgctctatgcaggcaggttttatcaaacgctccataaataccagtagaatgaagacccaaggccggctgacagttgagtttagtcattctggagtgagactaacttgggttcaagtactgtttctttgtatccaccattcactagctgggagagcttcagtaagtactgaaccttcagcactataatttcctcagctgtgtgaaaggagctcaccatgcctggcacacagcagctgctctctgaatggtggtattgatattaataatattgaagctaataatagcaatatgcataactttcccaagtgggatcctggagccagcagcatcaccgtcacctagatacttgttagaaatgcaaattcttgggccccactctaggcttactgggttagactttcttttttttttttttgagatggagtttcactgttgttgccaagactggagtgcaatggcacaatctcggctcactacaacctccgcctcccaggttcaagtgattctcctgactcagcctcccaagtagctgggattacaggcgcctgccaccatgcccagctaattttttggtttttttgttttttttagtagagacggggtttcaccatgttagccaggctggtcttgatctcctgacatcaggtgatctgcacaccttggcctcccaaaatgttgggattacagacatgagcccctgtgcccagcctgggttagactttctacagatggggcccaagaaactgtgttttaataagccctccgggagcttctgaagcctgctcaagtttgagagcccctgcattagaactctgctgtctgccagggctggaggctcacaatatacacctgttgtcaccgctcaggctcaccatatgccaggcactgctccaagtcctttccctatctgaaattactttgtcttctccacaatgatgtcaggtagttattattagcagtctctgttttgcagaaaaggaaactgaggcagaaaggctaacttgcttgcttgtgatcacacacctgttaagggcagagccatgaaaatctggccccagagtccaaattcttaaccaccttactctgagaaatggctcccctagatctgggatattataaaaaagcaacagtgagaagactcaacacataaagggatccattgcccatgcctcagagcccccatgggaggggtggcggtgaaggatgccccaaaaggaaggtgacagcgctgggtctcccataaacatgcagactcactgcatcaggagtcaagataaaccactcttcagggcttgttttctctctaagtgagaatgtcccctaattcatcaaggtcatgcttctctacacccaccccatcatctgtgtgcccgattgagcctctacctggctctgagttccccacgtgagcctgtctagtccccagctaactccagagcttagggggccagagggtctgggcaggggggttgcaaagagcctgacaacaaagcctgtccagaattccagaaagttaacaatgaaaggtactttagagaagatccctttattgaagacctctgagacaggacatgtccttcagtcagtcccctctcagtggctagtgattcatttgtgcaacaggatagagagtgaaagggaggtatagaatcttaaggcatggaagtttctagaagtaatctttcctgcctccacccctaacattcatttctgccctgcctgcttttgatataagctcctggttgtctacacatgcctctcaggtctccattttgctgtttgtgtgtgtcatacttgggtctgagctcggggctggctgacatctgaagttcctaggaggcaggaaacaggctctctcagctaagtcgtctggcacgtcatgggtgtcttctgaaaagtacagggctgatgggcgccaagaaccctcccagagtgcagggttccagggcctcagggcagccctccaacaggcaggcagacagaggagccgcgctgtacctccaggaaacccaggaaagctgacgcctgatgcctctgctctcaacaagtgcaccacctgccccacaggctcaggatgaggctccaactggagtgagagaaggaatgtgttctgcaggccacaaagctcaggatacatttaacacggtaatcttattaagtatcattaataccacatagaggtggaggagcggcaggaagaggagaaacatgtcttagagtctgagcacagcagctaaggtaccctcgaggacataaacactgttagggaggcctggggggcctagaagcccccatattacatacactgtaatgcccccaaatgtctgagacattccccagaggaacgtttattgtagaaatgtgatagaattagaaacatgaaagatatttttatcatcattttctacagatgtagttaataacatgccccagggtcacacagctaggaagtggtagggtttggatttgactccaggtcttctgactccaagtgtggtacccttttaagtatcccatagcctcctttctttgatcaagcatttattccatgccaggcactgttctcagtcctttagccgaattaacccttagcaaccctatgcactaagtacgattagtattctcatttccttggttaggatactgagccattgggaggttaagagatggataagataagtccttgccctaaaggagctcactgaaggttacatgctgaaaaaatgcagcaagtactggagtagtgatatgtagagaagggcccagaggaagcccctgatggggtgcatgtgtgtgatggtgtcaggggatggaggcacccagcatcagagagcttcttgcaggatgggcagggagaggccagcctggaaagcgaggggcctctctcaggtgctaacgctgttctcatggaaacatctggcaggcatgcccagtcatgaccggtggagcagccaccatggcggtggggaaggcagaggttgcagttggtctgctccatgaaccccccctggtgccccagcacatcacaacggcagggctgtggtctggcacttcagaaccagccacctccacctccctgtgtgtcctctcagcctggatgccccagacgctcctcccctcaccacaggagacccaggagaattgggcctcctccatccctgttgtccccacacttaaccagccaggcgctttgttatcgttaatctaccccgagactcccggtgacacctgacagtgacttggcacattttcttgtcaagagctattgcctggttgggaaatcaaatttgaatcaggtggctcttggggtgattacagaagccaggatgggcacgtggctggaggaagaagccagcctgacattgccaaggatgtctaaacagcagacagggctgtccccttggatgggtggaagcactgggctaaaaactgtgtgtctgggcaggtccctccctatgtctctaagggatgtggtgactgtatacagtggacattcatcattcatgacaggtggagctgaagatttggtgccttccctcagggtgaccctactgcaggacttacctcccatcacctggaacttcccactgcccacagccatgcggcggcgggagagacaggaaaagtgtagcctgcatgatggaaacaatgagattttgctgtgtttcgtgtgctctctgacccatgtttcatcatatttttttctctgtggcatcggcaccagctgatgtgctgctcagcaggacaggaagggtctaatgagccgcgtttcatggggacatggaggtactgggggttcttgctcagctgcgggacgtggctgtggcattcctggccccgaaggatgctgaacaccaccactgggactagcctctccctactcaggctgacaagaaggaggactctgagatcagagtgcaaggcctggaatcctgcctcactatcactggctaggcgacactggaccttgatttagtatctccaatgtcagtttcctcagctgtgaagtgggcgtggcagtggcctcctcacctctgcagctgaggtgcacagaatatgtgcgcagaggagctggagtgagggcggctgctgtcattgccatctgagaggtagatactgctggtggcctgagggagggagaagaggacagatgacttctggaggggagggcgggcatgggggaaggggggtgaaacagccagagtctttggagaatctgggggaggaaatcctgggtaagccttctgggtgcaggtctatgttctgaggggagttctgctagggactggcactgggacttgggcacatcaaaaacccacgcaggccagaggccatccatagcaggatacacctattagagcaagaacacgacccagaggatgagtggactgaagcccaggggaacggggatggaactgcaggtagatggtcaggaaggcaagccttagtgattgctgcaggccgttctgatttgcatggcccctggcaagtgtgtgggagggcagagaatcagggtgctgggtgctgacccagcctgatgctggggctggggtgtgcactcagcctttcagggcctcagccccttcctcatttgtggaagtcagaacccatgctctagaggcagcctggcagagtggggaggccgagggctctgaggctgcttcttctacttattctctttgaccttctgcacgttacctaacaccacaggcctctgtctttctataaaatgggataatagcctcccttacaggaatgtgaggagtgactgagtggacacatgtgacatatagaatagtgcctggcacgtagttagatgtgtctggtgctcctagtacagcgctgggcacctggggagcagacacactgtcaccaagtgctggcccagagctggccaacagacaagcaaggatgcctcacctgcggatggtcctgagcagcgtggagcgggcctcgttgtggaaggtgatgatgatgctagtgggtggaaggtccgtgcaatacaccagcagtgtgcatctggggaaggaaaggcacagggcaagtgagaccttcagggacaaagcatatctggagggctagaaccgagggcatctgggtgggcatccctatgccagatgcttgatatctagaagggcttccccagctgcagagtactaggtaagaccccacggcttcacctggccctaagaggggctggggagctccaagaatgactaaatctgaattttctaccaccttgggggaacctaggcttggagacgaattgagttgatatactgaaaataagtgtggtatttcttgcatgcctgagccagtgcacagtggctcctggtagctgcatgaacacaaccccaagtcgggctctgcttcccactctctaccctttcagcccatctgcccacaccactggccagtgggtagattccagtcggcagaggcttcactgtgttctgggctaacagcttcaggctaccatgttgtgctgacgcccagcccctgcaacacacacctaaatgtggcatgtaaaagaggcagagccccaaaccctggtataagtgataaaaccccatcttgaaaaggcattcacttccatgtatccaggattatttcctatgacaattacatctggggtaatttcaatttaatacctcgctgcaagtgaaaattgtagcctgcagcttgaaaattactataataatgaaaataaacccgccaagtgaggctggtggcaccaggggctatcactgggtaaatgcttcctcctgtttcttgctatttcgggggatgttcaattattgcggggagctgggggatattaaaagatgaagtaaataacagactttagggagtcaaatatttgcttttttcattatctatttttttcctaggcctggggcttttaatatagggttcagagacccagggatggacttcaagggacacgtgagccctctgaaattgtttgcaaactgtgtgtataaatgtgcatttcttttcccctggaaagatagttcatagttttcactagtctcaagaaagtctgtggcctaaagcatttaagatccttagtcctaggctaatggccctggtgtcatgttggcctctcagataactctgatcagttttttctataggggcataggctgaaggctcatggtgtcggtccagagaacttatttagaaaaagccaggcagctctgatcaggactcaagcatgggctgggcgtgggtcatccaggaggagccaaaagttagggaaggaaggccccaggagcagagatggtggaaaaggtaagtcttgtccttcaagcctgtcctctctgccagaaacaatttctcaccatgtccttttgccccacctcctgaattcacccctcctctcatgcccatggcctctcagacagtccttttttctcaggggagcactgcagcagcttcctgacccatctttctgccttcagtctctgcccctgccagtcatgtcctgtccaccacatagctctgccaaagcttcctctggtttgaatccctccagcagttcctgatgtatgaagtccaaactccctatcacagccttctacacccttcaaaatcagtcttgtatgctgccatgactctccaccattgctcatgctattacctctgcatggagcaacgtcctttctccttcctctacctgaggactcttattcaaccttcaagacccagagcaaatgtcccctctgctgtgaaggtgttccatactcccccaaataggtaaggacctgtcctttgtgttgccatcattctgtacataactcttttctcgcagttctcgtgatgagactctcctcaacttgactgtgagttcctccagggaaggcccatgcccttgtccatctttacatcactagaacagggtttaagtataccagttgtccattgatagagaaagggagaaagtaagtcaggaagtgcgttcctaggtcagctgaagacagcctcttctagctttctaaggtgtgacagccagccgccgatggctgccactgatcttcactaactgggttttatgtccttgtgtagcccctccctcactgaagcagggcagctcatatgacccatagaatatggtagaagtgacggtgtgtgtctcccaaggttaaatcacaaaaacattgcaggctctgccttggccacttggagggaagccagctgccatgctgtggggacactcgagcagccctgtctacggagagatgtccaggtggagaggaactgtggccacctgctgaaggctggcaccaacttgccagccacatgaatgagtcaccttggaagtgggtctgaagctccagtcaagccttcagatgacagtggctacaacagacttccaactgcagttcaatgagactccaagccagaaccacccagccaagatgctctgaattcctgacccacagacactgtgaagataatcgatgattcttgttgttttacaccacaaagtttaatcaggagtgatttgttgtacattagataagcagtagaaaaagggaaggagaatgccttgaaacagctcccagtgagaagagaccttggccttgcttatctttggacacagacctgactcacttaggagcagaggagagggagggcattgctcgtaggtagttgaggtggaaccagggttgagggagacctggagggagtgttagctggcaggtggcaggtctgtgagagcatggaggggcttggagaggcccaggcagaggggaaggagccagcatggtcagccccaagaggaacaagtggatgtcagggaggagggccagcatctgtctctctaacaggaggcaacaagtcacagagctcagcagagcctcctggtctctccataagagacagcagaggaaaaagagcccaagcagagtgactcagcagcctgccaccaccaggaccgggtgtgtccaatggccaggcctgaagctgctcctggctgctgtggtccctgctatggggaaagatgctctgaaatccctcatggggttaggacgaaggcactgccttggggatgcttcctattccacatgctgggaggcagggggaccacacaccccagcttttgtggtacaagttactcaggggcaagttggggagggaggtggtactgagagttatctcctttgagagcttttggggacaggggccatttgtcctgccttggaggactagctgaggaggcaggtatattgaccacagtgacacagatgcatgcacacacgcagttacgcagaggcataactctgcctggagtggcaaagatggcttcgtggaggaggagctgctggatctcatgggggtaaagtagggagggacagacagaaatggggcacagaattccagtcatgggcacagaactagacctacagaccacgtgaggcagttcccagaatcctggcttgggggatcaggataccactgaccagctgtgggtacgtgagccaatcacccacctctccagctttccatctgctcctctgtaacacggaatgggcccaaggctctcctgctaaatgctctcacagcatcagctttcagaagctctgaccatagctaacattcaatacgcatggttaggaatgtcacaaatgccattttgtaactgaggctcagttgtcaatgggcatccgacattactttcccaagcctcagtttcttcatctggaaaatggagataacaattctggaagattttctcccttagactattactatgttaggtgattacatagtgccacgttagatgcttgacaaatagtaactattattatttttagcatcggcccaaatctgcagacgactctgcctgctgggtggaaccagatctcacaggggctggaaaggcatctttgctggggggttctgtcctgtcccacaagcaggtaaggggcattgagaggcaagaggaggagcagagatcaaaggatgcagcgtcaatgtgagtgaaaagaacctgggctctgatgcctgcatttgagtctggacatgtcgagaaccagctgtgtgcccttggacacatcatttaccctctctgagcttcaagactgttccctgtaaaatgaggataaatacacatttttgttgtgaagactgcagatgatgcacgtaagcacgtggtgtttaaagggtgctgaggaaatggaagctagaattgctatcatcacgcccagagagtgggtgagccggcccgcacgccaggttcagctcatcgactagaatcacaagctcatggtttagaaaaggaaaggaccatggagacgacgcagttaaacctcctaaactgggcccaccttactgacacaccaggtgtgtgtcagtaatggcttactgagccattgtcctcctggtctctgagacccccagcctctgtccctgcagagtaaagaacagggctgtaccctatgagctcctccagcacaggcccagggagggcaggtagtggggtgccatcccccacctcacaggctcaaaaagcttcacaggactctcctcctgcccctgctcacagctcaggagcctggactcaccccttgtctcaggtgaccctcacaaccgcccccactccacagatgagctgaactaaggctcagaatctcgctcaaggtggcacacctgctgagtaactggggtgagggaaatccacatcctgtgactcctaatctggtgctcgtccctacagtctccctgtgaactcaccggggttcaaggcacctgccttggagccctacacacgagtcatctgtggtccaaggaccaagggatgagcatggggataggcagcaacaaggttgagagtctgagaaaaaaatccagaaagctggacatggtgaggagagtcggcccagacagtagggtttctgtgggagagatctaaaagatcaatcaaacagtgagatctattaggggcacgagggaatggaaaaccctgccaacactgagctctggcgccagcagacagacgagcaagtacgttgataatttattaaagatgcagtgttttactggaagaagagccagtgagcgggaaagattgggggcggggtgtgggggacaccgaagagtctccatgagccaggaggagactctggtctcagcctcacctcctggggaaacagaatcccgggatctctatacgtgatggccacagcagctcatgaggaaggcatgcttttctaagctgatcgctgacatgctgtttctttctcttccatttttaatgaatgactcagtgaagactctcaattttccccaacttgaactggggctccaagggcttcctgcactgccaggctctggagcattcagtgccacttactgtccgaaaatgcttccaggaaagtgctctgagatgctaaccccagggtctggggaggagtggcccctctttcctctgcacagtcactgcctcctgctcacccccacaacaccccccaccctgcacctgaatatgtgacaacttggcatgtcagaaacatgctcagtgatggttgctgtcagtcatggcagtcatgtcatgatgcgtgcgatgccttttattttaccccacgagctcattacatcctggcagcagcctataacggagagcgtgatgatgatcactgtcacccccatttcatcaatgagcagtcagggctcccagtgcttccgtggcttgtctgccggggccaggacccaggccctcggacacccagatacatgatcttcctcctgcggcatgctgccttcatgggagaaaagacttggtcataaattagaaacattcaggattttattctccagcatgaaaccaggagggagtgatggagaggcatacccactaactctgaagtggagaggagagcgtaattattattactgaaatgtcagtgtcaaagagaagccgctctggcttctctggaattgacaatggctccgaatcttaaaggtgggctctggcatcccagacgggagtctgaagacagttagagaatgggaaaaggtcaggcaactacacagcacaatgaaatggaaatcaaacaggcctggcgtggcgtgggacacactgggactgaaccttcgctgcttggagctcccggtttacagtgatgacggtatccacctcctggaaagctgttaaactactgctcattgaacctttctcagcaggcaccacgcagagcacctcacatatttactgctcacagtaatcctatgaggctgctactggtttacagattcactaatgaggaaactgaggcacagaaaggctgaggaactcactccaactagcaaagggaatttgaaccaggcctgctggactccagcgtcctcgtcacatgttgtaatacctctgaaccaggactgttccaattgtgactcaggtctattctgtggccttgtacactgtgtatactcacatgcccactcttgaatgaccacccgaagaggcggtttctactgagctctggaaaccagcaggtacagcgacctgtccaggagggagggactggctgctgctcctgggtggtaacaggaagatgggaaaccgctggtgggctgccacgggtacatcctaaacaggggcttccactggagtctgatcaggtgggcgaagatgtgacctcagcaaggccctgggtgaggtgattcatgcacatctattactaaacaaaaagctatgttgacctaaatagaaattaggatttccttccaagtcctgcacttccagcacacattgcagaggccagagccacaaagagaaaatgaatgggtcattttcatcatgttccattttccctaatttccagggccagaaaggcaaagagaaacacaaacataaaacataaagtgggaatgggaccaacttcctgggagagagctctctgtccccatggaggtgacaatctatggatcccaggtgcaggtggcgtaggcacatctttccctcctccacatccctccatcactccatcaccagtgctagcacagatggctttgtagacaatgcctcatcccttcctttcctcaccaccagccccaactcagagccaatgtgtgtgaggaagaaagaatgagcggagaaaagctcttggccaatgacctttccagaacgtcagttatctcagcactcagggcagtgatcttgctactggcttttagaatcacagatttcatttttagatctgagaacatctaacacctccacagctcagatctatgtaaggaagcctgctctcagctatgaggaaaaatataaaatgccgaatctgtggctggccccttggttcaaactgaaccctttagaagagaaaaatgcaagcagtatgaaaagtatgacaactataaaatcaaaaattccttttaatctcatttcatgggcaacactgatacactgtaaggaatgaaatttttgcttcatgtcaattttgctgggatttcacatgcagattaattcgttcattcacataaacatatactgctcttattcttgcctcaatagccaccctcactttggttacagaaatcctgtgtctcagaaaagacccttaacataacagtgagattcgctattccattatatcaccacctttgaagtgctgaacatattattaattccagtggtctagaaagggaataagtgggtcagaatagagaagtgaactgcttaggaacttggtcgggtgctctggtgggcagctttcaaagagttcccagtgcctacctcctttaacctctaacactaaccctgatgagcatcttctcttgaatgaccccatgagatgaccttgtcatccaccctctgcttcccacacctcagccaagcctgctgaccctcctgagttccccagctcactatgcactatgtgccaaaaccaagagatattctctaatcctgcctctttctgccccagacccaatgtgattaaatgtagtcttgtgcatttgtcttctttatctctccatctggctgtttctctccacttccattctgtcttttctagattactgcagcaacttcctctctggctgtatcccttttcaatctaccctgcatgctgcagctagaatgatctttccagaactgcgtctttaacctctttcaatgctgctcaactgctcacaaaatcaaactgagactcttaatcatggctcaccatccttagtggcctggcaccacttctgactcctgccctctgcactctcaaagttctagccacattctgcttcacctgctctttgtcccctctggaactttgcaagtgctgtctctctcccatatatctgaaatgcactctcctcgcttccaacgccaggctattttttcctcttctaatcttggcttggaagttacttcccctgggaagcatttcagtctcccaaggcttttccaacgtgcctctttaggaccctgtgttcaccccattgctgtaatttattaccaagcactgtgaaattacttttctgtctcctctaccgactgttgctgcagtgaaggcaaggacttatttgtagttgtaacctcaatacccaggatgatgactaaacatactagacatacgataaatgtctgaagaatgagtggagggataagtgaaggtgggaggcaggtgaggcttacttggggtcaaagctggagaggaaaatgtcctttgccaagctatgggtgacaccctcacagggagctccagagcagtaaaagctgagcaaaggccaaggtcagtgatacagcaaagagagaccaaagaaattgcccaaactgaagaagaatctggaagctgaagtatggagccatgagttggggagggggctggcgataagaagccttgggctaagggtgtcctggggaatatcaggtggcatctggtgtccgtggagaggtcttaagttttgtctgttatgctggaaatactcaactgtgtttaaaaggctgggatgttcttgtttaccaaagttccaagaatgatgaaaaatgtcgatgatgaagcaagaggggaaagactgaagccttcgacagactgaggcccagacaccctcttctcctagacatgcattatgcagtagggcagccatgagccacatgcagttactgagcactgtaaatgtgtctgctctgaatggagatatgctgtaaatgtaaaatatgcccaagatgtcaagcacttagtatgaaacaaaggtgaactattttacttatcttttttaaaattgatcacatgtcaaaatgttagtatctggatacattggagtaaatcaaatctattactaaaattaatttcacttcttttaccttttttaatgtgactactggaaaattttaaataatatgcagctcacatctatttctattggaaatcattgtcctaagttgtccctgaactttaattggtatataatacaaattaaaatttcaatgttactgctggataatggtttctaggtcttggttttctggtatgagtaaaataaaataaaaacattatagagacagtaattaagttcgtgacattttactttgtgagaaagtatgtatttttaaaatcccatcatttaccatcatcatcatttcaaaaagaaagagtatttaaacaccagaaaaggccacaatctcagaataattaacaactctttaaattgtaaaatttagcttgaaattgtaaaatttagaaaatctccctcctgtctcctctcttccccaattccatggatcatacctgcattcatttaccaactggcatctgaaagaactgttcaagggtttgttccactgaattatgacaagcctttgactactctcagcaaaaaacataattactgaacacagaaggccagacatctcccactctttgttctggaaccagcagatccatctcagctctcagtgctgctcaggatagcaagttgacagggtttttcaatctctggccccaatctacctcctcaggcagttctgctgcctgtactgactcgtgcaatctgggctcagaaggaccacatgacttaaagaacgtagactcctctggctgcatttaaagacctcctagaaatggccattactccaatgcaccaggatccttctgtttttctaaacaactaatcttgatcttttacattgcctagccccttccaagtgagtggaacactgaggtttggtggaaaccctgggggaagtggcagcttctgctcttcaggaagatcagcagatctatggaggctgcaaagaggtttctctagggacactggcaggacctgtgttagccggtaccaagcaccacccagacggcagctgtgtgtgcatgtgcgtgtgcgtgtgtgtatgtgtgtgtgtgtgtgtgtgcaaaaaagaatcttctcaaaaggcaaatgcagagcctagctgggacagaaagtgtggagttgggccaagacttatttttgaaatgtttcctaaaaaagataccttggtgtctgggaccagagctccttcatgtcttattttagccctgctcaaatcacatcatacaacagtaataatagatgacacaattgaatcctcactctgtctcaggtattcttcccagagctttcagcctgcacagtaactccccgaggtgggtgctgcaattcctcttctcatggtggtggagagggaaagtcacaatgagtgagtggtggggcctcaacataaacccagatggtctggttcccccctaccagtcggtgccctcacgagctccacgagaatgccctttgaagattatccacactcactgcctctgaaacctttattccatattggcttttctgtctttttttttttttttgagacagggtctcactctgtcacccaggctggagtgtagtggcaccatcttggctcactgcaacctctgcctccggcgttcaagcaattctcatgcctcagcctccagagtagttgggactacaggcatgcgccagtatgcccagccaattttttgtatttttagtagagacagggtttcaccatgttggccaggctggtctcgaactcctgacctcaggtgatccgcccaccaggtcctcccaaagtgctggggttacaggcgtgagccaccatacccagcccttctctctgtcttttatcttgaacgctgcatgctggaagattctggaaagatggaaaatcatgggtgtgggtcatccctcacttgctaaagcatagtatctccccttgatactcctagagctatttcatgatatttttcagactttccacctaaaggatcagagaagcatcattccctcctttcacctgaaaggggaaagttcctccaattgcaacagctataaggagcaaaagtaaggcctgcagccaaggaactccaggaatgtgctagactcagcaccctgagctcaggaatggtctgtttgagggtcaagggtcctatgcctcttccccaggggactcacatccgtgcgccattctggtctgaagcagggagggaaaaagcaaaggcttcccataccttcctgcaccttcgtacagtcaatccacccctgagccaatactgcactcaaatctgcctcttttttatatcaccaagcctgatctacacccctggtttgccctcctgcaacagcttcctaactattcttcccgcctgcagaagagtcacttccaaccactcctcccaccctctccacagccgttctctcttccatcttcctaacacactgctctcactgtaggaccctctcccgaccttcagagccacctgcagttaaaccttcaccagcatctcaaggcctccaccctcgtgttagctcttcagcaccctgcccccacattcccttgcaggagccttctggccctgctaaaccagcccagtcactgcccttgactgtacctgtgtcacaacctccacaaacctccctagattctgttaccttccctcctccagctgcccaaactgtcactgttgtgcagtttcgctgaaatcacttcctccaccacactccacatggccgcctggtatgactattcccctttctaaatcactgtgccatcttcctaggtaactactgccttcttgcaggcaggggccacgtttctacttctttaaattcctgtggacaagttattcaagctaccggagtcaatttcttcatctctaaaacaagggtcatagcaaagttgtgaggctgaaccgagagaacatatatatggtgcctcccacacatcagggggatggtatgatcaatacgtgtttgccaattgtggcgctggatttatgcgtgaacgtggataattctctgttgagcgaggatggttttaaatttcctgtgatttgattttctccctctgttctgaggattcactcgctcaccggcacctgcactcccaatccctgatattttcagtagcttgagaaggaatcacgaggtgcgctttgggcccctattcactcagctgatactgatggacagtgtgagtgccaggcaccgtgctaggctcaggagatgcaaagataagtcagcattcctgtgctagctgctcaggggcttggaagggtgatagacagtaagctgatgtctgcaatgcacagcaaggggtgctgctcagggtaagcatagaggatggaggggctgccaaattgtctgaggggcaagcggtcttcctgaagaagacaccctccacccagactcccaaaacacaaaagggcatcctgaatagagaaagcagcaatgatgaggcctgaatcctcacagcacagtcggcacaggccatggcctgatgggggcggccttgacttcagggttggggtggtgacaggagctgtgtgcccacagcatgtgaagagtttcaggtgaggagtgatccttctgcatttagaaagccagagtcaatgaggagggcagctagggcctgccgcagtcacccagacgagagggggcagcggctgagtttggcagcaagatatctcagggagcaagagatatctcagaggagacaacaaaatgggagtggggggagagcaggatgatgccacagatcagggcttgggtgaaagtctgaagggtggtggcacccggcctgagatgaagcagacgggagcaaagagggtgtttgctaccttgagaggcagggcaggaaggtgtgggacaaggagtacatgatgccaccttatgaggaatcaaggaggagagacagggaggagcagggaagcagaagagactcaaccaccacgccagctctggccaggccacggttatcatgagagtcaggaggggagagcagtttggataatacaataaagtttccatggagatcagggattcctcttgttgcctcagggacagcaaagataagctcaaggacatttactgatcttgcccctcactaggccagtgggaccctcactgctcagtgatccacagagtccccagcggattcctgcttccatcacatcccattgtgcctgcttactttgccagtcacctggggcctcacgtggccctcagcactccatcctgtgtctgccaccctcggctcagaggtctccctcccacagcagcccccacccagctgtcatctcctctcccgctcttttcatctcttgtcaaacacattttgtagttgctggcccccggctctaaatcactccctctgctggccttggcttccatccccagtatctttcaagcacaaatttcaccagatgtggcactgcagtcgcctcctcgctcattttgctttccagtttttaaagtaagtctgacattcaggcaaatggaatgttcagagccaggagccaaggccgaggcccagagctctctaaggacttccctgctcacatgccctgcacccagcccaccttgttctcagctccactgtgactcacatgagccgcagcaccctgactcagagctggagagcagggtgcagagcctggacctctctacattcatccatgtcacccgtttctccacccctggccctgttacctgtctgccctgccttccagacctgctttggcccacagctgcggagcagcaggaaagatgatgaaaccagaactgttgctggtcctgatgccccctcttgcctgggtgactgcagcaggccccagctgccctcctgatgccagtactaacttgactactcagggccacagctagcaaacagtcaccaagtgcttactagaggttaaagatgaggctcggcatttgacatcaattatttcacctcaccctgaggaccattattattcccattttacagatgaagaaatggggtctctgggagtttgagtaactcacccatggtccagctagtaagtgacagagatgttgtatgtcaaagctcacagggctaggagacctagcccagccactcagtcaaccagttacgttgcctgggtctcagcttccttctctgtgaaatggcaatgacctcttcacccaaagggctactgaggacatgagaaagagctgggaaagcacttcgtgaagtcctatagaaatacaaggcatgggccgagcgcggtggctcacgcctgtaatcccagcactttgggaggccaaggcaggtggatcacctgaggtcaggagttcaagaccagcctggccaacatggcaaaaccccgtctctactaagattagctgggcttggtgacaggcatctaaaatccaagctactcaggaggctgaggcaggagaaccgcttgaacctgggggcaccgtggttcgagattaggccacttcactccagcctgggctaaagaaatacaaggcatgaagagtcttactctaagggcttactgcatggttcatcctctcctgtaggaattatcccaggaccttcgtcccagcacagagcctccttgaaatttcctcaagccaatcctaccagccctatttcttcctggcagtagaggcacatgtgttatatcataagagccagtggttctttgaagcacttgggggcaaatggtaatggaacttgacagtgatccaggttttaaagggaagacatctgtgtgtttcagctccttattctagactgaaaaatgtgggcaggtcaccaatgtttgcagtcaaactgccttctacgtgatgtgccaactccaggagcaagcatctctgctgctgctgtgtttaataggtccggggctttcagataagtgagaagacatgtcaaatcagcctacatgtgcacctcaggctaggagaggtctggtgacctgcactgcgtggagggcatgagagggtggagaaggcctgcatgaagaaatggacaaggtggcaataaaaagggctctgatgctctgcagggccctggagtcctgttaggaagggaagtctgcgaggggaaagagtaatccagggcagggggaggggcaccactgccgagcaggagggcttcatgtttctggaaatagcgtccaacttacttagtacctaagccagtttccgcatgcttttaccggcagaagtattttcaaaccagcagacagagctggaactgaccttaataagcatctctggcttacttctctcatgttacgtgggaggaaacagacacccagggagctgaaggcattgttgggcagtatcttagaaagggcatgcactttcgcaggctcaggccagttatttcttccccttactttatcatgctgcctcacaatgttggacaaaatggcaaaaaatatccagaagaaaggcaggttactgaggggggaactgacagccaggccctctgtgcctggttcttgggcaaaaggcatagacagatgcagagagaaggggcaaaacgcttgctcgggtatgcaaacggtcaagaaacttaggaaaatgtgtgccacttcattgcagcagggagaggcaaatttaaaccacaataagacaccaccactcagcctcctggtaggcaaaaatgaaacagacagacaatagcaagtgattgataatgaggacttggtgcaacagggactctgctgtaagtacttcattaaatatttgatgatatctacagaagcttctaggggtacaccctacagaaacacatatgcctgttcaccaaaagacaagtagaagcttaatcatagcagctctcgtcataaaagccaagctggaaaaaccccaaatgagcactgatagtcgagtagatatagaaattgtaatatattcttataaaggaatactacacagcaatgagaataaacaaactgtgtcttgcaaaatgtggctgagtttcatgcacagaactttgagggaagccagatacacatgagtacatactgtgtaatcccatttatataaagttcaaaaccaagcaacatcaatctacagcttttgaagacaaggtagccacggagaattctgatggggcacgggcataagggtggcttctggcaaacacagaatattctttaacttgatgtaggtacttgatgcaggaacataggtgtgttctctttggaaaaattcttcaagatatacctgcaggaggtgtgtacttttccatatgtatcttatatttcaataaaagatttccttgagaaaagatgaagagagtttctggtgttgcggcagattttggttgtgcaagaagatttcaaaagccactgaactgggacatggaaagctcatgaaatagacaaaagctgcagccaaactcaacagtattgtcttctccacccctcctgtgttccccataacactgaggagagcacccccggaatgcagagtgcaaatccagggaatcttcttcacccctcttcctctgtcctttaaagacagataattcagaggcgagagaactgataccacactgcccttggtgttactgaaaccctgagttcacgggccagggcttattttcaaggctagcttaagggaccatgcctcctgtggaaagtgatctgtaaggtggggaggtactaggggcctggggagggtagtaaggtagctcccacttgtccacctgagggatttattcactgggggcattcaagttccatgagggcacactttcagtctgttttttttgttgttgttgttgtttttactgatctatacttaatagtcttagactcaataatttgttgaatgaattattcctggcaaatatttaatccaaatcagttttccatcctgggcattgaaaatgtctctacatctctttccacatctctttcccctgcctcattccccaggtaatgtgaaatgtaggaggcaaacttagggagggagaagggaaatctgtccccagaacaaagaccacttggtacctttcgaagccacacaaggttcttcttgggttacctgcccacaggcatttggcccagatggcagaacaccagatgacactatttattgaattatatggctgaaatgtagtattttagtacctctgggcaaagctaaaatataataatcaaaccatcttaattaggaaacccagaatcctcatctatcacctcttctctttccccaaatcacaagtcaaacacacacacacacacacacacacacacacgtatgcacacacacacacactttctctaactcagtgaactttagacataataagaagttttatgtttgtgacagaataaaataaaatatatggacccacaatctgaaaaattgattttgcatttcagccaagcatggactagctgtgtgaccctggacaagtcccctaacctctctgagcccgggtcccctgacctaggtgtggagttaatctgctagtcttgctgttctgctcaagtctgtgcagcccacactggtgctcagtctggaaacccagcagtgagtctggggatgaaggacagagtccttttccaggccctatcagctccttctcccctaagactagctcctgcttctcactgttcctgcctcacttcagaacgaactccccagtggaagatccaatgtccccaccctgaggatgaaaatgctttcaggccaagttctcatatcaggctctagctcccgggccagcagcctgttcagcctgcactttgtttgggacagttgtccagccttggggcaggggcaccactcctgcctggtactcttttctctgtcacactttggctttcttcctactggccatggtgctggccaggaatgtgttatttagggcatgtcccagtgttgctgtgacaatgaggcagtgacagtgtgaacatggaagcattccagggtttactgaataaactctaatctccttatcctgaattcaagactttgccacaacatgtccccaagttatcttccagagtattctcctccattcctcccctccatcattctacaccctaagtaaattgggcttactcctataaaacactggctcttctatctcctgatatttccttatgctcttccctcaacttgaaatgcctactacctggtaaaatcctacgtgccccactcgccagcacactaactgcagcccacgccatctccttcaagaagcctctgcctcccagccacgtgtaaattccttctccttcacaggccagcctaatgctattttgtctttttcacaggacagctcctaactcctgtgctgtgctgcatggctaagatggaaataactacacccaaaccagggacagggcaggagctgggtgcctgaacactgagggcaggaaattcgtgtattaattccaagagcaagggtatggccttagcgcaatccacatttgagcatcaggaattggtctcatgtccatttctcccactaggccatgagctcctagggcccactaggccatgagtggagactagttcctaacacaggacttggcatatggcaattgctcaataaatgtgtggagtaaaggaatgagcaaatgagtgagtgaatgaatgaatgaatgaatgaaatgtacaatgcaaggtcaacgttagcaggaattcactaggaaacaaggtgcaagaaaataaattagctaaggcagtttagatgaattctcatcagtgttgttgactggtccccttttgaagtctgaggagttaccccttcgggaaatctccctgaaactcaaaaaaacaggcactcaaagaacacaggaggggcctgcaggctcaggattcaaggaaatcaggagatcaagactggggaggaatcctgacccagaggcccttgctaactcctgtgctttgctacgtggccaagacaaaaataactacacagaaaacagacagggcaggagcccctgtggccgttcctcccctcttaccctggcaagatggtactgcaaactgccccgggctgtggacacagttctgctacagagccacttccaggatgtcctgcaactcttcctgctcttcccttcctcccccagaggaggagatgctctggagtgaactcagagatcaaactcagatgctctggagtgaaggcacttaggcccactatcaacaggctcacatcctgtattgaaaagtggcacatgggggaccagaatgtcacagacggggagagcttgtttgcaaaagctaagtatctgtgatgggctccccctcccctcccctcagccttggtgtggaatcactaacgctgtgctgagctagtggaatagccttgactctgagggaatatgaacattttttatgctttgccattccagctgtaaagatttttatcctattactgctaagtgacgagtacaaggagagaaatgatgatgatctttggcagccattccaaccgagtaaatagaaggagggagaaatgctacgagaggctgggccactgccccttcatttcccaggaggaaaaggagccaaggaaaaatgtcttcctggtgggatgtatcaaagtgtagaattttccctacaggcaagtgatgggcgccccactgtctgagccatttagcaccgcactggacaaaggctgggagaatatgtggaagaaaacacacagacccagccaggccaggcagaggtgacccaatgaggcttccccggctagagtttccagcccatggctcacgagctcagtccaccctgaatctgctccctgaaatcaaagcaaccccataataggcgctgctagcaagaacatacatatgctttatcaaaatattccctccctcctggaggggtgtgtctctatttgtggctgcttgtctgccagatgttttatgtaccacttggataatggcaaatccagctgttgtcaccagaatggggtgatgggatggaagtgggatgactcgaaaatgaggactacttgttgaaccggtcaatgctttatgtattgaaatgtaattgtggctaatagttctctattgtattaaaatgtaattgtggttttttccactaaaggtaatggcaaaaaacgcaattacttttgcaccaacctaacatatgaacagcagaactcctctggacaatcatctcagactcaccccagctggaagttgtctcttccttacagtgaattcgttatttaaaacacatcacctacctcccacccccagtacatgtagccccattttattcatctttgtgatctcacaggacttaagcagtgacctggaaatgaagtctctcctctgtgtgagcagaattgttgacctcatgaggggaagttggagctaggatgtccccaggcaagctccatgttttgttcgattgaggtgagtgggggccagtgtatgagtatatatctggaatgaagagaccataaatggaagaatgcattcatctataattgtgtggagacttgaggaatgatgaagcttcgaggttagccagtctaacacctttatttcacagctgacaaacgaggctgagaagagcagggatgtgctgaaagccactcaggggtaccttgttcttgccttgtcacctagcctgagactagggatgaaaggacaaggttgcagcagagacatgcatgtctacaggctgacgacagaggtttccatctcaacagtgaagatcacatcaaatgcatgtaaggggtgaggtgggcatgggaaggttgctaagcccaagcatgaatgagtagggcatgcctgcgaagctgtagaacttaccttttgagccatactggatgtagcatcactcagtgcccactgccaaggaccctggaaatcctaagaaaggctcaaagcctgcccctgtcttagcttcttctactcctgccctctgccatctcacactccacatagactggactgtctctcgtaaaataccgtggacttcacaggcgaagaaccaaaagaaaaatggctactcgcttccattccagatacggaaattaagcccccaggcctctctgggcttcttttatcacatggtgccctgcatggcttgcttgtaaggggtccacaccgccggtgcatctggggattcaatcagcacagctgcctgctgggtgaaacttctacagccttcctcctccctccccctcctccccctcctccccctcctcccccacctgctgcctcccacatcatgcggcatcttcagattcctgagctgctcaccccaacacccgccctcctggcagcacttgctctaatgctcagctaatagttctctgtttcaggcactgtccaaacgcatcctataaatcagaatccaattactgtggtaagaaaattggaagcaaatttaataagctcagacccctcccacatgcggtttcttcacccttcttttttcagtaacgagaactctttaagggaaaagcatttttcctttaactcagagtctattctcctgattccttctacaaggcccctgaggatcgaagggtgaggagaaggggcttcctttagctcctcttttccttgctacacgtaaagcaggtgggagagggtggtcaattgcttttccagggttaccctccctttcatttgttcaacatttattgaattcctatcacacacaaggaaagcactgtaggagatgctcaacatgttactcaccccagagggcaactgatatcagtaggaccttagctgcaaggcatgatgggaacacaaaggaggcccaccaggggcaaagactgtatcaatatgattgggtgtcctcaaggaaccagaagtccagagtgggccaatggcgatggggccaggagtgaccccacagtaggagcttctcggtagaggtgatgccaattgctaggaggatggcaggacatggagcctgtgaatgaagaactgggaaaggagggaggagcaagaaggaaccagagaggccaaagtctccgcagagcccgagacagaagtcatgtcagtggagaaatggagagggctgtagtgtgtgggggaggtggtggccttattgcagggcctctactctcgactcagaccctcagccttttggctgcaccagtcctacctatgaacttcacctgggccacaaaaataagccacaggtacaggctgatgctctgtggtttctaaacttgagccggcatcagaatcacctgtagctcttgccgagacacaatcagttcagatcgctaaactccacccccagagtttctgatccagtagttctgggtgaaacctaagagtttgtgtttctaacaagttcccaagtgaagctgatgctggtggcctgctggtttggggaaccagaatttgagaatagttgttctaagtccctgctattcaaagtgtgatccgtggactagcggcgttggtatgacctgggagcttgttagaaatgtggactcacgggccccatctcagacgtactaaatcagattttaacaagatcctcagaggggttctttgtttgcctatttaagtttaagaagcgcttacctagagcagtggttcttaaccctggctggggagcttagaaaagagatacttcagctggttggagtctggatatcagcattgaaagaaagcaccacaagtgattcttgtaagaagcctggattgagaaatgctatgaccgatgctaaggaccagcaccccacactcatggggatttgacaccactcacttccacttctctggcattgaacctgaccttgaaacccacctctgttctcctctgcccccctcaccatccctgacaacttagtgatcttaatgctctttcctggtacttggggtatagatgtgtgctccgtttgggggtttagttgcatctcttgcctgatcatcttgagttttctcacagaaacctctccttccattcctggcccttcagtatcagcctacccacataccctgtaataatagcaacaactagaatttgaaaaatatttactattaggtaggtaaataccttatatatatatatatatatataaaaatatatatattagtagatatataaaaatatatattagtatatataaaaatatatatattagtatatattaaaatatatatattagtatatataaaaaatatatattagtatatatataaatatatatattagtatatatatatattatttgatctttataaaaactgaattaggtaggatcattattgtgatttttacccctattttccaaaagaggaaactgaggtacagagaagctaggcaactttaagtttactcctagtcagcagcacaaccaggactgtaaacagggcaatctgatcccaggatcagtatccttagcccctgggctattactgccttccattcaactctgcttttaaaaagaaggcttggccttgtcctgttgctggtgatggggttgataaagcatatttacatttcatttttgagaacttaggtaaaaagcagaggtggattcacagcagagatcttcactgcaatttcgcctcaaggggatgtctatggcaaggtggggagacatagctggttgtcacaacttggggaatgtgctactggcatctagtaggtagaagccagggatgctgctgaacaacctacaatgcacaggacaccctgcaacaaagtattatctacccccaaatttcagtagtgctgcagagaatccctggtccccagaacacaggtcaccagcagcattagctgttcagttctgaggcagacagggcccaaaaggccccagggccctgtcagcccagacaggcaagctccaggaattgcatcaggatgaagccgggacacagtggggaggctggaatcacagaaggattaagagacatagctgatgactccaacctagagtcagggtttccctgagaactaagagctggaagtgtgagatgagatcctatagacggaagggcccagttgaaagaagaaaacagggctttgctggcagtctttggagctctcatcaccacaagggtgacaccagtatggtgactaaacttggcttggagattgctgatccagttggtggcccctcacagtgctagcctggggctttgcacatagtaggtgatctatatccctagatggctgctggtcccatgtgcttgccctcattctcaatcacctgacctttccttttcatgcacattcagagtaagttctttaagtgtgaaattctctgagtaacacaatcccagctcccacagggcaaggctcgtgccctgaggcagacatatggctgatacactttccctttttgtcttcccaaagggagtctaaattctgtctaaatcctctcttcccttcttgctgtaatcccagcagatcacactttcttaacagacggaacacactgggctaggtgcaaagcccggaactggacaccgtgagctgggctccttggaaacaggctcagttcttcatcacctaccaccacatatgcctagcccttgcaaaatgttagtttctgcctctaaatggtagaagaagttaagtgtagaaactagtcctgctcagggtatccccaagtacctgcctgctcagtgaattacttgttgccttctttctgcaggtgggagcagtcacaggtgtctctcggggggctgtcatccaggtgcgccagcaactttcctggctaggagaactccctttgtccctcaagaaagccctggcctctggactcaggacaagggtccacctgcctaagacccagcggagcttctcaggttcctgtctcctgtctcctccctcttcccctctctcctatctgcagtttctgctcggggaaatacaataacctaatatttaaataaaattctctcagatgccaaggagtaggacaagtgcccaggaatttaaacaggaataatacaagactctgattttcagacactttcaggccagtagaagggagtaagcaggtatagcccacgctctgggtctttggcagtaggggactgccaggaactgctgctaaggcagagcctcatgggtccctcgaggggagagttaaattcacagaaagtcagagttagaagaagctgtaatatcatctagttcaccccccttgctatattcatagggaaaccaatacttcagctgcttttggcaatgatggggattaacaaggactggttgagtcactccaaagcatacatgctgtttagaagacaaggtttccaagtagtgcaacctagttggggaaatggagtccgccagccttcacagggtaccatcttaagaactgccagaggaatcagcctcataagtcatgaaaatgcctgctctactgctcataaaccccagtttccacaatgtgagtacccacagacccaaacaaatataagaggctaagaagctaacaccagtaccacagcttctcagcatgccagtctgctatttaagactggtgcaaagtcaatttcctgcagcagacaagaaaggcccacacaggtctttggcatttctgggcccccagtttggaggccaggagcccgggagtggaggagctgagattgagactgacctgcttactaggtcttaccagggagcataagggctgctatgactctataaagggtcggtcgtgaggcagaaagtcttcacaaagcctctgcttgctaggaaacaaaactttctacgtagctccaggcctgatctctgcaacccactgaaggcatggcctgactaaaggctggcaggatggagctgtgtgaatgagcccctccaaaggcagacagaagaaccaatggcaagctggctcctcttctcacatggtgaaatgtccaacggctggcactggaaggctctctcccagtcacagaaaacaccgcccacctacctgccccagggtccaatcatcctgccttcccctactttggaacccagcctcgggtgtgggaatctgccagggaaaaacaggccttggctgtagtgtttttggtgctctatgggttcgtgtcaaatgatccctaaggtgaggagcaggttaaagtgaaagaggccacccctgcccccagcctcctggtgggacctgcggggtttgggattgctctcagcagtaagcagtaggcaacacagccagggtcaatcaccaaatccgaatccctttagtgttcaactggcagcagatggtccagcccggttcttagcactggtgctgcatacagcaggccccagatcaagcctgctgttgatctcttttgactgcgggggtaacagagtgggagaaggaggaagtacctcagatggcgagtgtccgggatggcccgattgctggagatccgctcactctcccgctggttgaaagcatacagcttataggggtcgtcaccaacgcgccactttttggcattcagataccgccgctcatcaaactggtcccacaggtcgtcccagtcagcgtccgaaggctgcgtgacacgaatgggaagtctgtgagaacggctccctgtcctccactagcccccgtctgcctatcagtacccaaccccagagaccaggcttattctggcaaggtttggctcaaagatggggtcagaagcagaacataaactaaaccatcagcaacaataaaaacagaactatgacaacgatggctgccaccattttctgagcacttctatatactgggtgctgttctaggatcttgactcacattacttcatgtagttctcagagcaattctatgagagggatgctgtgcatacccttattatacagatgagataacagcctggagaggtaagtaccttgcccaagatcccacagttaggaaatggcagaactggaacttcaattctagtatcccaaccccagaggccatctctccagggcaatctgagaatacctggtatgaaagtgcttgccccatggctggcacagagtttcatgaatgactgtcattcctcctctgctgtagaagggccagcgatgggaaggaaggaggagttccgtctacagtggtgtgctactcaccaccaccctatctgttcctttcttcctcctacccaggaatctggtatttttaagaagcatcaatgggggagtgagtaacaaccctcaccgtacatggatagagcacttcagaattgtaaggtggcttctgtattcatgatctcatttcatcttcacccaaaccttctgaactgagtagggaagatgaagttccaaaaggttgactggcttgtctgaggtcacacaggtgggaaggggcagagctcaaagcagagctcagtctctgtggcccctccagcagaggaggcaagggaatgcctcctagccacagcccaggctgcctagtgtgggtctgccctgcccacaccggttccacagccaacagactgtccacatagctagcaggaggtgtggacttcaaggccttgagaagctggacacttaaatttggtggtcacttcccaatgcatgttagcactctcacccctggggaggagctggtctgtatctaaaacagctcagaactttcaagttcataaaacataagactctgtgtttccaggaagaaagtgctgatcaggttctgattggaacatgagggttgttggtatgctggggctgacattgtccctgagggtgggatgctcattcatgtgttactgaacccagtggccgtgcaagtgtctcaagctgcatgggtactaactaagggcactgagctgagagctgcccatcccattactgagtagaatgcacctcctgcactcgggaaacctgaccagggtggcccagggcaggctccacagacagcagtgcaggggcttggcccacgtggcaggttaagaggggctgctggccagtgtgcatgttcatctgggcaccatggtgagcttatccagtaattgatctctctctctctgttacctcctttttaaaaacagcattctcctgctaatagcataaaatgaagctttggagaccagagatttttatccaataattgattttattaatgtcctgtgatactgcggctacagaacattctagaggaaatcggtgggggtgagaaacccccagcctgtgttttgcaatgtcacagcctgatagctgtgacctctgcttggaacatcaccccacggtaaccttgaaatcccatcctcatgggaagggccatagaactgtctcccactggcttgtttccaatttaattcatcacaattttctaaataagttgtgagcccttatggtgctccgagctagagaagagcgatgtggagctggaaggcccctgctctcgaggggattgcaacattgcagagagacatgcatggagatgcctgtaacacaccgcaaagtgagttcaattacatgagcacgatgacaaggctatgagagcagaggagtgaggggaactggggacagcttcttgagtaaggtgtcaaatgagttcgatcttgaaggatgagtagggatcttactttgcttaagggaggatagagagggaaaataagtatgtagcaaaaagccagataaaaggcagtatattagtcagggtcctctagacaagcagaaccaatgttgtgtgtgtgtgtgtgtgtgtgtgtgtgtgtgtgtgtgtgtgtgtgttcatgtgcatatgtatacagccacatatgcataacaacatttcagtcaatgacagactgcatatacgacagtggtcccatatgattataatactgtatgttcgctgtaccttttctgttttgatatgtttagatacacacatacttaccattgtgttacaaatgtctacagtattcggtgtaggaacagctgtacaaatttgtattatagcctaggagcaacaggctataccttacagcctatgtgtgtggtaggctctaccatctaggtttgtgtaagtatatcctatgacattcacacacaaggatgaaattgcttaatgtttctttttttagagatggggtctcactctgtcacccaggctggagtacagtggctcaaccatagcttattgcagcctcaaacacctgggctccagcgatcctcctatctcagctcccaagtagctgggatcacaagtgtgcaccaccatgcccagctcatttttttacgttttattttttgtggagacgggatctcactatgttgcctaggctggtctcgcactcctagcttcaggcaatccttccacctcggcctcccaaagtgctgggattacaggggccaccatacctgggcactgcatagtactatatgatcttttatatatatagtttaagttgacacagaaaaatatgtattataaataggaattggcttatgtgattatggaggctgacaagtcccaggatctgtggtgctggagatccagcaagagctgatgtttccagtggagtctgaacgcaggaaaagccatgtcgcagctcaaagacatcagcaggaggaattccctcttagcctttttgctcttttcagaccttcagtgaattagacggggccaccaacgctggggagggcaatctgctttcttcagtctactgattcaaatgttcatctcatccagaaacaccctcgtagacacacccagaataacatttgaccaaatgcctgggcaccctgtggcccagtcaaattgacaaataaaatgaaccatcacaggcaggaaggcccagagaaaaaaaatctgttcagggaatggctaactgaggaatagcaaggccggaatgtggattgcaaagaggacatgagtgaaagaaaactccagaatgtagttgagtctgcctgaagcaggtcatggagaaaacgtctctggccacacgtggaggacaaggagaccagctgggaagcggcctcagccatctagccaggtgggaagggacgctggaactggggcctgcctagtgggtcattgcctccctgtgctggagaggcaggtggaggggcaggcacgcatgacgacaccagagagggtgggcacaactgacctcttggcctcaccccccctctactctctattcacaccagatagaggcatgggcccaagagggcccgaggctgctggtttccctacagggcagctgaacatcccagcatccctggctacagtgccttctgggagcaccatgtgctgtgagctctccagaattttggaactctggaattctgtcccccagcaagccagagcagcagccaggctggcatgagaaattgaaagaagtcatggaaggtgtcctcggaggggcctgttcccctcagactgtcatatgcacaaagcgcagtcatagtctgctgcactgagaccccctgagggggaacagcccatactgggagctgggcttttctacatcaatatctgaatgtattaaataatggtgaaggtgtgtttaaaataataccactacataaagaataaataaaataaaataatatcactatttcaatagcactttatattttataaggcagcttgcacgtatatcatcatgcaatcctcacccaacccctatatgtgcagggcaggaccagtttagagaggttaggtggctgacccaaggtcatcggctgttaagtgatggaaccactgatttaaacctcccaacaccaaagacagaaacaacaagaagcatctcctctactgagggtcggtaggcagagaaagaccctgggagttggcttccaagctcttccattcatgagtccccacatccagcttccaagagcccaaagtgccacaggagggcacagtgtggggtgttctggccacaccatcacaggacaccagcctcctccctgactctgcatggggcctttgcagtacattgtatctatactgtgaattccatttcctggctcatacaaatatccgggaaagcttctgaacacacatgctcaccttcccacacttccctggtacaggaagtgatacgtcccgggaaaacaagaacaaatacccaggagctcccaaagggctccactcagaactgggcccactcctgtggggccttcatcagcacccatggcccccaagcaagcccccgcttcactttctgactagaatttattcaacctagagggaatgtgtttcaaaagtatgatgccacaaacagaaaacacaaacgttatcccgtttaaagttttatttttaattaacaaataatatctgtatatatttatggggtacaatgcgatgttttgttacatgtagacactgtggaatgatcaaatcaggctaattaacattttcatttccttaaatatttatttatggtgagaacatttaaaagtctctgttctggctattttgaaatatgcaatatatttttattactaactatagttattcctcctgtctaactgactttgtactctttgaccaacatctcccccagcctctggtaaccaccattctactctctacttctctgagtttgactttttttaggcttcacatataaacgagatcattattcagccttaaaggagcaggaaattaagtgatttgtgacaacatggatggatattatgctaagcgaaataagccaggcacagaaagactaagacataatcttttcaacagaaactgtctcgttaagtctgccaaacccctggccaagaccattgcttaaataatctggcatcaaaaactaaagctcgatggcacatccgttaagttgcttaatttctctcctcccaccatgcttcaaggagaaatcttgaatctccttttctccttccttccctgggactgtttttactccctctcacttcaagcagattatctggctctgaaatcctggtgtatccctcccttctgttaggatttaaagctgttgtacattcccactcatgcttttgtctctctcccttctttcctgagcttggtactactagttctctcttactgtcccaattgtcttctttttcaccctgaaaatgagaaactctttatccctttgatacagcttctatcctaccatgaactgtgtctgatcctgaagagaacgtctcaaatttaccctgtaataaatcagctaacacccaggaagaatacttactatgtgtcataactatttacatttaatattcacaataataggtaccaatattacctttccataattgggggtatgtaggcacagaaataacaggtcccaagtcctgtgtctgatatcacacagcttgtcaatgctggagctgggattagaactccggcagccagctccagcccccatgttctttgccattaggcagcacggccttatcacagcctcactgccattttcttggaccatcttcaaagactcactatctgtgcatttcctgtcattttcctcagccaacttctttctttgcttcgggctattcctccttcaaaggatgtctgcactcccttcaccatcagcccctctactcttcactctccttgctgagaaacccttctcctcccagcagtgagcttattcctaacagccagggccaaaaaaggaggtattctgcagctggattcctgcaagaaggcggggatgtgctgccaggttaacgtagaagaaggtcagagtagaaaacagcgatgtaaattcttatttaaagaggatatcatgaatctatccatccaacgttggaagcttcagcataacatgccactgccccatggacatccctcctgggtccagctagtgacacagaggtcccaaatagcccactccaaccttaaagaactgcaacttctagatatgtccttcttatattgatcaagaatctgtctcctggtaatatctcccttttggatctggttatgcccccatggccatttggtactagtctaatctttctctttcatagtcttcaaatatttagtggcagctattataatatttcccagatcttccaacccctggtaccatcactgagatttgcacctccgaaaaattaacacacaggagtgtgaaacaggtagcaaagggtctaactgttctagaccaactgaagtcagatgggttcatcaaggaattcaaacacagtggagaccctgccatatgtgtgctatgaaaagggagatatcacccagcatagaggctaccttttatatcaacgtctcatggacagatgttgttctgtgaaaatgctgtgcctatggtaatgcctgccattcactgggcacttactatgcaccaggctctacaccatattttatcaggaggagaaccctcttctcctcacccaccagatcatatttccatggaagagttatctcctaagaaaataaaatatggtgtggagcctggcacagtcagtgcaggagaacacgtaaaaccctatccagggcattgctgtgagtgtcgtaaacacttccagtgtttctttccatcctttcatgctcctccccaagagaggcaaaactattctcaccggttggagccacacatgttttgctggtgagcaggactcctgtgtggtaaagccatggcctagccctctagtctgcacttccactgtccaggtggaacaggttgtcctgttctatttgtccctaggtagtaagcacacactaggcttactttctagaagcaagcctatctcacccaagcggctgtttgaatatgtagatctggggtctgtgccaccatctctccctaaaccctgagtgttctggtcccttagtttagagctgaagtggggatataggaagctccacttcatcctcaggcaattccacgttgtccaactcagcttttacccaaagcctttccttaggattagaggagcttgcttgtctcaggtcatgaaattaataaaagtattattcgtttcccatttgtttgcagattcttgtatgtgtttctgtattggtcagggttctacagaaaaatatcaccaactgtgtgtgtgtgtgtgtgtgtgtgtgtgtgtgtgtgtgtatacacagaaattgagaggacagattgattgattggctgattgatttctaggaaattggctcatgtgattatggaggtacaaatccaaaatcctcaaagtagcctggagacccagggaagagctgcagttgaagtcctaaggtggtctgctggcagaattccttcttgcttggggaggtcagttttgttcttttaagaccttcaactgatcggatgaggcctacgtacattatggaaggcagcctgctttacgcaaagtctgccaatgtaaatgttagtctcatccaaaagacaccttcacagaaacagcagaataatatttgaccaaatatctggacattgtggtttggccacattgacatataaaattaaccatcacatctccccttattagaatcccagagggaactagtgagtgaggggtacctaaagtgaattctaacccccacaaacttaagatatagtaagaaactatatccccaattttcaaatgaggaaagtgaggcacagggaggataaatgatttgcccaagttcacacaactgatgtctgtctcaaagcctgtactgtcttccctcttttcaacagacctagttttaagtagctgtggggccctggagttctcgtctccatgtagccaggctatctccaggaccacagccagctctggctacctgatacccctcagagtgcccttgctttccactagctggaagcttctgttatctagcaccacggcaaaccagatactcccaggggactcttcatgctaaaccataactagattctacaagggttctgatgcatttctggtctttctagaaggaaaatcttcaacatgaaagaaggagtgaagccaggaaaaaaatacaggatgcggaaactagaggtagggtagttgaatgataagcagaggtaaaatgtgaggctgccctcagggtaaaggtcactgagaaaataaaccgtggctcccaaaaggtggaaaagctaaacctgagtcttctgtaattaagcccaagaaggggacaaagtggtccagatcagttgtaccctggctcccagaagaagcaaatgtaagtcctatgtggaggaaaacatctccaatttaggaccccagaattcccacaaagctcatcaaaagatgaaaccacaatacaaaattaccagacacacaaggaaacaagtcactataagacaagacaagtctacaatgtaagaatcagtggaaactataaacagatttagatgctccaaggactctggatacaggaatactagatatagaataaggcataactgtagataaaatgtttaaaatatggtataatgtaacaaaactatacttgtactccccaaatgtatacaaataaaaataagtaaaataaaatatggaataaaaattagtaaagaacaaaagacaaaaaatggctgggtcgatttgaaaaagaaccaaatcaaactttcagaaatgaaataataatgatggaaagtcaatatcaaacaggcccaagaaaattgtttataatctgcgaagcattttcacttgaatatctcgtttttactacccctatgaagtagccaggctggttatactgttaccacttcacagatgaaaaaactgaggctcaaagaaacaaaggggcttcttcaaatcatataaacagtgaattcaggccaggcgcagtgactcacccctgtaatcccagcacttttgggaggctgaggtgggcggattacttgaggtcgggagtttgagaccagcctggccaacatggtgaaaccccatctctactaaaaatacaaaaattacccgggcgtggtgatgtgcgcccgtggtcccagctacttgggaggctgaggcacaagaattgcttgaagtggggaggcggaggctgaagtgagccgagttcatgccactgcgctccaacctgggtgacagagtgagactccatttcaaaaaaaaaaaagtgaactcactactgagattctaatccaagacttttcatttcaaaactgtgttccttccatatcaccagatgctccagtcagccacaagaccactcttccccactgtcagctagtcataaaaatacaaaagtatctgcttacccctatacctttctgttgtccagccagttagggagtgactatatttttccaagggccagccaagagagggagacggtgcaacataatccccagtgaaatgctaacatatcaccatatgctcccatatcatactgctaatataactcccacctgcagagaatggatggtctgggaagaggatgactgtcagtggcagacattccccacagcgtgcagaacaagttccagtgaggaaggaggggcacccagcccttcgcttgcctgggctcatgcaaaggaaagagctggaaaatcctttcccctcaccgagggaccccacatcaattatggattattagataagatcttcattttaatatttcctccatgtattatcaccttcttcctctcactggaattctgtcttgggagttatttaactgatgtgcagaaatctaaatttaatttattatgctctaactcactttagaagccaaattaccctgcactggagaaggatcaagtcaatatcccacttggctttctatttatcttctgtgggggtttctctccttctctttagtattcatttttatctcaggtactggtaataaatttaaattttcctcagaattaagcaattgctccttcaatgttgtagtttaatggttagtattaattatatgaaaggcactccttaaatagtttgatagatagaatggacatataatagaggaagaaagggcaatttctcgcaccaaatgaggtagcacataattcagcagggatgagtttacttttctgttctacctcctcctgtcccttttccccactttcctcctcaccctcctccctcaacagccaggtgcctagaaaataagtctgctaagagttgctctgctgtggcatctctgagcccccggagggtctgccagccaggccaagcctggatccctctttagtgtgggagtctttttccatttgatttctctctcatttagtctctgacaacaaaagcaaccactgcccatctctctcctccccaccacttcgcccataaacactctccccacccatgtctcaattgcgctccacatgcattacaactttgggggaagcttccagctttctggaagaagaaaagttccaataattattataattgcctaaaaattccaacagtgaaacataatatgattaactgaatggacagaagcccggtttttgtttctggaatagaaaaagaaactcacatatttggaccttctatggagattaatttacttacaaattagcacgagaaggaggtgccagggaagtctaagtcagcatgactggggaagcgggcctggctcccaggcacgtgccaggaagcgtgagctctaatgctgatgtatctgcttccttcttatcaacaccctgtaaattccaccaccaaagactgaacccaaaactcccttatgtcgatgggcatcctggattgctagtcacttgtctgaagaacacatcccaattgccggtggacatgaggactgagagagctggtcctacccacacgctttatttctgcatccccttctctttgtgttcagagaccagagcggcaagctggtcactggaacaggagaagagtctgtgtcctccagctctggtacccagggagcaggtgatctaggaggcagggagccaggtatccacaggggactcaggaaaaaaaggatttggtggactgggtggaagcacaggagggtgaatttgcctataaccaggaggccaatactggaagagaacaggcactgagaacaggaaccagtacccaggagagtccaaggggagggattggatgtaggtagagcaaagctggaagtgactcagagagggcagcttcagctggatggagctggatagagctggatgctgaaacatgctgtctctggtgtgcacagttgagccatcttggatgcagggtcaactcatcagacagagggcaggtctgcaagggtgaggctgcagccatctctcagagacagcaatatcagagaaaggaggccaaatcctcccagggtggccccacaatgtggccagagcagcctccaacaggacagggaggggccgagtcagatgcccaccccactgaaaaccactaggaggaaaataaccctaaaaataagatttggatttatcagggacagagcagctctccctccaaaagccaggcttctctcccctccttagctcactgcaaaggactggaacatatcttaaggcaccatcagaaagctctctagccataagaaatagctacagggaaaagcaattttcaagaggccctctgaaccaaggtatctagcaggggtcatgaatgagcagacctggagtcactgagaaatgtgagcgagagtggatggcttgtaggtgccgcacaatacctgcctagttacactgctttaaacctgctcttgggcaaaacaaaacatgcccatgggctgacattggcctgctggccaccaaattgtgacccctaggacactaagggaatacaaggaaaagggtaaagaacggaaaagaagggaagaatcaaacaatggaaaagtgatcatagtaaacattatgcatttgtgatttttctccttcaagggatcctttgttgttttcaacccaattttagctggacagaaatgcagccccaagagcttctgtgttgtgtgtgtgggggtggggagtggagatgggctaaaaagggaagcgcagccccagggatgactcctctaattccagaaagctgggtcctgagcttggctcagctaaacatatcctttctggtcagtttcagaacctcgtggtcagtttcctcctcctcccaaggacaatactaatcttcaccctcacccagcttcatagcccgaattaggcttcagaagtgagatgagacatgaaaaattgcttggtaaaacataatgcatacacaacatattatcattacaacatagctgtggttactattatttcttttggtgactgaatgctaatggagggaaaacgcaatttacagtcagtcaatttaagtttagctgcttctcccttccctgtggcagaaatggggtctctgacagcatccacagatgaccgggtgcctcacctcactgtccgtctgtgagaattggtcattatcaatgtgaatgcttcctgggactcagcaggtgttttctacccaaagctccatctcacacgagtttgagcacagtgccatgcaaatgataagacaagaaaactattttaagaagcgtaatacataaggttattatcagcttagaaggctagaaattgagctttgtgctaacttgctttttatgcacgtggagagtgggggctggagccagcacagaagctgtgcagggtgattctggagagagacttgggtgagattagaagcctggacctgcctgagaccccatactccgaggaacctggacttcagagcttcctgcttgacttctggtcccttctcctcgtctgaacttagtcccgaagggacttctccatgcctcccaggactttggctccatgggctggaatggccggtccaacagtcacactcacgaggaatgtgtttagcatggtttgcagcttcctcaaatctccctctaggttcttgccaggcaaagataaccttgagagaaataaagatgggaagctgtgggaagccaggcgaaagaactggctttaaaaagtgactacttctcacactagatacaatcacccagaataatgacaacgacaactactgcaactaatagtggtgtagcgtttactacacaccaggctctatcctaagaatgtccctcgttctatactcagaacaaacccaaggcaggtgcttctattaatcccattttactgaagaggaaaccgagtttcatggtgctaacgtgacttggccaaggtcacacagcaagtcagtggaggtgctgggatgaaacccaggcacgcagattccatgcacaaccttgcaaagtccctgccatgataggggatcattcatagagtgaggcttccaaaaccagtgcctgtctggagatagacctgggaaggatgaaggaggaggcatggcaggaagcacagttgtacattttctgccaaggttattctggaacccccttccttaatccacgtgcccaaaggtgctaaactggaatatggctaggaagacagtttcagagtcaagtgcccctaagccctgccactcaatccccaaaggtgacattagcaagaagcttccagctttcagctgagcagaatttgttcccctctcttctacgcctgctagggggaggatagatctccccagatagtatgtacagcaagggcccagagcttagcacattttctgtcttctctgtaaataaggtgacatcaagataccctctagctctctcaaaactaggtcagctgctgaatatgtaggtgtgggatgggagcgaatgactttgaaacgactttatctcgtgggactctgtgggggctgctggctggcttttaatagaaaggactctttttatgtcaaaagcagaccccgagtatccagacgctgtgcctgctgaatatggatagggcaggatggctgcctcaaccaagggcgggtttagtgctacaggcgacgtggcaagtgaacatggcagtgggctgagaagctgggagaaatcctacatgcctgatctcaacactggccatctccaaaacgcagcaggaacctcgcccagggaatcttagatgaactatcagaatgggatttatgatgcacttgcttatgtaaacaagacctacagggacatttccctgacctcgggaagcataagtaattgctccccaaatgacacgcgtgtcaccaatcattcttgtccattcatcaaagcactggtggcatgatcccttctgcaggtccatcctgaactgttggaaggatgtaaggtgttagagtgacatttcgaatgtctcccacatgaatccaacttctttacatccacagtggccttcttttcgctttttcagaattaggtgtgctctttaatcaaatccggtaactggataggaatccagatttgcaattcagatgcattgggaacagattaatcatttcaccagagctgctttggtttacgttttactttataaaagtactcactgcaagattcccttaagttatccgtttccttagtgcattaaaatcagattctggagacaaagaaaattgagtatctaaacaaatttccagagccatattctggaaatgagattaaaattatcaaaacccctgtcacccctttgcctctgccttcctatgcccttgccctcaactcgcagtggcagggatccaaagctctctggcccacaacctctgagcagggcatttccctcctgcaattttgttatgctgtgagaatggccaaggtctcaaaataactctcttcttcccaagaagaggaagtcaaaaccaatgggatgaaccccaaccctcagatctatttattcatttatatattggagacagggtcttgctttgtcactcagctggacttcagtagtgcaatcattgcttgctgcagccacaaactcctgggctcaaacaatcctcccgactcagcctcctgagtagctggctgggactacaggcacacgacaccatgcctggctgatttctttattttttatgtttttgtagaggtgaggtctcactatgttgcccaggttggtctcaaattcctggcctcaagcaatcctcccatcttagcttcccaaagtgctgggattacaggtatgaaccactgcaccctgccaaccctcagatttttcaacaccatcagctctcttcagtttccaaggaccagattctctctgaggtcccttccttcagaaccttagatctgcatgggtgtgacatccacgtctcactcactaaatggctccccccagccttgctgtctccagtcctgtcaaagagtcactctcagcacattaagcattaaggctttccaggcagaaaagatgactgtaccttcttctcgcctgcctccaaaatcaaggctggaagagaggcagccagcatgagtggtgggaggatgcggtgcatagagaaagtaggtcattagtggtaaagactacaattttaaagcggttgttaatgctctgtttatacggatttcttcaaatgtgacattttaatggcataataattgtgtgattacagtgcagtcgacaccgctccgggaggaaaggcgacagggactctagcttcctgctgggggaggcggctccctgcacgggtggccggggaccatgtggcactgctcaggccaggatgccagacaagcatgagaaatggctccctggagggccctctgctagacaagggccataggttcccaggaaacttgcatctggcttagcccttgaacaaaatcaatgccccgggctgcaggaggggagataatgacagcagaacttgcaattcacttcattcattcacttcatgcattcatttatttattcattatttcttgagttcttactgtaaactgagggaaaaggccaatagatatgcagaaagaatgaaagaagaacaaatggaggaggcagagggcaaggaagaggatctcacatttattgggcacctactggatgctcagcactaaggcacaatttggcacattcatcttccttggcccttcagcaacatcctaccccctggaaaagccccccttcgagggtccttgtctctctgtttcagaatactttctcctgggcttctcagactttggcatcttcttcatttccttctctggctcctcccttcccctgatttctcattgttggaagtgtgcatggatttagccctggtccctcctctccactcgttacactctccctacaggtgacttcctccattcctgtgccttgacaaccttctatagatggaggattccaatatagttttccagcccagatctcttttctgagctccagaacaatatcaaaaaaacgcctactggacatgcccacttaaggtctcacaagcatctcaccttgcatggatttcaaatggaactcttgatttgcccattggaactggtgcctcttccaggctttcacaagtaaagaaatggcaccaccagccacatagctgcacaagtcaggaatctgagagttaccctcgacaattccttcttcctcattctaaatctcactctaatcacttgaacccacacacaactaacccatccccatgtcctgttggttctgcctgcaaagcatgcctccatccagccaccctccttttcccatctctacaaccatacccaaccaccaccaactgcattctggaatactgcatttgatccctccaattcattttccaaagtcaccttgttttgttttgtttcgtttttagacatagtcttgctctgtcacccatgctgcagtgcaatggcatgatcttggctcattgcaacctccgcctcctgagttcaagcggttctcatgcctcagtctcctgagtagttgggattacaggagcccaccaccacatctgcctaatttttgtatctttttagtagagacggggtttcaccatgttggtcagcctggtctcaaactcctgacttcaggtgatccacctgcctcagcctcccaaagtgctgggattacaggcgtgaaccactgcgcctggcccaaagtcgccttcttaaaaacgacatctgtggctgggcgtggtagctcatgcctgtaatcccaacactttgggaggccaaggcgggcagatcacgaggtcaggagatccagaccatcctggctaacacggtaaaaccccatctctactaaaaatacaaaaaataaataaataaataaattagccgggcggggtggtgagcacctgtagtcccagctacttgggaggctgaggcaggagaatggcgtgaacccgggaggtggagcttgcagtgagccgggattgcgccactgcactccagcctgggcaacagagagagactctgtctcaagatgacattcgttcccgtctctcccattctggctcagaatccctccagcggctcccactgcactcagaatgctgtcctcactctttcctgtggcccccaaggccctgcctgatcagaacctgcaaactctccacacttacccctccccatccctcttagctcattatgttccagccacactggccgttcttccctttctcatccatctcatcccatctcatagggctttctgcctggaatactctcaatctgatcaactgtggccagcaaggaagtggcaagatgggaaaccagaaccattttgcctacaaaaaactttcaatgggcctggcttttcagaaaagagaagaccagcaagggctggtgccatcagggagaggttcagcagggaggcaagccttggcctaggcctacaggaattaactagactgagacagaagcacaggaaggagggagggaagggatagggagggtggacacccacgagagctgggtctgcaatctctcctccagttactgtctctgtgaccttgggaagtgacttaacctctctccctcaactgagagttagctgtctggctgtctattctgcaaaactgtgatgccattttacggatctaatggactaaaataagtaaagcactaagctctgtgccaggcatacttttagcactcaaaaaagaatagctaccactttggtagcaaagtgaagacaacgttgtatgtccatggggcagtaagagctgacttttagatctggcctccacaaccttgaatcctcgggtaaaccatttctgctcactgggtctctggttacttttcccacctataaaatataggggttacatagcagaggcatccttaactatttgaggagacagggccctatttttcagtgtaatagaagccatggtcttttcttccccagaaatagatgcaaaattctgctcacaggatctaggatccagtgccaccctggggccacaggaggcacctggctgttaagaggagagggcgcctctctgaaagatgagctcacactggcagacctgtctggcagcaaataaatctatgatactctcccttctccctcccagctacccctcagggggccaaagctggctcctcagctctgccagcctctgcccaccccatgccgagcacagtcaggaggcatgctgtgcagagggactccataattggtccctgctctgtttgtacttcaaacaacaaccttgagatgtgttctctggacgtgccgcctggctctggctgccataacgctcagccgggaaacacatctccagagatccacagcactggggaaaagctaggcattcttcagctgatgcccaggagctgaaggtgtttgaaacgggcaggggcaaagaagggtggggaacgccagtctgctcaggaaattctctactccttggtgacagtttccagtacagaagatatctcctcattctctttgcagagccgaccaacagataagcgctggggatttatgtctttagacctgtatttaatttttcacactgctgctggaatggctcttctaagacacggttggatcccactcacagaataaaggccaagttctttgccgtggtctgcaagtactgccctggacttttggtctggcttaaccctggttcccacacactggcatccttccattaaactgccaccaccatgactttaaggaagcaagcaaatctggtccctgcaacctaatagtgtcccctcttcttatggcagcacctatagttacctgtttattgggtctcttccacaaaacagcgtgtgtcctggaggcaggagtgtggcttttctctctgagaggttggtaataaaaactgctcacagcctcagtgcagctctcccttcccacctcactccaccaaggccctcaggctacagacaaggggacagacacagaactcacagccctcaaactatgccttgtggaggaaatgaacaggctcagacatggtgaaaaaagggttaagaatgaacttgccctgaatcagggtgtgtaggtcaagcaagatgcaaaggaactgcatggcaatgatgcaaacatgcccctgtgtgggtggggccaaaaccaaaaccaaacaaaccaacaaaatggaacacagtatgaaaaaaaatccaaaaacaacaccacccacacacacaaaacaaaaaccccagtctaaataaaaacaactaaacaaatggaaggaaattacccaaacgtgcttcatgctatggaatagcttaaaagcatgaatttaataaaataagagctaaaggattagatgattaaataaagcaatggaataaagaatgataaaactgagaaccacaaaacacttttgcagaaccaataaatacatgttgaaactccaagaagcagtgcaggcacagcaggaaatctaattactgataccaactaaagggttccagtcctggctctgacactcttgagcagtgggaccttgggcaagtcactgggactcagaggagaaagatttaaattattaaagcaactacaggagagaataaaatgtatagaaagagcaaaggtgatccaacatcagaaaactggtgaacctgaagcagagaaacagatggaacacacaaaacagtcttcatctttttaaataaaaacctcctgagatgaataaagatctgagtctgcacatcaaaattgcacaccacattccataaaaaattgatacaaagggattgacacgaagatgtttcctggtttaggtatcgaacttccaaatgcaagaaagaaatcatcaagcacccaggcagaaccaacaagtcacctacagaaggggaaatgttcagctgacctcaaacttccccgcggcagctttccatgtcagcggataatgaagcaacacccacggggctgagtccaaatgtgaccagaagcattttaacctgctgaggtgccgttcaagtacggacagcaggagtgtgatattcccacatccaagctcagggatgacagcacctatgagcccattttgaagcagccactagaatccactatggcagacttctaatttggaccccagtctgtctggcccatgctctttctgttaatgccatttctgctttatatatgaattttgttcccacatgcagtcaatgaagaggtggttcaaaataaaaaacccaagaatggagcagaagaaccagtagagcactgaatctatgtaattacaaaactaaaagtaaacagctatgggaatggtcatgaaacactacaaaagtgttatagactctgacaatctaaaaataacgattgtgcagacaatggctttaagtttctgtccctgtaagatttcatgaaagctgcacttaaggaatgaaaacagatgaacctaaattttctcaagacctatgctctgacactggctccactgcttactgtttatgtgatttggaggaagctgcttaacctgtttgaacctcagttccatcacctgtaaaatggggagaataatgcctatttcacagggttttaagaattaaatgaaaatactgtaggtaaaaagcagtggcttgcacatagtaaatgtcaattaagaggagaagctgactaaagatgagaataaaagtgaacatctcccttcccccttcctccccaaaaaaggcaagggggtacccatcagctctggatctggatagctagtgaggctctgggctctccagtaggttgctgtatcaattcacaatgttgcaactcattgcagggagaagcccctcccacagagaggcattgggcccccagtttccaaccacacagagagcaaactcttttccccaggactgaggcagagaaactgaagactgaaggaaaagcaagccttcacctcctggcaggggcatggtgagaagcagtgtggatccagctgcttgccagtggatgcccccttctgaaggcctgaacaggtccccatatgactagccctgaggaacgcagcatgctgggacacacgatacatgtaggtcagcaagtcagattctagacccaatctatctgccacccactagcagtgtgaccttgagcaagtcacttgaactctccctatttcctcatcgtagaataagagggtaggagtcaatgatccctaaagcacccctgcgtttaccatgtatatagagtgcaaagttctgtgtgggttgtacccttacaccagtctttcctgccataattaattcaacaagaaccccagagaaaggaagaggaaggagaaggaaacatgagacagaagtgtaaattagcaggtgagggaatgcataaaggagggagggaagggctaaagttctgtggcctctgaagaatcaaccactcgctagctttaaagaggcaggagcttggccgggcaccgtggctcatgcctgtaatcccagcactttgggaggctgaggtgggtggatcacctgaggtcaggagtttgagaccagcctgaccaacttggtgaaacctcatctctactaaaaatacaaaaacgttagctgggcatagtggtgcactcctgtaatcccagctacttgggaggctgaggcaggagaatcgcttgaacctgggaggctgaggttgcagtgagccaagagcgtaccattgcactccagcctgggtgacaagagctaacatccatctcaaaggaaaaaaaaaaaaaaaaaaagagatgggaactcactctctgccagtgagagttgagagttagtgactacagcctctgcagggcaccccaaatccactcctgacaggagaattgcagaaagaaggcaactctgccttataaaaagggtccggaaaatctgcctccatctatactaaaatcgatgggctaacagttgagatgaatcagaatgtctgcaaagtctcaaagtacatcctccaatgtactaatggcaaaagggaaaaaaagagtaattttatgatggagactgctggccagtaccaccctagccaagcaatcaagattaacattaccagtaataaaacatatcaatatcacatatcccctataaggatgtactgacaagggctcaacaccacgtctgtagtatttttgccaaaaacacgtagcttcagtctaatctggagaaaacatcagacaaacccaatggagagacattctacaaaacaactgactagaactcttcagcgtgtcaaggtcacgtaagacaaggaaagacatcacagattggaagagactattacaattaaatgcaaggtggatcctggcttggtaaccagagccactgggatcatcccaccagacaagctgcctaaacgagaccttgaagcaggctgagggggcatgaaatctagaatgggtagaggaggaaggagatgatgagagtcacaaacaattgcagcagcagggcctagagtttgctctactagcccttctgcatggatccgctcgggctaccatcacaaaacaccatagaccacggggcttaaacaacagaagtttattttctcacagctctggacgctggcagtccaagatcaacgtgcgaacagggttagtttctcctgaggcctctccacttggcccgcagatggccgtcttctggctgagtcctcatgtggttttttctctgtgtgtacatccccaatgtctctttctggatttctaatcttcccttcttgtaaggacaccaatcagattgtattatgccaaccttgattacctccttataggccatctctccaaatacagtcacatgggggttagagctccaacgtatgaatggtagagggtagagaagggacacaattcaggcgattacacctttccttacagagcttcctagaaactgggactaaacagaatcccagagaagctgtaccaggatagagggatgaaccacagtgggtgccactgtgccccacacgaactccttccactgggcctgcacacccatctctcagctgctaggagtgctggctgcaaacttctacagagacctgccccccagaacaagacctgcctctcctgggaggtatatccccaactccagggagcaactggtgccagtggctgagcaatctcttctccaaggctccccttggaaccaggttgaaatctcctactatgagatacatccttgcagagcatcttcccccgcctgccctgtcttgcttccctcactcccctcctcctgggagtgctctcattaaatttacaaggctctgcttctatggaatctgactcaagacacaaagcactacctacaaagcttaggatagtgcctggcacacaaaagggatcacgaggtgttagctatcatcctcacaacataccacgctctgtgctggacgaaccgtacacattattcactgaatcctcaaaaaccctgcaaggcaaataatgtgatgatcactttatggttaagcaagggtctcaaagctagctatggcagacttctaatttggaccccagtctgtctggcccatgctctttctgttaatgccatttctgctttatatatgaattttgttcccacattttcagaaaggttcctaagactctaatcttcctccatgtccatggccttcaacagatatgacttggcccctggccccttgcaagccaggatgttcttcctgtaagccatcaggcctgctagcagtgactgtggccactcagcatatacctgccatcttctgttcccttgcccacaataggcattgctgatgggcccttccaatatgaattctcctaactccactatgatcttaatgacagctaaatttactgtaaataatacatataacagagtacccatttttataaatatttaaatttcctactgagaaaacacaagattttaatcattacctgcaggggatccaggttcttagatagattaatgaagtaaagggtttaaagactgggaccctttgctccaagtattgagtcaggggagagtcagacaggagcaaaatctgtcacccttcactactccctgggggcccactctgcaagaaaatcctctttagcctctgcccaaatcttgcagtccacagagaccacctgagaaggcctagaaagcccagcacctctcacctggagagatgccagcaccgctgcacagggcacaatggaatggctgagaaagagggcgcttgatgaaattaaaaggcaaccaatttaaaagagattaagcagggaaaaggggatttaatgatcagcttttgccactgtgaactaactgaacccactggcatggagactaatagtttaatatgttgttcaacaagggtgagatgtctgtgtgagtaataagggcacctgtagttatggtgacaagggtaaaattgccctcgccacagggcctcggccttgggggctgtactccactcatttcccgagtacggtcagggccagccactcagcacttcccagcctcaggagaaacaattttcacgacaagaaaggggcctgatgatgtgtaagcagaagaaatccttggagagcaagtagcaagaagggtgagacagaggctcgcagatttaacacaaacagggcagcagggccctccaggtacccctggcccaggccgagaaagagccagctccgaaggacttgagaggaatgactaccatatatcattcactcttgctgaagagttgtattagtttgttttcacactgctataaagatgtacctgagactgggtaatttataaagaaaagaggtttaactgactcacgttccacagggctagggaggtctcaagaaacttaacaatcatagcggaaggggaagaggcatgtcttacatggcagcaggtgacagagagtggtaggcaaatgaggaaaagccccttataaaaccatcagatgtcataagaactcactgtcacatgaacaccgcccccgtgatccagtcacgtcccatcaggtctctcccttgacacgtggggattaaaatttgagatgagatttgggtggggacacaaagccaaatcatatcaagaatccagaagggctggggactgctttttttattttattatttttaaggtatttgacaaatgacatctggaaaagtgagggcttctggggatggaaggatggaaatgagttggtgaggaaatttgtgcaggttctttgggatgacaacaacaaaaaagcaaaactaattttactcagcacacggccctcatgacctttcattgtggcctgcaggctcagcagctgtgtggtggggcctgcgacctctacctagctcaggccctgcagagcacagagagcttctcagtgagtggtcattagacaagagaatgaatgagtgaccccaggccccctcacaaatgacagcgtgaagggggccggtgatggggactcagttgtctccaggtactatgctcagtgctttattgggcaccatctcacatcatcctgagaacaactccatgaggcaggagagattaagtatgtccccagggccacagcctggcataaggcagccagacttcaactcagggctcctaaaccaccactcatatgtctcacttctgggacagaagccccagagtaggcaactctcagagaggacagaactgcgatgcctccactcagcccttctgctgacactctatttcaacttgaaataatgtcgtcttaatttaaattccagcttgggttgagaatttgttggtatcagagtttattttgagtgggttttgctttaattttcatttgaaaggaagccttctttccagaactgcagagcctagtacctgacacctaactcacctgccccagccacactgtcattttgaggggacttgggctcattcattctcttatctaatgaccactctctgagaagctatctgtgctctgcagggcctcagctaagcagaagaacacgggtccaccacacagccccacaacccagtcctgcactcaaggagcctacagtcatgaggatgatgacgggatagtcccagggggaaccagggtttctcatggaggttaagtggctatcgctgtctttccagactggaccttcctgggagtggcagcttgaggcagaggaaagaatgaatactggattctagtcccagctctgcactcactcactgtgtgaccccagaagacctacttggaacatcagactgtccctctgtaaagtgggcatcatgattcctggcctgcccaggtcacagggtcattgcgggaattaagtgaaaggatactgtaaaagtgccttaacaactgaacagctttctacaatagaaaggcttactcttgggccagaatttaagtatgaaattgcacttgagtaaggggcgagcggtggctcagtctaccctatgaatatatctctgtgaaagccgattacatgcttattactcctctccaggaataaaacccactttccacatggccagccccttccccagcacaccctggcttatctcagccatgtggccccttctgccagccactgctgtcagaaatgagcaactcagtcagggacttgggaacacacgtcagagaagtgtgttttgcagctatcacacaggaaaacagtgttggatcattatccaggagatgaaaatacactcagtccacagaactgtattttttaattatgttcattaaaaggagattgaaccaaaaatgaagctcaatggaaagctgattttgctagaacttttccattcaaaacacagccatagtttatagtattgtcatgtgggtaaatgacaccccagggaacaaataggtttagaaagaagcaaaatacctcaagcagtccctggtccccctcaggaaagtcagagcaccctctctgggtagcacaaagttgggagtggggcacagcccacctaaggctaaaattcaagatggcctccggaatcacataaggatgggcttatctatacacccaagacacctgacaccccggggaagctatttttaatcttcgactcctcaactttcatgcttggcctgggaatggcctccccaagcccagtccccctttcccctctgggagggaaggtgtgttgctggtaggatcaacccaccttctgtcttgccctgatcagcctcttggctcccacatatcatacggcttacagagatcatttaggacaagtgcatttccacctgctcatgaaggctgcatctagctgatcctctctcttggtgagccagcttcagctgctctgaagggagtatggtgtgtgggagaaataggctttccagcagcctgcacatttctataatgccaattacatgcttattacgcctctccaggaatgaaacccacatcccatgtggccagccccttctccagcacactctggcttatctcagccacgcagccccttctgccagccactgctgtcagaaaagtatgggatcttaatcaattgccaatgggactggagggaaggcaggagcacaaatgcccatctcggagccaagagagactcaaacaagagcttgaacagccagcaggtgctgcacagatgggccattttagaggtgtggaagggatgttcccaagggccatgtggagctgtggtcaccaaaggggagcaaggtagaaggcaactttggaggaagtctagggtcttctccctcagacctgtgggttaagtctggcctgccagctgttttttcttttcttttttttatttttatttttttgcgacagagttttgctcttttcacccaggctggagtgcagtggtgtgatctcggctcactgcaacctccgcctcctgggttcaagcaattctcctgcctcagcctcccgagtagctgggattacaggcgcccaccacgacacctggctaattttttgtatatttagtagagacagggttttgccatgttggtcaggctggtcttgaagttctgatcccaggtgatccacccacctcagcctcccaaagtgctgggattataggcatgagccaccatggccagccagctgcttttataaatagaagttttatggaaacatagccaagcccatttgcttgcatgctctctatgaccactttctcactacaacagcagagctgagtagttgcaatcactctgcagaccatctggcccacaaagcccatagtatttacaatctagccctttatggaaaagtttgttgagtcctggtgcagcagaaagagcactggcatggaaggccggaagtcagaggacttgaagttaaacatgcattctgtcccatcctggccatgtgatgtggataggtcctttcacttctctagaaattagtttttctcatctataaagtgtggatgtaataaccaccctgtagggatgttgtcataatcaataaaaaggaggtaagttgtgtatgcagtgatggcctcaaagacagacacaccagtacataattagatagatagaagaaagattccgtcttccctgtggttctgaaatactgcctcctggtcttctattctttgtgggctagaacagtgtcagagactctgcatgtgttttgcaaaggtgtgtatggatgggaagtgggggtcagaaaggggaggaagggagggaagaaggaagagctggcacagacttgattttctcagaagaaataatgacaggcagatcaaagcctgcctccttttaaaacatatacactgtcacaccccaaatatgggcgtgtacccctcagggggtccccctcagtaggggatggtgggatgctgggccctatctcaataagtggcttgggggtcagccttcccttgggctgagtattatggaccttgacccattatgcaggcctacattctccttctcctcccagttctggaataaggcctttttttcccccaacactctacctttccccaagtcagaatcccatcccacacagggcctccagttgccatgtaacactgctacaaaacaacgtcttcccacttagcacatgtgtatgtggagctaagggggtgcttcagggggcccaagactggtgggatgaaattcctgctcaagaagcatagagcttcctaaggaactggggagggcaaacaaggccaggtaaggatcattgggagccttaagcagaaaagaaattatagtactccctaatatgtaattctaaataaaaacaataggcaatgttaaacacgacatatgagtatgctgaaatgaacagaggttctctgtagattttctaatgccaaaattctggataagttcatgggagcttaattcatttactccccgcctatgggtgccctgccaggctactgctatcagcatgcgctctgtctgcttatccaggagctcagcactgacagtctggagaccccaagcaaagggcccagaagctcaggaggcactgcttccagcaggactattgtgggaatgcagcatggggtgaggaagggcgcatttgagagaggccttgaagaaggggtaacattttgacagattgagatatgggagagttttctaagatagctaatggactggtccaataaagctatagtggggaaaaacaaaaacaaaaacaaaaacaaaaacaaaacaaggtatgtttgaaggctcaaaccaaaattgagaatggtgaatatctcaattttctctggagtaaagtttccagtggatgaaaaataatcctagtaagttaggttaagaccacagcatggatggccttcatcacccattgtgtgatttggatctcacctcctctcacctcttcaaggaactctttcctgtaactgtgcctctttccttacattgtcaaagctcccctctctgctggaccactcccattagcatacatgcggtgaatttcccatctttaaaataccctccctcccctcagccccagaaccctcttcagcagtcatcccctttctcagcttcccttacagaaagggaattctgtttgcactttcttcccttcctttcttgagccccaaccccattaggcttttatcccagtgattctactgaaattgccttcctgagaatcatcatgacttgcacatggttaaatccaatcggcattcctgactctcaccctgcttgatctagcagcatccatggttggcacagtagcctcatccctcccctgtgacacttccctcctctgcctccagatgccactcactcctgctttccctcccacctctctggcagcccctcatcactctcctcctccagctaaacactgaagcgttccagttgtgcatccagcaccctacctgacctcatttagtcccaaggatttagactccgaggtgactcccaaatttatatctttgcctccaaccctctcatatccaacaacttacactgcacttccactttaaggtctaaaatatatcctgagtgtgtggccccaacccggtcttggtttccctctggacctgctcctactgagcttccccatcttagtagaggcaaatccatgcttcccatttccccagccttgaacaaggcatcacccttgactcctctatctcaatccctactgtcagcaaaccctgtggactcctccttgaaatatactccatgccatctcccagcacctgcaccactgtcacctgaccccatctcttacctgaactctgatctccctggctcttcccctttccccttagagattattccccacacagcagccaagaagagtacaagtcagatcacatcacatcttggctcaaaaccttctcctggctgcacaactcactcacggacaagtcttcacggtggcacaaaggccccaccaaggccccacacacggtggcccaaagtcccctcctactgctctcccctcactccctctactccagccacaccaggttcctccccaggccagccgagctgccacctcagggcctttgcacctgctgctccttctacctggaatgcattagattctgcatggctcactccctcctactgaacctcacctcttccaagacttgtctggaccaccttccccttattcagctgttttttcttcatagcatttgtcaccaccagagaggttatatatatctctttgctttctgtctcctcttgctagaatgttggcctcgtgaggacaggaattccagtgggtatccctaacacccagtccagaccctggcatatggttctactccataaatatttgctgaacaaataccaggcccaaagtatgaattttattagagaagtaatggggaaccactgaaaaattctaagtgtgaccccacacggcagggctctaggaccatgagctggcagggatggcaggctagtgggatggcatagagggaggcccagaccaaaagttgaaatacctgatatgtggctccactctaccatggactgctgtgtgcagcaggccaatcgcttcatctctttgggccaacttcctacatagttattaagttattaagacagttaagttattaagttataatagttattaagacaatagttattaagacagttaagactgatctgagtacttgtattgggttaggtgcttcacatgaatcatctcatttcacccttgccataattctaagatgtagttatcactattattcctatttcagaggtggggaaactgaggcataaaggtttacaataatgctaggaagttgataggcctcgatcccattgcaagacacctgaccccagagccagtgtccctcccaccttgttaatccagacccatgagcagggtctggatctcatgacctgcaaggtgcccacccatcaccaacactccatattatggagagagagacgggtagaggcaggcatagggagatggatggggagagagcacaagtgacaagctaaggaggccactggaattgtctagatgtggattaaaagaaactgactggagaatgacaagacagggctggatggaagacagggagcagagaaaacaccggcaggcttgtcaaccaaccagatacaggtggaaggaggtggaagagaccagagaccaagagctctaagctgggtgaggacaaggttgaaagcatctgtaacatgaaagaaaggtggcaatgagagggcaagtgcatgtgagttctccagagaaacagaaccaacagggtatgggtgtacagatacagaaagagagatttaaacaaagtggctcatgctattctggggtctgacaagtccaaaatctgcaaatcaagccaactccaaccagagttgagtgcaaaggctggtaactcaggcaggccttctatgttacagtcttgaggactgcaatttctttctttttcaggaaagttcagtctttattcttaaggccttcggcagattggatgaggcccgtctacattatgaagagtaacctgcttgatgaaaagtctactgatttaaatgttaaacatatctaaaaaaaatcttcatagcacactggtgtttgaccagaccacagcctaactgagctaccacataacattgaccatcacagagagctcgtcctcagacatgccgagtccaccagagacccctgtggaatgttgggcactttcagaaggacatttcttccagtaaggggcggggccactggcttttctacaggagatctgcaaaggtcagagtgtccatcttcatttccttttccttgtattattttgccaagtctctgaggccttgtagaagctttactcttcccacaattatggctgttgttattatccttcttagtcttagcacgaggatgctctggctggattccaagaaggagaattactttctgtctcccttacaccctcctgttgcttttaattggatgcagagtgtcttgtcttctctccccagacggacaaggagcgtggcctgtgatagtttaagtggctgccctgccctggctcagagatgagttagccctcagtcggggtgacgccaagtcaccctggcagccacatgaagatatttgcttctaaagagattcctgaggctcttgtgcttatcacttatagggagggggtctgccccaagaatcacaatggggtctagtcctgcctctgccactaacatgcggggagactgtggaccagtcttttccaatctctggcctttagtttccccactgacctgggtaatctccaaggtttcttccagtctgacgttctcccatgccatcatggcaggtcattgatgtcctgctcatatacaaagaaaagggattctgctccaagtccacagtcctttcttcctcagtcttcccagggctgcccacttttttgagtacaacctaaggtatgaaatgtatactgcagccagtacactacacagcacgcatatctacaagtgcaatggagaccaacattttatgaatgaaactccttttttacctgtaatgctttctccttctgtctcatgcctttaaaaggtaaaattcactgatgcatcataatctatattaaaacaaacaaacgctggtccatctggcactgtatccaggtatgatgagaaactaggaaacacaggcccttgcatgagtgttaaaaacaggccctggccagttgcggtggctcacgcctgtaatcccaacactttgggaggccaaggcgggtggatcacctgaggtcaggagtttgtgactagcctgactaacatggtgaaacctcacatctattaaatacaaaaaaattagccgggcatggtggcacatgccttgggaggctgagacaggagaataacttgtacctgggaggcagaggttgcagtgagctgagatcgcgccattgcactccagcctaggcaacaagagcaaaactccaactcaaaacaaagcaaaaaaaaaaaaaaaaacagtccctgtgctcagtattttcttactctgagaagccaaggcacctcttcagagaccatataccttcaacctcaagggtcttagcatagtgcaaaagatcctcgacaaaagggatcatgtctgagatcagccaaccttggcaactttaggaagaaacctggtacgtggaggccaggggagtgatattagcatgtcccaagaattcctttcaggattagtacatactattagttgctcattattcgtgcttatgtttatcatcacaatttatgtccccaccctgtatggtgaaatgggaatgtaaattaaattcacatccactacagtgtactcatgtagactgtgcaactctataaaaacaatagtttttgcctctggaaagctttaagcaacaagtgctgcctggcggatatgatactctaagagggcccagatgtattctgtgtgtgtgtgtgtgtgtgtgtgtgtgtgtgcacgcatgcatgcgcacatgcttggggtaggggagccttcatcagtggcatcttcatcaggtaagaggctgacttagtccatagctaatgagcatatgtagtgaggtgtataacgcatgcaagtgtgcttgtaaaccttaaccccatctttaatgctaaatatccctgttaatgattcccatcgttctcattgttacagacatacactttttctcctcttctgcctgctcctcagtgcaggaagttgaggtcctcacccacatagttgctcaggtgaggttgcttggctgttgtccaggtgtgagaatgcctggcctctctgaggggctccacaagtctcccagccatttccctcctctgaggtgatgatgagcctctctctcaggacatgacaggcaggagctgctactcaacccagatctccctcctcctcccaccatggcggaaagccagatcagaactctcagtccatccagggccagctctgtgctgaactagaaagagaccctaattcagccctgctgggatgagagcatcaagattcagggtttcagggcaactgccctccaccaggtccggttagcggggctccctccatctcagctagagccgccaccacctgcccttccccatggggtgctcccacacataacggtgtgtcagaaacactgctgctttattatcaatatgcaaagccttcgaggcagcaggaggcggggtagcggtgaaacaccaggggctatttatgagcctccaactcccatgctgggctttatttgcttaatgaatggccggggccagccatcagcccagggatttatttgtcactgggagcagaagacactaggatgtggagatgtaaaaatgacaaattctccaactcagccaaggtggtatttcattggcatgatatctagtggggaagcgaaggtgaggagaagggaaggacggctcccatgctaagcagcaacggctgagagtagcttaaagttgagggattggccatgttcaaaaaccaaaaaagctgctttctagaatgaagaatgagggctagggatgagaacatttattagcagttctcaggtgctcttccctatgctcaattctctgggggttgctccctgagcccccatttctcaaactgccccacccaacaagaactctaacgcgtgcagagggaagaaaattggcccagaagacaagaggcttgagtttgagtttctgttctacaattcattagtggggtgaccgtgagcaagtcattcgcgggatctattttgtcatttgtaaaaggaaaggatggacaagctctatgactcttatttaaagtggaggaatataaggaactaaagtcaggaatagtcagccagcctattaaacagaccctgccacctctacattcactgtcacagaggccacgtcatgacgtctgcaaccaacatcatctcactgcctccaccaccgtcatcttcacacacctcatcatctccaccagcatccgaccatctggtcctccacagagccaatctcacatgaagactgacttattttatttgtaatacaatacaacgtagttatatttctcagcctgccctgtaatcatatagaaccacataactaatggaaggttagtggaagttatatgtacaacgcacaggtcacaacctttaaaatgaaaatgagctgtcctccgcccctctctttccccttccccggtctaggacatggatgtgatgctgatggccagtcgcaatcatgtagactagaacaacactctacatcccagaggagtagcaatccctggctctccacgtgacctcctgttgcagagtgctactcaccctacaccacctttaaactgtttagagagaaaagcggcaacttctatcttgattgactactataatttttttgtatatttgtatattttgtatatttgttacaacagattaacccatatccccactagctataatgccaatgaaatactaccttggctgagttcgagaatttgagttggagaataagctttccattgtccttgggaacgagtgagttcttctctgctctgcgcaggcacagaacatcatttctatgacagcattgtgcatatcatacagaattatttgattattattttcgtgtcttctagactgtgagcagctggagaacagaacttgtgccttcttcatttggataaagctccagtagcctgaccattttgagttttcagaaaagcacaagaggaaaactgtggggcctccctaagtggacaggttagggatgaagcccaagaagatctgtggggactggtgccattcttaactgccagtgtaagaaatgtcagctgtaatagcagtatctgtccactcctctcgtggaaatcacacaagtccagggccgagcaccagggctggatggaaaaaaaaatcaaggcatttgattttgctaaacataccattctaggtatgtttagcaaaaggaacttaatagaggcacttagaggcttataaaattgttgaaaaaactaaggaagcaaaagtcaagaaagttcactgctagtgtttaagaaaaatataggaattgcaggagactgtcacgcatggtctcagctacataaagcaaaaaagtgggtggcacttctatcaccattcacaggaggatacccagaagcactggcaaaacctcaaaccctcatgtctgccatctgctgaagcccgtgagccttcccactgacctgctggagcaacaatgacttctgcttctctcctaccttccaaatctcaggcacaggcttctccctggtggattctttatagtgaggaagtctgagaaatgtttgtaggcttccagcccctggaatatgagagacagccaagaagggcagagacggtactgatcaccaactgtcagcatctctcacagcctagatttagacatggtttaaggctcagacccatcagcaactctttttcttgggatgcctatttatctgtgtattttgcattcactggggggctgaaggattttgatagccccagctgaaggccagaaagccattaatattcaagcatcatgagaaagcgcatgtgtgtagtcacacaccctcctcaaaccagcaagctccaattgtacaattcgaatatgagaatcgggtttcctgtaatggcgatcaccatgtgctcagataatttagtgtcataacctttaaatggccacaagttctttctcaaaatggtagacttatcaagtcctatttggatgccatgtgatcacttaaggggtgaacctctgaaatgtcttaggagtcctgtcaggtcaccccagagaacaggcagccccagaggttggggagaaagtcccaaactctctatcctaacaaaacttcaagcaggtgacaggggaactttataaaagaaagcacatgacttggtcacatttcagctctgagattactggaccattatttccaaacaattactattagatatgattctaacctcatagaactagtcataaggaaatgatatctaggctcactaagatgactaaaatcttactttcggtccagtctatctttgcatggccatgcaaatcctttgataagactccctctcatgcaccaatgccactggtacctctgcttactttgctcaccacttcctctcacctccaactcaccaagttgaagaaatctagtccccaaactgttacaccttgttgacacattcacaacactgatctatctaaacaagatcaatatggagaaaaaaataagagcctttaagtgctctgcctaagccttgaaaatagctaccatccttaggatcctagaaggaaatgtgactttgagtgcaggatcttggctacacattccaacttccatggaggggcagaggctcccacttcccctccaccctccacagaggggcaagagcatggctggacacaaaatgctgggatacagtgttctctctctagcaagagtcttcctgttttgaagctctgtctctggaattactgagctgtgcctgctccctctcctctcggaacttctcgcggctgccacagtcagctgcagaggacctgcctccacttggaaggaggcatatttgttcttatggaaggccatgatgaaaccatggtggggttttgagaggaatacctaggcagcagactctcatggatacaaaatgggtccttgaggcctacggtaatgaggccagctccctgatgtaggggaccagccaggggcctggggcaaagccctaacctacaaaacactgatttttctccagtggtcctttgtgcccatgatccctggggaactggtggggatggctggttgaggatccactcgctcaagataccgcccagccactgacatcccagaactttcatcctcgcctaagcccagggttgggaatgagaaagatggaagagttgttgggagggagaacaagagtggccacgagggctgcagcgcagagctcctgaatgtcactgaactgcagtgaaaggcagggtatttttcatttccaggctgcaagaaacagatgaagtaggcagagtagctgggcttaattgttgctgttttactttactggtgttttctgaggtcaagcatgttaagaagcatcctaaggctgtgaaatgactgagcagcccagaggtccatgtgaccaagtgcacaacttgattctgcaatcttcctgccagggaagctgttgagattatttcccaatccccacataccccctctttcccagcacaggaagtccctcctctgcacaactccatagcattgctgagcgatcaaggtcaactgcgcagtactgctgagtgatcacgggtctactgtgaagagtagaagatgtgatgtgcacacagatgccaggaagctcttgctctgcctcaggctttattttgctcaatgctggagaaacagctggactctgtagaagaagaagctgggaaggttgcatgccatgtcctaagggggcccactggaacagtcagctcccagagcagccctgagttggaatcacaccccagcctaagtttagcaccatactgtcatcagtgaacatcctagggtcctgaaactgggcacactctggctggcaccacaggggagagggcagatgctggagaagaatcaagcctccaaaatgagctctgctggcttgagtgggctgcttctcccaatactcaggctcaagtcattgaaaagtgactgacagacaccccagggtttctctgatttgctaggtatctctctcctgcttctatggacaagggctcccacctatctgtcacgtgtggtatagctccccctttgcaaaactcagagcaccagaggcaggcataagatgaggtccttgtcttcctagtggctttcctcatggccctggcacttctactaacagcagaaccacacaaataaagagctctgaaatctcaacacaagactctgaaattgtcccaattctctcttcttcaagccaattgtttaacatgtggagtctaccctgttggctacctttccttcctcgtgatcctccagctaaattctgataatgctatttttgcttccttcatttcctaaggaaactcctgtgtgtagttaacacatacctccccatcccaagactggctgtcttctctctttcatgtctcaggtactggcgacttgcaacactgtgaagcctgccctgaccctttggctccttccctccctggcctgcctgcatccctaaccgttttgacttctccagcgagtgagtctttgtccatcctatccccagcccattccagcttcctctcctttccccgagatatgcaggtgatgcccacgtgttagttctgacactaatttctctccagaacgccctcccatgttttcagctgcccattcaacatttccacttggatgttctcactattgaaaaagcatgtcagaaactgaactcatgatgacaacagcaaacaaaccctcacatttatcgagcatttgagagttcacaactggccattatgcctagtttatacaccagatttcatttaaaccatacaaaatcctctgctgtaggccaggcaagcattgctattctcatttcatagttgaggggacacaaggctcagagaaattgcctaagaacaaatggcagaaaattatggagccaggacttaactcagtttctctcctttgtgacttctcagaccaaaggtccaaatagccatcaaatcctgtgacatctctcttccttcttaatctcccttgcaccaaccctgaccctctacgccactattccactctagggttgtgtccctagctgcctggattattacatggcctcttgcttcaccttactaattttattctttagctacttatagtgcatctggaacactgccaccaaaataatcctttataatacttattttattttgtttctctttcaggagaaagtttcaatgtctccttccagctcacacttcaaaatagaatgcagcctagcaccacagcccttcacaaaacagcctcactcactgtcctttgcagctttacctgactagaccctctggttcctagtggctattccagtcactgacttttgatctttttctagttgttttgtttttttttgattatctgtttgatttctgtctgctctaatctttattaattttcttccttcagttgttttagatttagtttagtttgctcttctttttctaatttcttaaggtagaaatttaggttattgatttcagatctttcttctttttaaagcaaggcatgtatagccttaagtttccctttaagcagtgctttactttagctgcatctcataaatttgtatatgttgtgtttttgtttttgtttgtctcagactgttttctaatttctcctgtgatttcttctttaacctattagttatttaggagtgtgtcacttactttccacatatttgtgaatttcccaaatatcctttcatcattgatttccaagttcactccattgtggttggaaaatctactttgtatgatttcaatccttttaaacgtattcaggttgtgttacggtctaacatatggcctatcctagagaatgttccacgtacactttagaagatatagtctgctcttactgggtggactgttctataagtatctattaggccaagttagtttgcggtgttgttcaagtagtttgtagtattactatttccttgttcttctgtctagccattctacctattatcaaaagtgaggtattgaagtttctacctataattattgaatggtctattttttccttaaattcaatttttgcttcagtattttgggctctgccattagatgcatatatgttcacatttgttatgtcttcttgatagattgacccttttataattataaaatgttcttgtttctagtaaaaattttgtcttaaagtctattctgtgcaatattcatatggttctcttttgtttactgtgtggatgttacatcttcaacatttatccatttatcccaagctatttgtgtttttgaatctcaagtgtgtctcccaatagcaaagacatggaatcaatcaattcccatcaatggtagactggataaagaaaatgtgtgtgtgtgtgtatgtgtgtgtgtgtgtgtatacatatacatatacacacacacacacacctacacacacacacacacacacacacacacacacacacacactatggaatactatgcaaccataaaaaagaatcagatcatgtcctttgcaggaacatgggtggagccagaggccattatccttagcaaactaacacaggaacagaaaaccaaatactttatgttctctcttataagcgggagctaaatgatgagaacacatggacagctagagggtaacaatagacactggggactactgtagggtggatggtgggaggggggacaggataaggaaaaataactaatgggtactaggcttaatacctgagtgacaaaataatgtgttcaataaactcctatgacacaactttacctacataacaaatctgcacatgtaaccctgaacttagaagttaaattaaaaaacataataaagtgtgtgtcttatagagagcaaatagttagatcttatttttcaatccattttgccacgctctgttttttgattgaagtgtttattccatttatattcaatgtaattagtaataaggtaggatttatctctgtcattttgctttaggtttctgtatgccttatgtctttgttcctctatttctccattactgccttcttttatgttaaatggatatcttctagcataccatttttgttcccttgttgctattttttttacttattttcttagtagttccctggagattacaattaacaccttaatttaaaacagtatagtttgaattaatgccaacttaatgtcaacagtatacaaaaactttcctcatacctcttttccctcctccccactttgtgtagagaactgtcatacaaattatgtcttcatgcattataagcctatcaacacagttttataattattgctttatgtggctgtcttttaagttagataggaaaagcgttacagacaaaaatacatttaattaccttttttgtttacttctgtagttacctttactactgttcttatttcttcatgtggatttgagttactgcctactgttctttcactgcaacctgaaaatctctctttagtagttcttgtggggcagttctaaaacaatttctctcagtttttgtttatttgagaatgttttaatttctccttcatttctgaggaatagtctctactgaatatgaaattcttggttgacagtctttttctttcagcatttttaatgtaaataacactgctttctggcctccaaggtttccaatgagaagtcagctgttaatcttactgagaatcccttacaaatctcttttctcttcctgctttcaagattctgtcttcatctttgacatttttactatgacgtgtctaggtgaaaatttccctgagtttatcctgtctggagtctgttgaacttcttctatatgtagataaatgtttttcataaatttgaggagtgtttggctattatttcttcaagcatgttctccctcccctttccttctggcatgcttattatgcatatgttggcatgctttatggtgttccataggtctctgatgttttgtccatttatattcattcttttttcatcctgttcctcagactggataatctcagttaacctatttgcaagtttattgactctttcttctgtcaatttaaatctgctgttgagtccctctagtgaacttttcatttcagttattatacttttcaactccagaatgtctatttagttcctttaaatcaataattttacctacttactggtattctttaattaatcagacaatgttctcatactcacttttggttttctagacactacttcctttagttatttgaacatattttaagcagcagattttaaagtctgtgtttagtaagttgaaagtgtaagcttccatatggacagtttctattgactgctttgttcccctctttgtagaagtcatgctttcccatacttttgcatatctcttaatctttgctgttgtttaaaattaaacatttcaattcatataatgtggaaactatggaaatctttccccagggtgtgtttttgctaatatttgtggttgctgctgatgctactcctgcttgtggtttagtgactctcctgaactaatcagtgtagtcactgaagccttgattgaacagggatttccttaaatgttttgaatcaatacgtctcccagacttcgctgagaggctctgtgtgtgtgttggagcacactttctacactagctgtttataactctgcctcattcttcacttcctatttgcatagcctcaaaatcagccaaaggtgaaagattagatccttcttagggctttcctgagtatgtgcacagtcctacttgtgtgcatggcattctaaattcttagaaatttttcaaagcttttaaaagcccctgtggcatctcattctccaggtttttcttttaattattttggttagtcccttatttgccatatatatatatatatatatttttttttttttttttttttttttttttagatggagtcttgctctgtcacccaggctggagtgcagtggcacgatctcagcttactgcaacccccgcctcccaggttcaagtgattctcctgcctcagcctcccaaggagctgagattacaggcacatgcaccacgcccagctaatttttgtatttttagtagagacagggtttcgcaatgttggccaggctggtctcaaatgcctgacctccagtaatccacctgcctcagcctcccaaactgctaggcttacaggtgtgagccaccgcacccagcattaccattgatatttttgacaaatgccatagagatatgactgtatgaactcggtaagcctggagcctggttaaataaagagaagccctaagaatggtgcatctccagggagttgccagacaggccatatagtaataactctctggagatggagtttggcgttggccgggggagggggagggtaggtgttccaactccattctgccccctctagtggctgctaggctgctgattttcacagctattgttgtgaggctgttggtttttaagactactgcagagctgaggagaggtgaatgggaatagggcaagttaaaatcccacgaagctctttattcttagtgagattcagcaattttttttttttttttgagacagagtctcactgtgtcgcccaggctggagtgcagtggggcaatctcggctcacagcaacctctgcctactgggttcaagagattctcatgcctcggcctcccaagtgactgggactacagatgtgtgccactatgccccgctaattttttgtatttttgtagagatggggtttcgccatgttggccaggctagtcttgaactcctagcctcaagcaatccacccacctcagccttccagtgctgggattgcaggcgtgagccaccgtgcccagccaattcagccatctttcttaaacaaatgctccccggattgtttcaagtctttggttaatttctagagttaaaaaaaatgattttgacaatttttgccagtgttcttgttgcttttatggagatgtggtttttttggaggtacctactctgccattctggaagtgttacaatcactgacttttgaatacattttgttctttgccaagattcctttcatgctgttttcctgcctggaatgtttaatttttacaactacaaccagtaacaacaatgataatgagcagcatttccttagcacttctcagtttgcagagaacctttttagtgcacagaaaaaccattgaggtagataatactatcctaattttacagatgaggaaactaaatgacttgtccaagttctcacagtcagtaaagactcactctaagacttgaatcgggccggcttaccaatctcacacatattcgtctatttcccacaatctcatattttccatccagtggccaatcagttctcactgtccttactgagggtccaatatgctcttcctcatatgttccctcaaccactgatagaacctcaggcctatttgcctagtcctgtcatttatgaagggagaagaatccatattagaagatctctttttttttctttagttctacattattcataaacataggagggtaacttaaaagaacgtgcaggcccgcaggcacacttaccctcctaaggtgttattaggagacacaagccataagaagcagagatgttcatgcaatagtctaaggattttgtagaagactttatgcttctaatctacttcataaacttcacatgagaaatgtattcagagccaagtaataagaaaaccatgcttattttgagaaatggattgtttctccctttctaataagagagtcatgaaaccacatctcccttttcactttggctaccaggaaacttagagacaaatataaagcttaactataacaaatatagttaatggaattttgggttcttttccaaacccaaaactatccacactttttcttggaacaaactgtttatttctattgtatactgtcacaaatttatgacaaatgtactcagtataaatcaccttattgagatacatgacagaaaaataatgtagatagtaagagtaatgttttggggtttttttgttcttgggttttttgttttacattactgaaagaggctaaaaggaacaagaggtattttccttcccttgtctggagaactgtatatgtcctagcctcagaggttattatcaacttgtctggctaaaggcagaagctgctggatgctaaaagacagcctcatccagccttgaagtgggaggaaaccaactcaaggagggagtaggtcttgagaagggtccctgaggctgagaagggcctggtttctggaggtactgtgagtggtggaggctggggctcttctcacagtgctctggaactctgagggatctcagaagggactagatgctcccagcctgagttctcaagctctcttaacatggaaacagaggaaacactggcttgcagaccacatgggctaggagatgacaagtgtgatcctcaacccaaggagctcttcctcaactcttcagaactgataagaatccctgaggcttttgtacaatcctaggtgaatgggaggactctcaaaagacaggctgaatttcctgccagccctgcaggtggaagcttggcactgactaatttgatttagagaaataaagaaatgtgacatttcttgcaccctacggttgtggcctgaaattcatgcccaccacatgggctataaataaatgaatgaaagaataaacaaacccgacgccagaatgcctgggatgaattcccaatctgctgtgtatgcaacatcagggtcctgtaaacttgaacacacaagggctaatggagaattcagctagcacaatagacaccatctgtggggactgtatgggaagggatggaggtaagaaagccaaagagacagctccagacctcacaaagcttacaattcagtgcagcacgtgtcaataataaaacatcaataagaacagggaccttcatacagccattggcacatttttatgaagcactcactgcagatgctagaaggcaaaaagataaaggagaggattaagataggacccaggggcaggaagagtacaggtgggtgaggaagatatgagaaggggaataataatatgccagaaaagagatatgtgttataaaaatgatttgcctaaagtactatagaaggagagtttatttctgcctgaagacagagaaggctctaaagaagatgaggtgcttgggctgttcttggaaagatggacaggatttgagcagaatggggtggtctgaggggcactgcaggccaggggagatgaagatacagggtcctacctgtcacactcagggctgcaggggtagagtaaaagtttcatcatggctgtccctcatggtacatgaggatgtacgaatgagtagtgatgatgaggtcagagaggtacatgcattggtcgtgggcagggcttgggatcccatgctacggcattcatattgtgaactataggcaagatgatgggaagaaggtgagcagggaggggaaggataagaaccacgctcttgggggtttccttgaattgctgaatgtgggaatatgcatttgaaaagatggaaaagtagtcacgggaaaaaagttaagaagcccattgcaatgtcttgggcacctgaactataatagaggcagaggatctcagagcgaatactggagatgtgagaacattcacagatgtgaagcagagccatgctgaggggacaatgaagaggggagatatcaagagagaaacttgatgtttcaggcctgggtaaaacaggaagcacaggaagaagaggatttagggaaaaatgatgagctcaggataaaatgtcctgaacctaaggtcccagtggaccactctgatgagatgcttagcaggtatcgtatgcagagagacgtgttatataagtgtgcactcagttttatacattctaacctgatctttcaaaactgataaattagtggagatccatagtcatccagcaaaaggattcttcacctgaaaaaaagcattaataacagggtactttaaatagttagctcccctggtgaatataaaataggctttactatttttttaaaggtgacttacacctctcttttcaaaaactcatctattgtgttaagtaaagcatatctatgtatgaatatggaatgaactgggagacctgagccaggtaaagttaatcgaggtgggtgctatgaaagaaatgatgaatcataaagggaatactgacaagatgacatctgaattggtgaagaaaaaagaaggagggctcagacatagtgtggggtctgcagtcaccctgggatgggaagcctcccatagtctcccagctcctctttcatccctgggatgaaactacacctggatgggtggtggggaatccagctccacccacagcctggtccatctccattgatggcaactccatccattcatctgttgagatgaaaaccttggggtagccttcactcccttcctcttccttactctccacatccaatccatcaggaaatcgcactggttcttgcttcaaagcatatccagtatctgactcttctcgccacctccgctgctgctaccaccttggttccagcctccaccgtctcaggcctggcttatttaatagcctcctaataagtctccctccttcctcctgtgctctcccaaagtctatttgcaatacaacagttagaatggtcctttctaaaacaagtcagatcatgtcattcctttcctcaaaacccttgaatggctccccatttccttctgaacctaagccaaagtcccttttacagcttacaaagccatgctggatatggccacggtcacctgtctcacctcacctcctacttctcccctttctcctcatcccagcacactccactttggctatacctgacccttgctgttcgtcagatgctccaagcactcttaacttggagcctctgctttagttttctctgcctggaacatatgtctcccagatatctgcaagactaagtccctcacctccttaagtaagtgctcaaatctcactttctcactcacccccctgtaatgctgtagcctgctcctgcctcagtattcccccagtccatgctctttttctttcttacttagcatttacctttttctgatttaccttgttaactacgcttattatttattggctatcctcccttgctaaaataaaaatgagtggggttttaaaatttgttttactttgtcttgtccatagtagctcctcaataaataaggtaggaatcagttaatgaatgagtgaagaagaaacagtgtagacaaacaagaggggaaaatccacagctcaaggactccagccaaaaacactgtgcttgaagatgggaagcaatggatctggtccctgcaggggccatggtctggctgtggggctccagacaagatattaaaactctctaggatcctccatattacaaggaagggatggatcaggtgatttttttttttagtgcttttccataaattatttaattcattcaacaagtatatattgagggcctgttacctactaggtcctgtgcatataaagatgattaagataccacaccacactggtccttcccacagtccagagagaacgatctataaataaagaatgaaaatacaatatgacagcagatatccatacaaggtacagtggaaccatagatacaacagtgatgaaatcagtggtggggtggacaagaataaaggatgaccagggaatggccctgcagttacagcgtgctccctgcatcccagggaccagcactggaaggccccgccctctgtgctgttgtcaagtttgcaggctgccaacttcatgtactgtactctgtcaaggcacagtgaaggactagcgacatatttttagaagaccctttaatcatccaaagatcaactttttcatgtaattgtttcttcatgttcccattagtaagccttttaaagccacaggttgttatagaaagacaggccttttgtcctgacacatcagagttcccagaaatatttggaaggacacagcaataaaataatacaccactcatctcacccgggccatctcattgtgttcacaaactcaacacactgccctcttaaaataaacacactggatagagctttctttccctgaaaactgaggttcacattcaaagcaagtaatgttttcctcttgggattctcgattattatcatttactgacaccaccaccatcttcacggggacattgatttattaagtgtcctctgtgcctaggatgtaattcagagcaagataaacagatgtgaagtctctccactctaggaacttgtacttcaatactccctattaacagagcacaaactacaaaagattcttctagaaattacatactggctacacttgatcccaagtgcttttggatagacagaagtatagggtagcagctatactacgggtgaggtgactcatgcctataatcccagcgctttgggaggtcgaggtgggtggtttgcttgagtctaggagttcagaaccagcctgggcaacatggcgaaattccatctctacaaaaatacaaaaatacaaaaattagtggtgcacacctgtagtcccaactactcaggaggctgaggtgggatgatcacttgagcatgggaggtggaggttgcagcaagccaagactgcaccactgcactccagcctgggcaacagagtaagactccatctcaacagaaaaaaaaaaactatagggtagcagatccgtcaggcatggggaattcaaaccagctacgttcacaggaaagcactgtctgggaaaacttcagaaaagacttcaagaggggaggtggaggcagaggtcagatgtcaggatccatgtgtataaggggtacagaagaatgaccaggctgctcagggagagggttaggtataaggtgcaggcagggatgagactactgaaggatatgagcagcatccatgatctggggcgttcaggaagatgagaaaactggcccaaaccttgaacttcagaggccttgccatttctacatgtctcagaatcaagagaccagctgaggtttaacaactgtggtgccaagctgagctcagatgtgccaaatgaggaaacactggtctctaacatccacacactgaggtgtccaggtacactcacagcccattaatcaaggatcaaagtcttttcaacttctttttttggacaaaagataaggatggacccaggaggaacttccatgacccctcccccattttcatatgctgattttattttattttttgagaaattcttgctttgtcgcccatgctggagttcagtggcgcaacctcggctcactgcaacctccgcctcccgggttcaagcaattctcctgcttcagcctcccaggtagctaggattacaggcacccacaaccacgcctggctaatttttgcattttttgtagagacagggtttcaccatgttggccaggctggtctcgaactcctgacctcaagtgatctgcccgcctcagcctcccaaagtgctgggattacaggaacaagccaccatgcctggccttgataagccgattttaactggccatttctccctgtttcctgaggttatcaggaagcttaaagtaaaatgtaaaattttacaacaggaaccatatgaaacctctgtggtcatctctgtctgctcttaagttcctactctttttcacctgtatctcttattctatactatcatcctgttaccactgctgcacaggccactccaatcctttgtggaataaagtagagaagagtaacaacaacaataataatattaaacttctattgaacaagttatgagcagccattgtgctaatcacttttcatggattatcacactcagtcctcacaggattccaatgaggtaggtgctgttaccatccacattttacatataaaaaagaaaaaaatgagaatagaagtttaaatgtgctgaagtatcagatatggggtttgaacctaagttggctgactctggaacccatattctttttttttttttttttgagatggagtctcgctctgtcgcccaggctggagtgcagcggcacaatctctgctcactgcaacctccacctcctgggttcaagcgattctcctgcctcagcctcccaagtagctgggattacaggtgcgtgccaccacgcccagctaattttttttgtatttttagtagagacggggtttcactatgttagccaggatggtctcgatctcctgacgtcatgatccacccgcctcggcatccctaagtgctgggattacgggcgtgagccaccgcgcgtggcctggaacccatattcttaaagtactacacatatatacatccaggcccaaaatactctgtagggcattggtgggaacattgctacattatgtagttggaaacttatgaatgtagtatggaaacttatgataactacctggcttttgaacaatagtttgcagtagaggtcaatggcctacagaccaaatttggcccatagatatgaattatcaggaacctacagtattttttttaatcaaatctaatttcgttttccaggtctccccagtgcccaccattcttcactgcctggctcactcatttatatcactcgtttcaagttcatggaccttgctttagaattttcaagatattctcacatctatcagctcattcagtctttgaaatgttcctacaagcgaggcaacacagaaatcaaaatctccttttacaggtggagaaactaaagttccgggcagttgaactcctcatgtgggctcaaatgccaagaagtggcttggctggaagtagaacctcctgtgtggggtgtaatctcacagcatagatcaccttccccacagaaccctgaagaacacaggttgcctaacagcagtgattagcaggggagtgcatgctcctctaggagaacatagaccagggcttgacagcaggtggttgagaacaggggctccaggaagcctcacctgtagccctgcccccattcccaatcagacccagcaagccatggtgggaagggaagtaggaaacccctgacatgatatctgcgagtggactgtttgccaggcttttctgtggtgtggcatcattccctggggaagtgggttatcctgctgggagaatcctaattcatcccaagcctcagatgctctcaccatcctcaggtggctccctaccttacaactttaccaaaagacagggcatcccagggccacagattcccatttggagctactctctgggcctgaagagcttcagaattggtcctttctgaggaccctgtactctgggagatgatggacactacaagcaacatttcttaggccccaaggcattccctagtctcccttccagacccaaagtcatgagactctgagctagtgaccttgaggggttcctttctagaagaggaggtgcactcgagcaagggttctcaaatgtagctgcacattgggatggcccaggagagcattttcaagacatggattcctgagccatacccaggatgtactgaatcataaactctgcaagcaggtcctggaatctgcattttcactagctctgcaaatgagttgtatgcctaaagggacaggctgggatggagtcttcttcccagccacaaccacaaagggaatgacacacaccaggagctgtggggtgggcaccgaagctggcccaccttccttcaactccaggttgtttcaatgccggtacccagcctgtcctcaacagcatcggctcgcagccaagcaccagttccctgggactccagcttagggtccataagatttaaaacattttaatccaaagctgctgagcaggtgagacgcttccaaatgcccaacagccagctcctaccactctgagtgaaaagggccagacccgaaggccatgaaaccatttgccctgagcccagaaggggatgtgcagagtcagggataaccccatcacctgcaaggaccaccaggtatatgtttttcccacaccaggattggtggtataggggtaggaagcccatagtggcctttttgcttactttctgttaggaactgaagatttggggccctgctggctctgtggcttttgaataggggacacagaaatgcctaaatgtgcaccagccacttctccccatgaggagcctgatcaggtagttcagcaaaaggaagacagggctctacttctttattagcagacagtcctaatggtggtggggttgcaagactcagccaagaagcctaaggctggaaagacctctccctggaagctaaagtgctgaatggatagattcttgggagcaaaaataagacagtgctggagataaccaggccctgggactgcctccccacccccactcctgcctcccctgcctcccctgcctccccgcagcagcaatttcagcatcctcctatggagttctgccatcacgcctctgggctgagctgcccatcagaaccacgtctcacttctctcccctgcccacatgatgtgccaggagctctatgtgacccccttgctctgtgttgctgtcattgccctcttcattgtaggccaggtcaactccctatcccaaaccccagagaagtgccccacgtccttgagatcaggaactgaacttgacttccctaccactcatcaggattcaagccagtgccctgtgcctgaccggctcattcccacaggtgcccgtcactggccaaatgccccctccaaccttcagttccacctctgttcctttccccttgtcctgtccagccagctttcccttgtgaatgagaagggagagagcatgttgccttcagaaacctccctttcttgccttgcaagtccctcgaggtcccgtaacgtatatttcatctagcgattctctacagcctaacaccttgacccacttgcatgctttctttgcagtcctcatctgctctactacagatgtggcctctgtctgtcttttttggtgtcatctgtcttggactctccttctcaggggtgggctctgtgtcttcagctcattctatggtatcccatgcaagctcacacttactaaatgcccaaagcaggaatgatttttgctcaagactacccagaaagaagacccgaggctcctcagccatctccaaagtccagtccagtgttcagggctcctgaacgctcccagccagagctgagctggctcagctgttcagctccctggtcaccaggggacactagctacctcagaggagaagcaagtggccactgtgcctgctgggccgggacatggaaccatcctggaagctcaactgctggccctcaggtcatggagaatcccaagactcatcatgtgtgtggcaggggtgagggtggaggtcagaggttgggggagatgtcagactgggagatagaagcagccacagggaaaagcaggaagggccaaggtaggcagctcttctcagagcagcaggccagcagcctggctggaaggaggggacccaaccacaaacttgtggcctatgaaatccattcccccttcactggggattctgctcagcccttcctcactgattcccttctgactgcacattaaactttactacaacgcacagcttgtaaatggcattaaaacaatttacagcagcctttatgtgccttggtttaaataataaacatttttatttcactcttctgtgaaatgaaattcttggggggcaaagtatggaaaagtatgggaccaggaggtaggggtgggagggccaaatgaacagaaaataaatacaatgggcagcgatggggacgtgtgggttcccagattctctgaccacaaagagcttgtataccatgtcctggccactcggggctttggtggccagagtcctgcgccaagaaaaagcagaagtgaaccacatttgggatgttctagctgtgggccagcatgactactccttaagtggaaatcattcaagctcccaggcctctcgctaaacctgaagcatcagcaacagccagcttgttactttccttaactaatgcctttctgtttcctgcagagtaaacaacttgatcccattagttgttgtaaaatatttaccaagcggccgaggcggctcccttcttcccagcacgtaagaaggtagagagccctgggttaggcctctgaacacagatggacaggcatgaccagcagcttccggtcagtgtcacgtagatgggggaggagtggagggaggactaaaaaggggcggagtgagaaggagcaagtgcagacagacaaagcctgcctcgaaagggaaggagcactaaatgcaacgtgggggcctggatcagctcctgggacagaaaggggcatcaggaggaaaactagtaaaatctgaataaagtctggagttcagttaacagtgaagcatctgtgctggtgttttacttgtgaccatgtgctgcagtaacctaagatgacaacgtcagggggaactgggtgaggggtatatggaaactccctagtctctttataacgtctctataactctaaaattattataaagcaaaaagttttttgtttttttttttttttcaaatagcaaatgtgctatttggaggtgagggattctccatgacagctgttggcatttggggatagcaaaatacccacaggggacttctctgtgtgggacctcactggagagacagcctgtgagtcacggccaaattataactaaagtggaaagggcaggaaacagagaggggcgttcttcccacagagatgaagtcaaggaatcaggccaagagatgctgcgccacctcggagaaaccaccttcagggcaagaaagttcgctggatggaggcaatgaaatgaacagggtggaaaacctgacttgctgcatcgcccccagatttctgactctgggcacatgtggttacacccttccttggccctctcctcatgcaggcaacagtcagggactaacaggcccagcggatcaagatggtgcagagggaaggcatgacggtgaatgttatgcatccaccgggctaggctgcagtgcgcagttgcttggtgaagcaccagtctagatgttgctgtgaaggcattcttagttgtgattaacatttgcaattagtagactttgagccaagcagattaccctccataatatgggtgggcctcacccaatcagttaaagacttaagagcaaagtcaggtttcccaaagaaggaaaattgcctcaaggctgcaacacagaacccctgtctgagattccagcttgccaggcctgccctacagatctcaagctcaagactacaccaactcttacctgcccttccagcctgctagccggacctttggatttcagagttgccagtccccacaattgcatgagctaatgccttaaaatcagtccagctctctctctcatactggctctgtttctttgaagaaccttgactaataccaggcaagccgagggcctggagatcatgggcagggatcagaggccccttctctgctgccctgctgtgactgcctctgtgggttcagggactgggacaccatttactggggcttccaccgcttccttgctcaatcaccaaaataaagccttcacattgactgtcttagaggatgtctttccttgtactcaaaagtgacagcaaatgacaaagatttcggaaatagcttggtggacatttccccctcccctccgcccacccaactctcattttcaacttaaaaacatgttgctcaacttcctgcccagttgtgtgagccctgggctgacagcatttcctcagtggtgaccaaaatgtgccacctgccaaggagataccccactgagtgctgagctacccgatggcgctccacgggaccatcctgctggaagaggctgataatcctgaggcatcccttcacctgaatgtccttggcagcaaagtcagaagtagcacccaggacactgccccctaccccctcccgtggactctaagctgacctaggggtccagagatctaagctgcagcctcagcactccacatggcaccaagtccttgtctccctgtacttctgtgagccttggtgtccccgctctacaaagcacagaaccttcacctggcagaaacatatgtgacccttacagctgggtggatgacagcagagaggtcacatcctaggggtcactagggcataccctagaggtcaaacaacagagtgagaagctgggcattttccagggctgataccacccgcactcaggacactttttcaaagagcagcggcctgctccccacggaagcctggcctcctgcgggacaccagagcatccttcctctgctcagccaagacaccccttcccactgcagcagcctggcactctagctcctgccctcagctcaccactgacccaggagggacatatcctcagggaggtgggagagcaactccagcctcaatcagcctccactgcacaggacagcaccggcggcaggcgctttagaaatccagggcctctttgggagcttcttttgccttcaagtgaggactgccagatttaacaaacaaaaatacaggacacccaattaatttgaatttcagatcaactacaaaacatctcatgcattatttgagatgtgtaataaaaattatttgttttttctctgaaaccgaaatagaactgggtgtccaatatctcatctggtgtccctcctccttcaaaaggaggagagccgtgagggctacagcatcagtccttgcttgtcaccagcctctgagtgcctagtcccagttcctcacagctggagccactcactcagcccggcctaaccctaagctgcggcagaaggggtttaaccagttctggccccacacgaaagcagagccccaggctcccaaacagctcacttgcccccaagccctagtcttgggtggcattttttggacctatatgcctgtgctggtgttccactgggcacttcttcaaggcccgggacctgcctgataatgccaggttctttgcctgtcctcatatccactgtctgtaccccaacataataggtagagaaccctgactccggggggcagtcagtcacttcatctggtagatctgagactaaagacagttataacgcctgaaccctgcacttacaggtgccaactcacccgctagcacctgcagctgggtgaacacctcacccaagtaagtgggactcttctcaaaccccagtttttccccacccgccctgtcatgccctcccgtcctacacagctccaaccccgatagccatggttcagatcttagctaagtctggtttttgatcaagaccactcttcaaaataaggccgacaaaaatgcaaccagggaccatgccacgccagaaatcccaccacttcccctgaggcatctgctccattttttagcctgaatcccaggatggtcctgccgccactaaaaagcagttgcctgcttccattactagattctcctattgctgcttcccaggagctcaaagcccacaaatacttagcttctgattagacaggtttcttcaccacctcggcatccatgctttctaacgagagacatagcagggcatccatattttactgaggactaaatcttttcttctcatgctggtttttagatcatagcatttaagtctgatcaaggctggtaagacccttctgggcttctcttaccagatcttacacacccttgagcccctgccatcgtttggtaagaatcccacaatagtgtagttaggcaaaacccaaggaaagcaaaaatccacacagttcattcattcagtcattcactcaggcatgcctcctctgtgccaggcactgaattaggctctgtggctatcagggagagcaagtcagcatccctgcctgcaaggagatcacacgttacttagggagacagtaaaagtaaacaggccacttcgaggaagtccagtgcatgctttgatcccctgggatgagctgtctgcttaatggctgtactgatttttttcaaaagtagtttgcaataagactgaaatcacacttacatatgtgtgagcttactctggccattgtgccaatgccatcaaagatgatcttagcgtggctgactgctacctgtcattccagtctcatcataaatgtcccttcctctgagactctttccccagctgcctgatctaaagtggcctgtccctccgtcctcatatcctgttttattgttactatggcatttgtccatgtctgggcttttcttgtttgttcatctgtcctccactgagagcagattcttgtccatcatattcaaccccagaacccagcatagcgcctaccccattcaactttgctgcacaaatgaataaacaagtgaatgaacagaaagaacactaaccctgtagttcccaacctctaggggcccttgaatgtcataacaggtcactgcaagctattttcaatatattccaaagcctaacaggcttcatttgtttgcttatccttgataaagtcccacaggagaaacaaaatgtcacatttctttgcctttgactggaatgatatcaactcagcattaccggtccccatgctaatcagaaactgtaattagaaaatatattttgattattaaaagtggaaaaacaaaagcatcataacatcagagccatttatttagtgggtaacatctttcaacacaggaaaccacggagcaaaatatataaagaactaaagggttctcatgggagagaagagactgggaatagcttcctatttcctgggtggctaggctgaggcttgaggtcatacagaggaaacccgggccagagttcagtgcattaaaccatctgaacaaaggaggatgtgactaggccataaaaatattgctcataaaagaaatcatgctctagagaaagagcaatttaaacgaaagctggaattattattcgcagcacagatactgtgtatctgcaggctcgctgctctcaaatggatcatccatttaatgctggcaatcttcagaagcactaatgaagatctggaaagtgtaaacccatcagtggggcgccagcatactgcttttcatttatcctaatattttaaagaacataaatggcatgggcacttatccctttggaagttctgacctttgaatagcactttaaacgcttcaattaaaggcactatataaaaccacagccttgtcatttcacttgatcaaatgactggccttggaatgcaaaacttcaggggaaaaatagaacagtccaggtcaactgggactccagttactggaggccaaaggggctgttatgctgttatctaatctctgagctctggtgtgcccctgctaccgagtgtctgtgccactgatccaactagggcactgggtcctggaaggagccccctgttataaggagagggctttgagcaggctcactgaaaggagagaggatccccactggccagtccttggcaacggatccctagagtaaccacttgaaaaggactgaacagtggaaacgttacttctcctgccttccagggcagtgggagaaagaccctgctagtacggtgactggctgctttatttctcttatgaaaagtagcccaaccagagaggacagcagccacagctcagcctaacaataggacctctagttatgctgaacaggagcaagaagagacctagacagcgctaatagcaatgattctccccacttgcattctttcaatccaaccagcgtgcaacttggtttagaaaattaggtatgttgtttaaaattcaattaaaacttcaaacttcgagtcaaattaaaagtcccaggggcacagggaatctacagcagtggttctggttctcaaacatccgtgtgccccaaatcacccaagaggctcatgaaatgcagatccccaggccctgctcccaaaatgctgactcagcaggactgagggggacactgtgggagcctacattctaagaagcttcccaagtgattccaaagtaggcaggtgatgatgagtgggtcccactttgagaaaatgccaagttgaaggtgatcatcttctggtttaccattgtccgtttggtaggttcgggctcatctgtccccactctcctttctcgggacacttgcctcagaagtgtggtcatgagaaaggatcaatatttagatcagtaaatccagatgcagaaagagccaaaaaccatctcaggcgtactcctggaggttggtccaagatcctcagcctcagggcatgggaagccactggccagacattatgacccagatcactgagccatcactcaccacaatctagtacctatgattcagatcaatgtaccagggtctaaaatcatccagcccaggggttctgggtctttcgtgtgcacctgccatggggaggcctttacatcccttctcagaatagcacttataaatgcaaaaaacaagatgcatagtattataaaggacacaaattatattgaaatcgggtatttcaaaatattttttaaactcgtgatatagtgatacaagtgtttcttcactgatgcattaaacaagatctagcagcaggtctaactgctgcagtttcaaggtagtgacatgataaaaacagcatttcaaaatacttgcaacactacacacgatcgcaaacacatggaatcaacttaggtgcccatcaacaatggattgaacaaagaaaatgtggtacatatacactacggaatactacacagccataaaaagaatgaaatcatgtcctttgcagccacatgggtgcagctggaggccattaacctcagcgaattaacacgggaacagaaaatcaaatctgcatgttctcactgataagtgggagctaaacactgggtactcatggatacaaagacagcaacaatagacactggggactactactagacaggagaaggagggaggggacaagggttgaaaaactaactattcggtactatgctcattacctgggtgatggaatcatttgtatcccaaacctcaccatcacacaatatactccatgcagcaaacctgcacatgtgccctatgaatctaaaaagttgaaattatatatatatatatatatatataaaattatatattatatatacacgtatatatatgtgtgtgtgtgtgtgtgtgtgtgtgtatatatatatatatatatacacagctgttgcaggtatatatatatatatatacacacacacacggctgttgcaggtatatatatatatataccttgtgtaaatgtaaagctgggccaagcctgggagactcaacttggcagctacggcaccaggcctggctctaggaccacatgaaaggcaacagcccttctcacagtcacccggaggaacaatgatcaggtgctttactgtttttattcatccagcctgaaatcaccatgtggcaactacactctatctgaaagtggataacactaactcagcttagtgagatggcaatgggcccaatgttgtctgctgtcaggcttaggtctgcatgatggctatgctcccttggccccttcccccatacattctctctgaccttttccaccccgccctgagcctgggaagctgagcactactaacccatcccctggcctctcagccctctggcttagggttgggttgagcctcagctggttggaggcacctgcaggagaccttcaggagggaggaaagaaagactaggcatttactcctcacctcctgctcaacaccgcaccctggtagttacagctcctgtcggggacctctgccagggctccagggtagctccctccaccagtaacactattccctgccctgcccctcagccctaggtggtaactgcttcctgctggtgttagtccctgagcatattcccttacctttgccaagagagctttcaaaaaagtcctttccatgaaagtcccctcagtcacacccactgcctgcaacagctgtttcctacaggtatcccactggcacaactcttcactagctatataacattgagcaagtcatttcacctctctgagcctcagcccctgacccgtgggaagggaaccacggcacccacctcccagcgggctgggctgggcgaattaggtgggacagtgtgcgtcaagcggagagcagggtgcctggtaagggcgttctcggtgagtctgctttcattgcaggcaggtgctgggctctgagaacaggctgctctgcagtttattcttagtaaacacacctaggacatcctttgatcatcagggtcagaatcatctagggaaggtctttgggtggactaaggactccaagacctctgcccacagaagcactcagcagtcagtgggccactccccagaagaagaaaggaagacgtcaggttgacctcaggagagagagagaagccatgtgggctcagggcactagatggtactgctagatttactcatttacctccttttccactctggccaagaatccccacatctggcacatgcacagacctttcatacacaacgtcccatgacatctccacaacattataatgtgggccttattacactacttattttttttggatgagacaaagttcggagacattaagagaattgtccaaagtcaattatctgccaaatacgagaaccaggctgagttctcaagttttctaagcaatatctcaaattctttttcaatagaagatgtaagatagcagatacaaatggctcaaccaaaaccctgcccttcagtagttttaggctagagaggcccttccactgagaaacagaaaaggcattgaagagatacggtcatctgcctaccagccattgagtgtctgtggtttcaatgtgtaatttagtgaaaataatttcagtaaaaagcacacagataaaagaaacatctgtttaagcacaagttggagggttgaaaagctgaaccccctgatttcccaagggacaatatttcttaagccttggttttatagggaaaagtaagccagtcttgtggctctaccctccttgcccatttgtcattaatgaaaaaacagtattagttctccttgaattaagaacagaaatcacagcccatttctatttctaatagaaatagtcaatgctttatgtatccatcctaaactgttacttatcctgaataaatactctcaggaattcaatttgatatcaaatatatggctaatgaacactatgatctgaacatctgtgtccccctaaaattcatatatagaaatcctaacccccaaagagatggtacgaggaggtggggccttaggtcatgggggaggaaccttatgaatgagattagtgcccttataagagaggcccaagagagctgggcatggtggcacatgccttgagtcccagctacttgagaggctgagcaggaggattgcttgagcccaggagtttgaggctacagtgagccatgattgtgccactgcactccagcctaggcaacagagcaagacactgtatttaaaaaaattaaaaataaaaatgataaagaggcccaagagaggcccctcaccccttctgccatgtgaagacacagcaagaaggctctgtgtatgagccagaaagcaggtcctcaccggacactgactgcttgatcttggacttcccagccttcataactgtgagcagtacttctgctgtttagaacccacctagtttacacattttgttatagcagtccaagcagactaaaacaatgccaaattatatttcccctactctttcaatgggaattcccaactctccttgaatgtttagtatttacaccatctcaatccctttccgctccctgcactagatacatttcacagtcattaattcctataatcagctgagaggaagaaagatgttattagctgtactcgacaggtgaagagaccaaaggcaggaaggttgcatagcctgcccagggtgaggaggaaaccagtaccccagccaggaccggaaccaaggaggtcccaggtcatggttttctctgccaggctgagcagaatctattgtgaccattcagttttccagactatctccacccaaaaggaacaagtcactgtggtctccactttgccaaaaatccacataagatccctggacacacacaagcctaccaccaaggactttcttcagaacaagccctatttaacttaaacagggccaatgtcccactcctgccacagggaaaatccttcagcggagggaaagaactgattatacactcctaagcttaataggggaaggcaattccattctgaatagactgaatcagccttcacagaccatggggaacctgttcataaaacatttgctaaccattaactacagtcctgctaataaatgctgtaatagcagctcctcagaactgtgccccgccagtctagctgcacctttaatcggctagcggctgtcaacatgacaccaggggcccagccatggtgcagctggggtgatgtgtttaaattaaacagctctatcagttccggtgcttggggcccagcaggtcacctctctccaagggaagccagtgaggggcccgaagacagccaattctgcagaaccacctggctctcttttgcattgtccttcatcttgccagtgctccacccagccaggacttttctagggaagccccaggacacagcagtgtgatgggcttctatggccacaggactgacggaggctgctttctgattggcacactttcttcctaggaggctttgaacagaaggcaggacttcctctagttcttccttctgcattcctgatcttcccttctctttcctttttcattgttggtgtttctcttctgccattcaagtgatccctggatcatccagccacagccaggcagtcagctaccacccatgaacctggccttcttcctgagctcaaccccttaccagacatcccatttggatgacctatagatgcctcaaactcaactcatctacaacctcatctccacctcccataaccaaggtgctcattctccacccaactccaatttcaacagcaagcaagttcctgtctccatccagcttctcaaaccagaaatatggcctcttccttaatttctctttctcgaccatcaaatctgttataggtttattaattttacttccaaaatctctggcattcaccccctcttcctctctctcatttaaaataaaatcatgccaccacagtctggcttcccacgatcactcccaaagacaactgagccccctttttcctcactccaacatgcagtctcaaaaatactatcagagtgatcttcctaaaaccaaacaatgaccataaatttcctaaaactgaacaatgaccataaattttgtggaaacaaactcatcatcctgtagctcatatgccctttcccacttggtctccaaactctctgaccactatcacctccaggtactttccctaagaaacctgatactccaagtacccccagaccactgtgcaacctcaagaaaaaaggtaggctcagcaatgcctgcaagtgttggctcatgctatttcccctgccgagtatgttctttccattattcctcatcctttaaacttagttccttgcccttttcagaataaagtccttgcagtctatcctccacctgctgagaactcattaccacatcttataaccctcccatcctcccccaggtgcctactgctaccatgagcactgaataacccttgaagacaggatcacagtttacatgtattcataccccggcatttaatatagtgcctaaaacagtttcaataaattctttttgttgtggttgttgtttttggaatcaagtcatactaattttttttattttactttaagttctgggatacatgtgcagagcgtgcaagtttgttacataggtatacatgtgccatggtggtttgctgcacctattaacccatcatctaagttttaagcaccgcatgcattaggtatttgtcctaatgctctccctccctttgacccccacctcccgacagaccccagtgtgtgatgttcccctccctgtgtccacgtgttctcatttttcaactcccacttatgactgagaacatgtggtgtttggttttctgttcctgttagtttactgagaatgatggtttccagcttcatcaatgttcttacaaagaacatgagcttattcttttttatggcttcatagtattccatggcgtatatgtgccacattttctttatccagtctatcattgatgggcatttgggttggttccaagtctttgctattgcaaatagtgctgcagtaaacatacatgtgcatgtgtctttatagtagaatgatttataatcttttgggtatatacccagtaaagggattgctgggtcaaatggtatttctatttctagatccttgaggaatcgtcacactgtcttccacaatggttgaactaatttccactcccatcaacagtgtaaaagtgttcctatttctccacatcctctccagtatctgttgtttcatgactttttaatgattgccattctaactggaatgagatggtatctcatggtggttttgatttgcatttctttaatgaccagtgatgatgagctttttttcatttgtttgttggccacataaatgtcttttgctgagaagtgtctgttcatattcttcacccactttttgatagggttgtttggttttactcttgtaaatttgcttacgttccttgtagattctggatattagacctttgtcagatggatagattgaaaaaattttctcccattctgtaggttgtctgttcactctgatgatagtttcttttgctgtgcagaagctctttaggattagatccatttgttaattttggcttttgttgcaattgcttttggtgttttagtcatgaagtctttgcccatgcctatgtcctgaatggtattgcctagattttcttctagggtttttatggttttaggtttcatgtttaagtctttaatccaccttgagttaatttttgtataaggtgtaaggaaggggtccagtttctgttttctgcatatggctaaccagttttcccagcaccatttatcaaatagggaatcctttcccctttgcttgtttttgtcaggtttgtcaaacatcagatggttgtggatgtgtggtgttatttacgtggcctctattctgttccattggtctatatatttgttttggtgccggtaccatgctgatttggttactgtaatcttgtagtatagtttgaagtcaggtagtgtgacgcctccagctttgtactttttgcttaggattgatttggctatatgggctcctttttggttccatatgaaatgtaaagtagttttttctaattctgtgaagaaaatcaatagtagcttgatgggaattgcattgaatctattaattactttgggcagtatggccactttcacgatattgattcttcctatctatgagcatggaatgtttttccgtttgtttgtttcctcttatttccttgagcagtggtttgtagttctccttgaagaggtccttaatgtcccttgtaagttgtattccgaggtattctattctctttgtagcaattctgaatgggagttcactcatgatttggctctctgcttgtctattattcgtgtaagtttcaataaattcttgaaaatgaattgcatttctccctggtagtacctaggtatataattttgcctggatggaaaagatttgagaaggcagccctacagaggggacttccaaataaggatttgattctcatttcatcctgttgggcagagagtttgcttttgcagatggcaaagaaggagagacagcaaggctcatgtttggctccaagagcatgcagagtagacatcacatctagactggtggctattggctctctctcccagacaagctgctgcaaatgcttgatttgagtagggatagagactgaaattcaactgggtataaatctgctattgtgttcctactgtgtgcaggcacacaacttaaatgtaaaagaatgtctctgcccacgcagctgtcactggctcccaggaaagtccagtcacagacacaaaactgaggagaataatataagatggtaaatttttaaaatattagatctagaaactgccttccagtcaactatcccagtgctttccagacctccctcagaggcctggagtctgtggttgtgttgtcccaaaccctgtccccgaaaaccaaaggaactccacttttacccagttcatatctggggactaaatttaactaaagggactccactggaggaaacatttgaaaatgaacatctattctaattcccttagattattccatttatagaatacccaagagtggatgttcacaggccaaaatatacaacacaaatatatcgctgatttcggctgggctggcagaagtgagatcatcctattggatctcgccagacacaagtgcacctgagatagacaacagtcatagctcaccatccaaacaccactacctgacattgcttctcggaaatggctctgctctcaataaatccaataggggaaggtgaaggggactggggaagaaggagtaagtatattttaaaactacatagccaggtcttctcctgggaataactttcccattgtctgtattgatctccagaataaacaaagatgagaagggaaagagtggtaaaaaaaactcttcgcacgtttaaagtgatttgtctcctccctccttgctggcagatgaagcgctcacactttcaggctggctgagcttctccttgggtgatgaaaagtgggggagatggaggagtggccagaagcaggccccaaactggtctcttctctccagatcagcccagaagacctcccagctctgttcacccacagaatatacagcccagatatccatcttggtcctttattgtctactcattggttttattattttaaatattatgtggatgcttgaggtctccagagccctgagggcaaaggtgatgtctgatgtttcacactcttgcctcaagcctcccgcttcctcactcctgctctactgagggctgagatgatggtggaaaaagcactcctgtgggtctgtcccagtccctccactgatggaacagtgatgtgaacttggacaagtcagtagcgctctcagagatccattttctgcatcagaaaaacggggagaatacctttcaggaaagtggtaagaattaaggcaaattaaatgctacaggtacagcacgcagcttagtgcctggcaaagatgagcagacaagatcatgagcagatggcatcatgctggggaggggagtcagggccagcaagaggccaggaggagggccttggaatgggcagatgctgctgctgcacaccttcctgcctggtcaacttgatgatggtccggcagggcctcagatttgcagactgtattgaaaaagttatgtgtgacttgaagcactatggaaggcatcacattcaaatcgtgctggggagcctctgaccttgagatagaccataactaaccctcctacaaatccctcctgccgggtgtctgaggagaatgaagagcccagcagaagtcaagaggcagacctgggtttgagttccagctcagaatatattcatgccttgtgacttacctaagtatcccccagagaccatccaaaaacttaacccatgggaagacagtagggcacagtaacaagagtacaggccttcgagtcaggattccaatccccgccccaccctcttcctacctgtgtgacctagagcaagtggctcaacttctctgattcttaccttacctcgcctacagggctgatatgtgagagagatgagatcatagctgtaggtgcccagaggaggaggcatacatgacagggccctttttcatggccctgttgcccctttccatcccatggaggttacattctgagtgtgcttgctgttccatgctttgcatcggctcctcagctgagctggttgtaggcccccccagaggccagggcattaccattaagggagaccgatgaagaattcctagcagcctcccagctgtagagcacccaggtgcctgtcagaagccagaggagtgaggctgggcctcgacagggccattactcacccacaccaccggagactccagcagctgcgaaagggtgcgggggcggggggcgggggggtggtgtccagccatctttaagggtctgggtttgctcgtgaaaaagaaacaaggggcttatttatgtcactcaggcccagtgagcagggaggggccgtgcagggaagcctttaatgagcactcttccctcagaaatgctgacaggagttggacacgaagtacatctcggccaaaacatcatcatccccaggatcccagtggaaagataaacctgactgcaaatattggtttctgtgaagagccggagcacagagcaggcagcccccagggctcagctgcaggtgcacagagatgcccgcccaggccaacactgccaccactgagagcaccccccaccccccaccaaggccagcctgctcccacggtgccacacaatgccagcctcctgagctgggctgccctccagaaacagaaaggagaaatctagtcacatagaaagctgcccaggctgtggaaaatgcaatttccagacccagccaagctgggaaaggggcaggctgctgcacacccacctacctcaccccgacattgcccaggggcctggacatcagcctttccctaccctctgtaacaccagtgacacagtgggaccaggacagccttcctcagccaaaagtctccttttccttcccccagcagtcttggcatcatcatccctcagtgaccatagtatctgccctgccattacctcccgccagcccagggtcctctctccccatcacccagcctccctggccttggtccccttatttgtcacataggcaagggcagggggccaaacaggagattcccatagtcagtctcagtgctctgtgctgcagagaggaatggcagcaggaacctctgaacttccagccatgcagtgagcccaggagcaaggggtccatgtccccacgggggccaaagagaagatgagtgcccctcgttaccctagagaagccctgagagtctgggaatgccgtgctgagtgcagaggcacaggggtcaccgagagactcaggctgtcttcacgacatccccggactttgcagactttgagcatcctcttctgagccggttttgtgccggcagagggtgcactcactcaggaaagcagggtctgctcaggacattaggtctgctgtaaaatagggtccctggctctgcccatggtagctccatgactgaggtggctttccatgcctcagtttacccagtttcaaagacaggagagcctacccctctagcagagggaggacttaagagttggagccaacttgcacagcaaaaataaacctctgtcacttccatacagcgctctgcttctaccactatcagctcacttaattttcattaaaatgttataaaatgggcatgtctcaccccattttccagacaaggattaaggctcagaagggctcagggacttaagtcactcagtggctaaggcgagtcaggtagtctgggcatgcacaccgttactcctcctgtgacctacagtcttggggaggagcaggcaggaaggctggggacttgggcccctcattctggaacctgctcttccttcgtgtgggccttgactctctttctctgtacctgaaacaaagctcaggagccaccccttcctcctgcctcaagacagactcttatcctttccccaagccctgcccagaaagggattccaagtccactcccaaaactggaaactctggtcagaaccctggagcccagaccagcagacccctatgttccagttgcttctgagagaaggcagctgtagacttaaaaaggtccataattggctgggtgcaatggttcacatctgtaatcccagcactttgggaggccaaggcaggtggatcacttggggccaggagtttgagaccagcgtggccaacatggcgaaaccccgtctctactaaaaatacaaaaattagccacgtggggtggtacacgcctgtaatcccagctattcaggaggctgaggcaccagaatagcttgaacccagcaggcgaaggttgcagtgagcccagattgcgccactgcactccagagatcacgccactctactccagctgggtgacaaagcaagaccccgtctcaaaaaaaaaaaaaaaaaagaaaagaaaagaaaggtccataactaatagcaaatgcattttgaatagtgcagagctactcctgttctacctccccctgcaaagaagccacactagagacagttctgggataacctttctgaacagagcagctcaccactgccccgtgcagacagggcaacaatggggcccctaggtgtttaagatgaggctggaggactaataataaagcagaaacaaaacaaatgtccctcagctgatgaatgggtaaacaaagccagcatatccatacaatggaataatatttgctaataaaaaggaagaaagtactggcacgtgctacagcacagatgaaccttgagaacatcatggtaaatgaaagaggccagccgcaagaggccacgtattgtatgattctatttatatgaaatgtccagaataggcaaatgtgtggagacagaaagcagattagtggattagtggtcacctggagcggggtggggcatgggaattgaatgctaatggtgcagggtttcttttggaggtcaaagatgttctaaaattagattatgtgcttgttgtataaccctgagaatacactaaaaccattgatctttacttgtcatatgggtagactgtatggtatgtagattatatctcaaaaaagctattttaaaaaataaaaagatgggatcgccacctttatctttcttctatagagagggacagggaggaagctaagatctcaggaacagcattaaacattctagttatttaccacaaggccacttaaggaaggtgacattctgtgtttgtgagagtgtacttgtgtacacacaggttagacagtctgaatctgccctctaatcgctgtatttatcatttattgcatccctgttacgtagtaagcactttgcttgtatttccccagttattcttcacaatagccctaggaaggaaacactgttataatccccattttacaaatgaagaaatggagtctctgagaggttgaatgaatgtgatactttacccagggatgggcagaccctgagtgccggcaccctgggatttaaacacatgcagtctgtctccagccttcccttttaaccctgaccccaggagccttcatttatggcaactcaggatcacaacctccccggagcagcagggcctgagcttcctggaggcttgacacccaaaagtaaaagctgaactcgcaatagaaagatgtctttttcttcccaagaggccttgggcaacaacgagatggatttccttttaaatgactgtccactgttgtgtgtgatagctctttggttttatctaatcctgctcagttcacgttactgctgtcatttgtctcctccatctcgatggggtgatgaactgtcttgctcagtgagaagcaggcactgagacagaaaggaaagaaatgcatcaaagctggcctggaccgagagaagaggaggaggatggcttaatcaaccgggggcaaagtcacaatccttcctgtgtccgcttacccccaccctccgagtcccatggagcatcctccaagtacctctgggagaaaagagaagaagccagaagccaccactggagtgatgtcccaggaagctcactacctcatggcagggcatacagtgggatccctcgaccaaggacttcttcccaggttgaccacgggctattccaccatctactcattcacaaagtgccttcctaagttcagtcaggacctggcactcacccagcttccagaaaggagcccataaacataagagatcagttttggtgttagaaaggggaccacgtaggtcccattgttcctctggaagaaacctagacatggccacaccatctgggtcttgcctaggctgtcctgtcctcaggaacagagatgctgagagacctctgggtgtgtccctcacctgaacaccacctccttctgaaacctgcccattttacactgaactcaaacaagcttgcacttaggctccccaaaccctgtgactcatccattttctcccagcctgaaaaatgctcggcagcaatttatcggcgtgcccaaggggaggcagctgacagccaggagccagcacagccgaaacaaacaagggcaatgctgtgaactgcacttccaattttaatgcaaaatcttgcctcctaaagtctgaatttttcttcaggttcatccaaattccagcgtgtagccacatgcccaaatcattgcattggtgggatgatccaaaatcctttgtccaattgcaaactggaaaatttggaagtttgagtaatttgacgtttaaaggatgcagagaggctggccctacccagggacaggcactgtgcttgcaggagcaataagcactgtctggtctctgttagcaaacagggaccagggcctcctcaggcttggaaaaaatgaaagtagaaccagggtcatgggattgtagattacacgggatcattctaagtgaagtaactcagaaatggaaaaccaaatatcatatgttctcactcataagtgggagctaagctgtgaggatacaaaggcagaaaaatgacagaatggactttggggactcggggaaaggctgggaagagggtaagggataaaagactacaaactgggttcagtgtgtactgcttgggtgatgggttcaccaacatctcacaaatcaccactaaagaacttactcatggaaccagataccaccagttcccccaaaacctgtggaaataaaaattttttttaaaagagaaagtagaaccagggtcaaccaaacatgtgcctagtaagagtctgagttcctcctggacttgaccttttccagctcttttttgaacaaagtccggaggacatcagagcatccagaggataatggagagccagtgactttgaggagagcaattaggagctgaaatcaagggtggatggaaaaacctcattcagaaactggtgtcaagtaacatgagctccaactgtcccagcccctttccctgcccacctagacagacaggcagggctccacacagccagacccaaagtggtggaggcactgtgagttctgtcactgtgtgtcccgggcctacctctcctgccctgcctgatgacctggctcacctggtcccaggaatctgccccccggtttctaaggtgctctgcagctcttccttctcgtctgagcctcccttcctctggcccctgcctgcctctggattctgacagctctctgttccttcagacccaacagtgggtttctgggctctggggcaggacggactgcagagtttataaggctaagtgcaaaatgaaaatgcaggattcttgctcagaagtcattaagaatttcaagacagcaacaacagagcatgaaaccaagagcaggcccccatgcaactgcgcagccacacacccagaaagcggcctggagatgctgacttagcaaccaccagtggagacggtgcccaggagacagtgaggctgcagggtgggggccacccacgtgtgggagaaaagagaagagggcatggggaggagtcagaaagggagatgtgctagagacacgtggaagaacatggagaacccagagcaaaaaggagcatttcaagatggaagggtggaaggcaccatcttccctctgctgtggggtgcagaggtggagggcgagggcagaaggagcttggttgtcttcctggcatccagtcaacttcctccactgtgtgtatgtctcctctcttttctctctctctcacacacacacacacacatacacacacacacacacacacatacacacacacacacacacgcatgcggacgtgcagagatacacaggtcaaaatttttgtctctcttgctctctttttttttcttttgttccctcattgctttcttcctctctttcattttcaccttcgcctgacctctcctctctttcatcctctttctgccctatatctttccttctctcatttcctttctgtttcacagccccttactgtggtttgcttggaaaattctgccttcctttgcctcttccttactagacttactgccttacaacctggaactcctgcaggtgaaggagacctagaggacaactaagtccaattccaaatgtgacacaggcatctctcctataggatccctcatctcagtggacagggacaaagtgacttccctcgaagccttctagacaggaggtaagagatgagaactatgcagactagggcaccaagcagagatgtgccagacagggtggctcagtccgtaagactgccaccccagtgctccttccatgacatgtgacttctctgccttgctctgggcttgctgattgtctacttgtgccttctttgagccctgcattttttacacataatgataaattggtttttgctcttaaacagttgagtgttagatgcacagaagatgtcaacaggcaaagaatcaaagttcaggggaaatactaggaactttagggcacaggcaatctttacagggagaactcctccctgcactgcttgagtgatggcagcaagtggtcacctgggatagtacgtaagggcttccaatctggactcaaacacccccagctccaacgctaaccagctgcgtgatcttgagcgagatatgtaggatcagtgctccagggtcctcgtctgcaaaatgggaatatgaaaagggactcactctgtgggatttttgtgaggtttagataatagaaataactttgccctatgcctggcatatgatatgcactcaaaacatgttagttatagacatgagacttaaatataaatatttgttgcatgttgactatatgcagatattgttctagacatgggaaatagaatagtcaaaaaaacaaagattttgcccttgtggaccttgcattctagtggaagagatggacatatcagtcgataaataatctctactatgacaaaaattaaatttggggaataaagagggggggggaacagcatttggggaacgatgcaagagaagcctcctctaaatagggtaatcatgcagcttcctggagggaaaacaactgcaaaggcctgagacatgctgtgggtttaaggaccagctaggggccggcgggactggggcaggaaagtgaaagaaagaagaaaagagatgaggtcagggtggcagggaaggagatgtcagctcatatatggctttggagtccttgatgaggactatacattttattgtaagtgtggcaaacagccactggagggttgtgacttggagtttgacttggattcacattttaaaatatcattagcctctgtgggcaaaagactaaaaggacaccgttacagaccgctggatggtccaagtgagagaagatggtggcagctgtgctaaggggaggaacagaacgctctccttccattgccacacagggcctctgccttagaccaggctggctacctgtctacctgtatatttatttgggccctgagttctctgtgcatagtaataattaaatggggttttacactgccaacagctgcctgtgagttgaggagttagaagaggtaaatgtggatgagaaatggccccatggtgcagaggaagtaggaaatagaggactacagctcactgcccaggagaagacacagactgaagggagacggtgccagggagacggtgccaagcacacagcaccaagcaaagcacacggcctgcagagtcagccctgatgggtcccactctgagctgcctgaccttggagaagtcacttgacatcccaagctttggcttcctcatctgtgaaatggagctaacaaagggcagctgctgtgagtgccagtgacagtccatatgcagcgctaggcacacaggggttcaacagcccccgtgcatctttgggggatttttttttttgcttaaaaccaccactgttttttatttctcacatctctgggtaagcttgggattctgctgacctgggctgggcgggttgatctgggctgggctcactcatgctgtctgtgggcagcttacaggtctgcctggggctaactggttcaggatggtctcagctgggaagtctaggccctgctacacacaatctttcatcctgcagtagtggctactatacttgttcttaggcagtggtagagttctaagagggagacatagagaaaaaagagagagagggagagagagaacactcatgcgagccctcttggaacccagactcagaattgtcatattatcacttctacaatattctattggccaaagcaaatcacagtcagcccagacttaagaggtagagacactgactctcttgactcagactgtaaaggccatggatactgagaagaataggaaaactggggccatgctgtcctcaacccatggcaacaggatctaggatgtgactgtggttttgcccatggatcttaatatggttgggatatttgtcccctccaaatctcatgttgaaatgtaatccccagtgttggaggtggggcctggtgggaggtgttcaggtcctgggagcggatccctcacgaatgacttggtgctgtccttgtgatgagagtgagctctcgctctgagttcacacaagatctggttgtttaaaagagtgtggcacaccctctgttctctttgctcctgctctgtgaacagagcacgtgagatgcctgcttcccctttgccttctgccatgattggaagtttcctgaggtcctcgcctgaagtagatgccagcaccacatttcctgtataccctgcagaaccttgagccaattaaacctctttcctttataaagtgcccagtctcaggtattcctttagagaaaagcaaaagcaaactagcacacatctttcatatgcaaatgtgtctcctgcatctttgagcctccacccacctagaagctgctcctaaaaggtttgttgattgatctggaagcaatcagaaacaatctctgcgtcctggagatcggcttgaaaagtgtttcttgaatgatgcagaatgtgtgtcacagctggacatggcagcatttctgagaaatagagaggcacagcaggaagaggctcagctggcctacgcccagctctgagagtgacagcgtgtttacaagagctattagggaccactgctcctccgtgctcacgggatgatttactccaccaggactgccaggctgctgcttttcctttcactgctgaattgatgattgaatcacacatattccatctcaataacatgatttcactttgaggcaggcaggaagttcaaagcccactgtaagaagacccttcccccatgctgggctttgcgactctgggaagttctacagacacattcgtgagttagggaaagaaatctctctaaagcacactacaaacaactccgacagtcccaagtcccacaagagcagaggctgcatctggttgtttggcagagaattccctgagcacagtgcctgacacctacttcaatgaacacttctagactgaatgaatcaacctatccgtctacctggtcagaagctgtcttaactcgagcagacacagatgaccagcagtcttggaaaccactgtgtatagataacagctggaagaactggagaaaagagttgagtaggaaggaggccaggacatgatgctgcccacaaatatttagtgagttgtcctactcaagtctcctcccatttattgagtacccaccatgcaccacacaatacaatccttctaacaagtcttcaaggtctattctatgactcatattctctgtacgaagaaactaaggctcagagaagttcagtgactggcccaagaggacgtagctcctaagtgccaggcaaggatgccacccaatgtctcatccacagctccacacttcagaaccaactctgctcctgtctccacccccgctctgagaccaccatcctctggagatcccttttctgtgagaagcctgtatcaatcagcaaacagtggcaaggaacaggtcctacagaaatggccactggaggatgaggtcaccaacatttccatggggtaagtcctatttaattcctattgcaaacgcaaaaggagcactagataggggtgtgtatacatatatatatatatatattttttttttttttacatgtacatatacatttagtggcctcaagaaactcaatccatttgaaaaaattggaaactatgaataatgcaataatactgtcttactgatttagacagtaaatatcaaaggtagggaatgatatgatttgtcacccaaactggaacacttttaagaataaagaaaggcactgctcttggacaacaggtgtaaactcatactagccaagatgaaccaggacttaagatcaccatagctagatgatcataagccccaaagttagggacgctcagctttccagtgccttgtacaagtgctgaattttgcacaatgccactccatccctcatgacaacagcactgattgtagatgtggtagagaaagtaatgattactgttgctatttatattagtatagtaacaatccttataataattgcagcttctgtttattggattctgcagaaaatgtgctacgctattacaaacatcaccccatttgtttctcacagtgctaagcagtgggcatttttagacccactttacagataagtaaaacaggtacaaagaggttaggataaacgacaagcccaaggtcacagaagtgagtattccaatgaaggagagtcctattttaaaggatcttgtcttaattacaagctacaaatcttcccattatttctttttacctacattcctcaaggaacttatgaaatctaatatacacacccatcttttaccattcacaactcaactcctaccatctccagcagtttctttctctccattttaacatctgtctccctctttaaattctgtccttttcccttcaattaccccaggaaatattttatcctctctctaaatatttctttccccatcttcactgctgctacaaacctccaaagatactagtctcatctgataagtctatgagcccctttatcagggcaaatgaaagcttaggttgcaaaatgaaattttaaatgataaacagttttatcattcaataatgacattgaaagtacccagaagtcccctttcggaatccccagaaatcttcatttacctccttatctgtctctaattaaaccaacttttccctgagcaccaggaaaatacacatatttctcactcaattctatcacctttgggcgtcattccttaattagcaaggtagccacatcacttcccagtttccattgcgtgtgcatagcttttcagtcacagtctaggttaaaaggctattatgggttggctgaggcacctgatcaagatttatcatgttgtgtccacagaggaatgtatagtaggttacaaaatagagttgtggagcctaacttaatgacagagtgagaccaggccaggccaagaggctagagcaagtcggaagaaaacagcttaagtcagaagctgaggacattgctatgtgccagaggtgaaaatgcaggacaaaatggaaagaggcaaaggtgatcttgagaagagactggctccagtggagacagtgcaggttctgaaaggagcaggctggaaaatagcccgggaccaattatgttcattagtcaatagggacaacagctgaaaagtatcaggcataagctatggcagggaaaattcaggctcattaggaggagaaaacttgaatggtaatgatcctactggacaactttcaagttttagcaaggctgtgaaaatgttaatgaggttggacaacattagacgatcataagttcacctggtcaggcccccgaccccctcttaatgggccttccccttattaaaggaacacagattgataagaaaaccctattattgttttaaaggctaccagaaaattgtcctcagagttaaagccaactaagtggcttatagaataaaggatctaagtctgaatttttcatcaaagcaatcctaggtagatttggccttctaaaggtttctcttcccactccttggagccagatcaaatcaatcccattcaccttgtgctgtgcctggctgatgtgagctgtcttgaggctagccctacagaagtaccagaatcagggagctctcaggccccggggccacaccgcatgctcaggacagggcaaggcaaacattcagaagctagattgcatggtgagactgcaggctgaaaagcaggcaagcaggcagcatccgagaacagcacaggcacacaagatgaaggcaaggggcgagatataggcctgggagaacccaggcacaggagagcaggggaaagtagggcaaagcagggtttggggaccaggagagcaaaggactacaaattcagttctgactcactggacacgactcatcttgggccatggctgttccatgcctgggagggagagcaggggagctacagtgggctgctgaaattgcattcagaacgaaatgggtaggctcaggtgtcagctgcaaactgttttcaattctagaaaacataaatacatgaaaatgcatatgatgatatttggcataggtgaccacacctttgggacaccagcttgtttgaacccagtgctattgcccaggctccacatcagtgtggaagttggctggacaagaaggattctcctcctattaggaagccatgcttctagggatgatggcttctgggtgaggcttccattcactcgctgtatggcagatgcacctgacagcgtcaggacgtaccctgagaatgaccctgtttggaagatgcacctgaatgtgtgttcagagttctgagctaagaaatctgggggtggccaacccggagattcactccttacctctgaggaagagctgagccctcggactgtcctgagaaactcaggctgtacgggagatcaaggccctgtgtttggggttaaatgaaggctgccaggtggaggttgttaagggaagggtgctaagtcaaaacggtagttgaacagcatgctttttgcaagtggttatgattctcctgcccagcctgctgccaccagacctccctgtaagttgccctcctgctaataaaaccctacgtctcatgtgttggctctgggtctcctcttcagcctcttgaacatggtgtcatccctgttgaggttaaaaggggtctggcacaacacaaagtggtggtatcagataagagcaccccacgggcttccttagtcatgtacggtcctacaacccaacacgggtcccccattctgggcagagtgtggctcacgtagctcagcccctactgtggctactccctctggtggtcacttcccaggcaccggaccctcctgctgctcccagggaaggcaagggctggacactcagggaactgctctggcttccagcagtcctgcatttagccagtcccctgcaacctggtgcccaaatagtttggcttaggcaggcatgagccctgcaaacatgaggatgcccactcaaagggatgcagtgatacacatcaatgaaaacagtgcatggggcaaaatcagagctttgaccaaaaagagtttaaatgaaacaggacaaagaaaagcagaatatgcagtgaaaacagtaactcaagtgggtctggccacctgaaaattggactgatactcagcaccttaggtcagcaagaaaaaccaaaccaaacacattaccctgaataatggggagaataaggttatcagataaaatacaggacactgattaaatttccattttagatatgtaatgaataattttttagtgtgtcccaaatatcacaagtcatactaaaattatttgttgttttgttgaaattccagttcaactgggtgtactctatttttatttgttaaatctaacatccctgctagaactaagtggtgtccattccattcttagactctaagtgcagccctgtacaagtccaacaaaggtcagctgtaaatgagtaatagttagatgtttgtatatggagaacagttttctttaaaaacaaatcactactttgcagagaggaagatgaagagaagaaatctaaattcaggatgacttattaaagaaaaccccctgttctgggagtctcagatgacgtggtttctcatcccaggctttgtgacctgtgcaagtcacttcatttttacatgaaagggttagtttgaggatggaacttggaaatcactgggttctattaaaccctaatgtcatgattctattcaattagaactatgtgaataggggaaatgcacttacgttctagatcctaggaatacaaaactggaagacacttgtttcagcttgaaagatgcagatactaaattttctggcagatacagaatatatgtggccacgttctaagaaatgatgtcatagggctgagccagaaacatgctcagaaaggatggaggtaaaatcataaactcaagatttttatttggcctcaagatgtaaggggttcctcccaaacattctgaggctgataagatggaagagaagcatgcccctccctaacacatccttatctaagacaatatctcatttcaaatgcattgttgctgtgagaatactttccgaaaataaaacccagtggatcccagtgaagagaatctgtttcagaaatggtaaagctcagttaatcatgaaagataaggataaggcctcgtgaaggtcataccaatagccggcagaagtcaagtatatggattcatggcaataatgaagataaatatcaagtttgtcattacagctatttcttctctacacatagcaagaatgttttccaaaggagactgattcagtctaaacttggaaatcatttcggaactacaaaagttgaaaagcttacctttcttttctaacataaaaataagcaggaaggaaagggtaaagactgagttaactccaaaatataatattacaagtgttttgggttggacctgtctcaaacagttcaatttatctcagcaaaaacacatttttacacttacagcaaaaaatagttaaacattccaaagtgcacatgtttattttgttgggaaaattatacacatttgtttgattagctttggtaaataaaataacctagtcaccactcaagactcagacgtggctgcaaaattgattcaatgaaatgtcaaaataaatcatagcttaaaaatgcatggtatgtaacttctaaaaatgaaaaccacatctatctctgtcagagttgtgaagactgtgcattaaaattatatcaaaaatgaatgcagttttgaaggaaaactattgatttaatcgactcttcctgactagtgattcaaatcatgatttgaatcaatttgattttaatcgagcccaccctatccaaaagtcatttatacatgcctttggagtgcaagatgttattttcagcagtctatttatcttcctagttataggacactcagactgatataaaaagagttgtgttgcctatgtcacatcaacagggcagggagcagaggctcctacaaacttacctagttgcaaataatcccagtaaggccaaccacgcaccaactataagtaataagggactgaccaacagtctcaaggatgccaggacctgaaatcgggcagagtcctgggacagtcagtggactgcagacagtcctagcaacagggaagaggaatgcttcctgacctacagataacacacaacaagcagggcacttggcctcaggcaggggccaaggcagcctcaggatccagaaagcagacagaaaggccaagtctccacaaacagttcaagtgcaactcttgtctcttgcagaattctgagatgtggaggtcaggaacaaggctggcctcaatcaccagggctgtaatagtcagcaggtctcagtcacagatggagctgaaagccagagatcaggacaaggcagatgcttggagaaagccagtttctagaaccaaaggactaggaggctgacctgaagctgaaaacatgaattaggtattcaaggcaattatgcaagggttgatcaggtgaactaactataacctctgcctctgctgcctgaagggtattatctacctcgtaaaaaattgtaagtgtgtggcataagtcttggcatatggaaagtgctcaatgttagttactgatgataatgatgatgataaaaaggaagaaataatgataaaaaagaaattggctgggcacggtggctcacacctataatcccagcactttgggaggccgaggtgggtggatcatgaggtcaaaagaccgagaccatcctggccaacatggtgaaaccctgtctctactaaatatacaaaaattagctgggcgtgatggcacacgcctgtagttccagctagtagggaggctgaggcagaagaatcacttgaacttgggaggcggaggttgcagtgagctgagattgcaccactgcactccagcctggtgacagagtatgactccatctcaaaaaaaagaaaaagaaaaaaacaaagaaatctactactattaataataataataatgtagcctgctagggtattcagtggtccagtttgcccaggattggagggcttcccaggatatggggcatccagtgctatcactagaaagagccaggcaaactggaatggttgacaagtctgtccctgccatgtgcccagcctgactgacatggcatgggttgggtcagaacctgcagatggccttaagtgcctttagctgtggggatcagaggggggtggaagcagggagccaagcaccacacgttcttggatatagaactgagtttttgttgtatgaggatcatggtctggcttttcccttcaaggcacttggtgaaaggaatgtagtgaatcgataatcattaacgagctgtctggtctaatcatttcctcccattcgttccagttaataagaaaacagaacaaggagggaagaggaggagggtgaggaagcaggatctggccgtgtctgggttcactgagtttcagctgagctcaaaggtcccatccttcacccagttttaacctccaccctatgccccactgcgtgagtctggcacaaggcaagcactcaatctatatgcacagtatctgagaaagttgatcagtgggattgggatcagatctgctgcctccttggacgtgtctttgtggaaaggtgtaggtgcctggctaggaatgactgtgacgaagccatggttcagtgggcaggcactgctgccctgtgctaggcagcccaaggtccaagtccttccctatgtgtgatctgaggacagggcagttacacaaccttgcacctactcccgctcatgctgctgctgctgagtctcaaaacagccaaagcaaggagaagccggagaagtcctggtgaaaggctgtgtggttggtgagctgccggggatctcgcggttttctcagggatttatgggtggatttaggaacatgatatctagaggttgcttgtatatagcccagtaggggagaaagagcgctggattcaaagtcagaacctggatgtttatctcagctcagccactccacaaatgcagctcagctaacacatactgaacaagcatcgggactggccactgtgtgggatacttcctccaattttatccttttatcctcaacacaaccgattattatgccccattttattgataaggaaacggtctcagagaggtggaaactgaggctaagagaggtaagcctggtcaagacaacatactacatacgtggtttagcgtgttggctgaagctcaaagaggtaatgctggaatcttgaagacatgggtcaggacaggtactgggaacatgtactgaactgatgatggctgattcaaggaacaaagaatctcagggccagaggaagagccttctttggaccaggcagccagcatggcatgtaaagcacggcagttgatgtgtctagctccagatgtttataaaagactttagtgccctgaggtgatgctcagcttgcctgggccatggagtggggtatattcttggaaacactgctaagggaagcatgggtgcaaacatgtcaaacaagactggaataatgggtctctctgctccttggtagctgagcagcctaatgcaagtcatttaacctccctgaacctcagtcgcttcatctaacctggctcacccacagctggtgtgaagattaaaggtaaagtgtgtggccgagtgcagtggcttcacgcctgtaatcccagcactttgggaggccaaggcaggtggattgcctgaggtcaggagttcgagaccagcctagccaacatggtgaaaccccatctctactaaaaatacaaaaattaaccaggcatggtggcatgcacctgtaatcccagctactcaggaggctgaggcaggagaattacttgaacctgggaggcagaggctgcagtgagtgccaagatcgcaccattgtactccagccagggtgacagaacgagactccatctaaaaaaaaaaaaaagtaacatgtgtgacacgctttgcactgcatgggacacagtgtagtactccgtgcaggggaacatcattcaagcacatttgctaagctgccaggtaaagccaaatgaaagctatctgactcccccattagtggcatttaaccatgccagactaatttgcctaactagaaatctgactcgaaatctccatgccccactccctcatcttccaggcattcggaaaggcaggcttggatctccttggcacatttactaccagggacatcggggtaccccagagctatcaggacaatgagaagggcctccagagagagggaggggctcgtgctaaagcatgaccttcagggcctccaaaagatgctcccaagaatggctgcagaagagttcaactccaagtcgatgacaacaagggaaggttaatcacagggaggcacagggccacagggcaggaggcacatggagtaggcagggaagtcagcttctgctgcaacctggcctgggcactgatgtgctccatgccacggcacctgggaaaactcagtcccagactgacttccaccacctctatcacccagtccccttctcctccggtatctccctccaccctcaggggctcatgagaagtctcttcatttccttttgctgcactgcggggacccctcagctcctctgtgctttcttgaactgatgatcagttattttccacatgtgacacgtgctctgccactatcacctcctgtattagtccattttcatactgctatgaagaaataccagacactggtaatttataaagagaaaggtttgctggactcacagttccacatggctggggaggcctcacaatcatgcagaaggcaaaggaggagcaaggacaggacttacatggcgacaggcaagggagcgtttgcaggggaactaactgccccttatcataccatcagatctcatgagacttactcgctatcacaagaacagcaccggaaaacctgaccccaagattcaattacctcccaccaggtccctcctatgacatgtggggattatgggagctacaatttaagatgagatttgggtggggacaaagccaagccatatcatttccccaccctggccattaggccttcactacatcctaggacctctggacttgggccacacactactctggactaaaccttggtcttcaggcacatagagttgctagcactcaacttgcggctaccctctaagaagtcactgcctttaattacacaagtcagcacaggcccccagccttgggactgccctactgagcaggtccctgcagtgcctggtctcagccatgctcctcatcaccaggctgtatagcttatagctccctgggcccctaaccttttcctttccctcccgtgccaggcatttttactgcagaagaatgtgaccttgagcaagtaacttcatccctctggatctcggttttcacaaacataaagatagaagtcatatgaatgatgttagcagtttttcagcctttcagtgtgaaaaaaaaaaaccataaaagggtatacttttacatacattaactaagaaaacgcatgaagatgaagaggccctgtgaacttagtaatatcttcaaataaatctatattttatttattacaaccccatcatttgaaaagtagaacacatatgagtgagatttattatttagtcctcccgtacctaaggaatggttggtgcactacggactcttggacccagggtaataattccaccactccctcatgggttcacagcctgcagattggcgaacagcagactagacaacctccaagggtctttcaaggtcataaattctacaaagacttaccaagcacctgctaggatggatacattctaattagggagacagataaactccaagagaacaaattttaaagcaagcacttaattatggtaactggtaaaaacccaagaccaaactaaaaaatgaggcagcatgggggaatgtggccttttagatagaatggtagaaggcttctctgggatagtaacatttgaccatgtgacccagaagatgataaggcaccagccataagaaagggatgggtggggagaagaaggcaaagagcattccaggcagaagacacaacttgacaaaggctctcagaaggatgccagtgtgggctgttgaatgacctttgtggctgaggatgaagacatagggggcaaattatagaggggaaaaacagcaattctgtctggaagtattaagtttaggagtatgcatgacatccaagtggaaatgttgacacagctgaatataagaggaggctaaaattcagagataactgtgagagaaatgcacatttaggagtcaacagagagaagatattccaaattctgaaaagttaggggatctactgaggggagggcaggggacaggaggagacaggaaaggagaggagaagagaggagaggagaggagaagagaggagaggagaggcgaggagaggaagacctctagaccaagtccttagaaacaacaccactgacttggggagagaaggaaagaggctgggagaagccagagaagaaagaggaaaaccaggacctggtgaagtaatcaaatccaaaagagaaaggaattcaagaaggagggagcagccaaccgtgtggaatgctattgagagacagagagggtaagattcagatgaaagcacatccattggatttggcaatacagatgatgctatagactgaaggtttgtgtcccctccaaatccgtattttgaaacctaaaccccaatgtgatggcatttgaaggtacagcctctgggaggtgataaggtcattatgatgtaccccttatggatggattagtgcctgtataaaaagagactccagagagctccctcgccccttttctgcaatgtgaggacacagcacaatgatagcggtctatgaaccagagagtggacctttgaccagatacagaatccactggcgctttgatctaggacttcccagcctctagaactgtgagaaatacatttctgttgttgataatccacccagtctatggtattctgttatagcagcccaaacaaactcagagaaaaaagaggggcacaggtatagcgattgcggcagaggccactggagtgggatgaagagagattgaagggtaaggaacatgatggggacatgatgtgttggcaaccgcttctagaagtctggctatcaagagaaacagaaaaaatgggacacaagatggaagaacagggtagattattattcagcaagtactctgtctccctcagtctccatgggaggagtgtatgtcccatctcactgatgttaagtttggccaatgggatgtgcagatatgccctgagtaggactttgaaatgtgcttgcctgattgggcttggcgtctcgtggtccttcctttctttgtgagaacatgtcttgggtagcctctggatgaaggagaatgagcgatgtgtggcacaggcttgggacacaacccacaacttggagcccagcttagatctgtggaactctaacgaacccacaaacctgtaagcaaaaacatatgctagttgtatgccactaagatgctgtggttattggttgtgcagaattattgtggataaaggtgactaatacaagggaaaatatgcagtcgggtggggttatgtttaggatgggtgatgctagattatgtgtatatactaatgggaatgatgtactgagatgaaagaggatttggctgcctgaaagggatgagacagctttggcagggcgatgcccatgagaataacaagaggggataagatcctgaagattagcggaggggctggctttagataagaggagggctgcatcctccattctagcaagaggggaaacagcagatgcagatacaagaaggtttaaaggtttggtcaggaaagatgagcagcttagatgggatgactaatttctcaatgaatgatgaagcacgaccatcagtggagaatgtctttagcctggggaggaggtgtcttgttgcctgctgtttgcctttccttaaatgtctttctaattttctctgtagatctaaactctaagcccctccttctccttgaaatcctagcctaccatgacccttctccttcctatagcatttgcaatctcaactcgagtgggacatctgattagctcgtctcattgtttgaagtaggatttaggcatgctttcccttctgctgaacttgagcttgatgagacattcggatcacgtttgcttcttttgagtcccccacagtaccaatgacatagtgatggtcatgctgaggaggcttaataattacttgttaactggctcaagaagaaaaagtatgtgattgttactgtttcctcttatagactagctgacttgggccacagaaaatcagggaagaccagctgctaaggggttagccagcagaactattgtttctggagacggacacgttttctggtttggatttatttttttttctcacttcttatgccaacttccctgaagcttggtccgttttcttcactgcttcaagaattctttcatcaatcctgccgtggacatactgacatctttcctgagaaagcagagggttattttctagatgttctttaatgccattgcttagagggctttctgttttatttttaatgaaacaaaaagcaccagatctgacaggtaatgctagggagcccatatttcgtgcaagggatcccagaaataccaagcagctggcgtgctagttccaaagctaccatgcagaccttgtttatacctgaaagacagcagagggagcttgttctcaaaggcctccccagcctcagtcaaactggctgaatggaccttagagtctcagtctgacagtttcacaaggttctgtgtgccaccttcaacactcatccaagttacatgcagaggaaacagagctgatccagagaactccattgcctggcaactgggacaccatggactaacttgtaaggcaagggtgggtgtccactcctccatcccctcaagggctccgatccaccctcccaagttcccatcatttccagacaccaaaagtatcaggccaacccacccctcctccactgatggagcaaagtgtccctcaagaaggcccccagttcacagccaggctgggtgagggccccctcttctgagatccccagaccaccctactctcaccttctagccaagctctgacgataacactaggtacttcccccactgcactcagagctccctgggactggagctgcatctgattcacctgtatttccttctctagccaggcacacgtggatggccaatgaatggcttcttagacgttaacagcacaggtaggcagcgcatctgacgcacctggagaaagctccagctctgcttgcactgcctaaggcagtcccttcatctttttttttttttttttttttttttttgacagagtttcactcttgttgcccaggctggagtgcaatgatgtggtctcgactcactatagcctccgccttctgggttcaagtcattctcctgcctcagccttccaaggagctgggattacaggctcatacctggctaatttttgtatttttagtagagacggggtttcgccatgttggccaggctggtctcgaactcctgacctcaggtgatccacccgcttcggcctcccaaagtgctgggattacaggcatgagccaccacatccctaaagatgaagggaaggcagtcccttcatctttaagggactttttcctcatctgtgaagagaacattaaaaatatctacttcactggcactgtgagaagtaagtaatgcacattttataaactggcgagtgttttacaaagtgagtactaattcacacttaagttttagaggctgtattacctccctcaaaaatattttcacttttaaaccgaccctctgatgtgtccttttcctcttttatgaaggacaatgccttcctccttcagcagtgaaggtatttcaggcatgagtgaaagaaactgggtttgctttgactgggggaggtaatcaggaccctaaacgacagaatatggaccagaaatcagtaaactatggcctgaggcccaaatcctacccaccccccatttctgcaggacaggggagctagaagggcttttgcatttttaaatggttgaaaaaaagtcaaaaggagaatattttgtgatacataaaaattatatgaaattcaatttacagtatctataaataaagttttattggaacacaccatgctcatttgtttacatatcatctgtggatgcttttgtgccacaccaggagagctgagtggttgtgacagagaccataaggcctgtaaagctacaaatatttactaattagttttttaacagaaaagtttgccaactcctgatagagatcatctctgtacttgccccaaggccactcctgtgaaaggatctagaatgagtcaagattttattctgggaattctattttagtccatccaggctgctataacaaaatactataaactaggtggcttacaaataacaaatttatttatcacagttctggaacctgaaaagtcctagatcaaagcaccagcagattcagtgtgtggtgagggtttgctctctgattcacagacagccatcttctcgctgttgcctaacagggtggaagggataagggagccctctggggtcttgtgatggttaatacttagtgtcagtcaacctgattggattgaaggatccaaagtattgttcctgggtgtgtctgtgagggtgttgccaaggagatgaacatttgagtcaatgcactgggtgaggcagacccaccctcaatgtgggtgggcaccatccaatcagctgccagtgcggctagaataaaccaggcagaagaaggtggaaggagccaacttcatgagtcttccacccttcatctttctgccgtgctggatgcttcctgccctcaaacatcagactctaagttcttcagcttttgaactcttggacttacaccagtggttcgcctggagctctcaggactttggccatagactgaagcttgcaccgttggcttccctacttttgaggttttgagacttagactggcttctttgctcctcagcttgcagacagtctattgtgggacctcaccttgtgatcatgtgagccaattttccttaataaactccccttcatatatatatatatatatatctcctattagttctgtccctttagagaaccctgactaatacagatctcttttataaaggcactaatctattcatgagggtcccaccctcatgactcatcacctaccagaggccttacctcctaaatcatcacagttggggttaagttcattataataattttgtggagacacaaatattcaatctacagcagagggatatagacaaaacagatcatattctgaagaacaaccaggaacatgctgagactcagacatgtgtcacgggaagaatggtcaataatttcagggtgtcttcaattatccaaacacctgtcatgaagaaaggagataaggctccctctccatggcttcaaaaagtcaacctgggactggagacccatttcagtcaatataaaaaatcatcttcagctgtctgagctgtttcaggggatgagttccctgtcattacatgtattcacagaaaaacaaatgtacagtgtagtgaatatacaatgtagtgatcaatgcaagatgaccattgggtcactaacatgggtaccctttcattaggttggtgcaaaagtaattgtggtttgggccattacttttaatggcaaaaattgcaattacttttgcatcaacctaatagattgcccattttgcaaagacctccttaactacaccatgaaaatccacaagggtaggctcctggatgctatgtttgtacaatatgattctaacacagtttactgaaccagaagtggctcctgtctgaggttcgttccatcagggtcctttacctaagaacttgagagcagatcagggtgagaatgagagagaggacagggtgctatgtgtacggctgaaagtgtaatatctctgcccaccatgtgggatcaggagcagggaaagctggcttactaggaaagaagcataaagcagatttatggagagaaggagagagatgggatggagaaagagttagtcctgggctcccaacagccttgcagtccctggctccaaactcttcatgaggtctggtttccatgatcaaacttctgggttactacagattagtctcattttgcagaagctagcttgagatggattctcttacagcttaaagaacttgaagtaatgtcattatggtggaacaagactcagatcttgacaacctggccagtgtcctcagtctcttccagccttgggaatctaaggttctattagccatctagaggagaggccatgtccccttgagaggcagtgtctggggagcctgggactaaacatccacagcacagaccacaggcatggcatgtcaacttgcacacatcgcacttgcttctctcctctttaggaagataacttgaatctatcacgccactctgttgtgaaaaataatgaatagcaccgttaacaaatgacaagtgctacatttcttattattatctatcatgtatacatcactttatttctgtagcatccagcaggtgttgaatgcaaatggactgaaagcacttttgcagacttgcaatctcctattaagaaaaacatttgtgagcatggaacagtggagccgtcaggctcttccaagtcctacactgaagtaccccaagcaggacctgagaggtccttctcaatcatgctgattcactggaaagccattaaatccaagtgattcacatttactttagtgcaataagatctaccctagctccaagctttgaccctgtcaggcctctgaccccaagctaagccatcacatgccctgcgacctgcacgtatacatccagatggcctgaagcaactgaagatccacaaaagaagtgaaaatagccttaactgatgacattccaccattgtgatttgtttctgccccaccctaacagatcaatgtactttgtaatctccccaacccttaagaaggttctttgtaatctcccccatccttaagaaggttctttgtaattctccccacccttgagaatgtactttgtgagatccatcccctgcccacaaaacattgttcctaactccactgcctatcccaaaacctataagaactaatgataatcccaccctttgctgactctctttttggacttagtccaccagcacccaggtgattaaaaagctttattgctcacgcaaagcctgtttggtggtctcttcacttggacatgcatgacagacccgatgccatttggaggccataactgtttgtgtgatcagagaaccacaggaaacagacatgggcaatatgtggccagaggctcttgatcactctttttgctccagcaataggatagccttgggcctcctttgatccagtttattccacatgccagacttcaccactagccaagtgttgctcagcttcttctctcctctccccattttgcacatagagaatggaaatacactattaagtaatttcccaaagaacatgaggctggtcttgagattggaaggcataggctgtttctggcccatacagacactcactgtaaggtgaataccagatgaggggcagggaatagagtaggagaaactgagctctggacccattgctgccccaatgatattgggatccaggcaagtcatctcccttccctggccacagtaactcctctatccaatgaacagattggaccaggagccaggtcacagccacaagataggaatatcaagatcaaaatcaggaagaggctaggagttgacacccaagaataaccacaaaaatgtcaagtctggagtgaagtcaatgaacatattctagctgagcactaagagtaccagtgatgagctgagttaaagaggtaccagaagcagagtcaagtcatggaaacaacagtgggagtggaaaaagtaaaacagggggcaacaacccagagaagacaacacagaggtgaattaatcttgatagagatttgttgttggatatcttaatgtcactaacacaaagacaacatggggtgaccagcaggatcccacccagccctcatagtctacaaatttcaaccttgctccagttgtgctaccaaatgtgcatcagccctgacaaaggagcaattgcaagctaagtatctgacatagcgtgggttctgtattaagccacttttttcccactcagtaataactggacacacaagaaatcatcccccaaagggtcatatgccagtctccatctccatttaataagagcaatccctgtcttgactttctactttttacttgcccctaagatgttcttgggtcctaaaaaaaagtcacttcctactcatcaggacactagatcactgaaaaagaaattttgaagcttttgaccctccatgagggtagtgcaggctggctacagagagaagaaaatttatttccaaggccagctatttgatgtcctaatctttcccaggctattcccatagaatggttattgaatatattatattcaacaaatcaactactttccctataaaaagttctcgtagtagctgtaagacatatgacaagaaaagtctctctgtgtgcctagttttctcatttgtaaaatctgagaaatggtacctatattagttttccatcactactatagcaaatcacctcaaacttggtagcttaaagcaagacatatttattatcctgcctagattaggcccatatccaatatgggcctccctgagctaaaatcaaggtgtcagcaagggtgcgttccttctagaggctcttaggagagattctgtttccttctcttttccaccttctaggttcacccatattccttggctcatggcctcttttcttcatctccatcttcaaagccagcaacaatggatcgagtcactctaacatggaatcactctgacttcctcttctgcctcctccttccacttttaaggactcttgtgattacatcagactcacctgggtagtccaagatactctccttattttaagatcagctaactagcaacttaatttcacctgcaaccttaacttcctcttgtcatgtaacctaccatattcagtttctgagaattaggatgtgcacaactttgggggcacattattctgcctattacagtatatgtcttctcacagtggctaggaaaaattttcccctactagctaagcatatggccctggctaagtctcttgtcacttcagtttcctcctatgaagttgagggctttaatctaagacagtctttaagatgtataagtttatgaggataaaacagagtcattaaaagatgagcctctgtcttgtgcattacagtcttcaaagcacttgtccatgccttgtctcatttgatccctgcaccaatcctgagaaatatatagggaagatgctaccattatctttgctttgtagaagtgtaacctgacaataagaaggtaaatcatgtgtccacgaccacacaattaaaacatcacagtcctggtttaatattggagtcttctgataatacatgccctaaatgaaaaccttttctgaataccttggaaatgtatatatgaggaagatggtaaccaccaacacactaccaccagcaccaccaccaccatccaaccacatcacaactcatctaagtgaagaggcacagcaatggcagatgatccctgaagataactcaggaatccaggtccccactttactttggattcccatcctctaatcgcgtcccattaaaagtgccttcctacaaccatattcttccttccttgctttgagaccacacatgattagcatagtgctggttctaaatcaaagaaaaacagtcatgagcctctagctggggaagagggagagggtctctgtatagtagccagtggtctcaaggcaatcctgcttatgtgagataggataactagatacagtgatggaatcttcttcccatcctcctgagttcagttcagtataaaggaaaatacaaaaatggtgaagacattttctaggaaacaaggaaggagaaaagagctaaaggagattacttgaaagtctttgaggcacagtggacatttgttatcttttggttcctagcatccattgctacatttcattgccttttggggaataatccctctccccactctcagaccatgtgcttgctccatcctgcactctccactccaagggcagagaattaactctttccacaagtatttattgagcacctaagatgtgctctaggcatgtgagatatgaaggcaaggcagacaaggcccctgcagtcatcgagcacccaaataaacaaacaagcaaaaaaaaaaaaaattgaatgaaatacttttgagagtgttatggcctataagaaaataaaatagggtttttgttacagagaaggaccagggtattattatctggacttttcagttatgttcactaattcttatttcgtttaagcctatttgggtcacacttcctgttgttcacacccagcaggcttcctgtattggattcctaacacaggtggccctcactcccctgatgctgaagatccctgtcctgtttgtagagcaagactgtactgactggccaagacttttgtgtcatgggaaatgaacagatgggaaagaacccagaactggcactcagaacctcagcttctagttcaagctcagcactaactagctgagtaccttctacccaggctggagtatttactaactgctgaaatggggatgtttgcctagttaatttccatgatctgttccacctccaccattttgtgccctatgctctacttgatcagaacttctcaaatttacattataattgggaactgagtaatctcaagctggcctcaatcacattctacgtctctattaaaaagctgcaaaacaagcatttaacacttgatccagatccatacatattatcaggggagatccaaactgcatactcagcaaatgtactgcattctgcaaacaaacactccagtgcctaataaaggttagtgattcaagataatgctgattttacctgcaaaactcactgtgggctctaaggagttctgcctctatccttcatggcttattagcgggggaaagcctttgggcaatttcactgggttggcatagaagcatttatatacttttctgtatgtggaggacaagaggatgtgcatcatcttctgacatgaatacctcagtgactatgtcagaatcctattaatataataatccctttaaaaaatacatttatgtggttcaaaattaaaaaggcatgcaatgaaacatttcccttctacccttgcccatccccagttcatgtcacaacccttaagggaaaccattgttagtctgttgtattatctttccagaatttcttatacaaatagatgtaagtataaatgcggttgacccttgagcagtgtgggggttaggggaatcaatctcctgctcagttgaaaatctgcacataacttttgacaaaacttaactaccgatagcctattgttcaccagaagacttaccaataacataaacagcccattagcacatattttgtaatcatgtgtatgtgttatatgtattatatactgtagtcttacaactagtaagctagagaagagaaaatgctactaagaaaatcacaaggaagataaaatatatttactattcagtaagcggaagaggatcatcatcaagatcttcatcctcatcgtcacatacagtaggctgaggaggaggaggaagaggaggggttggtcttgctgtgtcaggggtggcagaggcacaagaaaatctgtatataagtgaatctgcatagttcaaacccatgttgttctgaatttattctaattctacaatgcctccactttttatatataagttagtatagaatacacactattgtgcagcttgcccttttttcttcattttgcaatctgatagataaaatatgctattcctatatagctttgagttttgatgaggtaatgttaagtacatcttttaacaaatttaggtctattcatatttctttttctgtgcattgcccgtttatatcctttgcctattattttctattggattgaaattcatttttattgaccctttggaactctttatttaagttgattaggcctttgtcatgtgtcttttcagtttacttatgtagattctttttgctacttagaagatttttttccttcaatttttatttactcagttatatcagatttttattttatggtttcaagatttaagtcttggttagaaaggcaccctgtgtgtttccttctggtactttcatagtcttgcttttacctttacatttcgttttcatttggaatcttatcttggtgtatacatggtgtgaggtatggatacaattttattttcacccacagggctaccagatatcccagtggaacatatttaatcttttccttcaatgatttaagatgctacctttgtcaaatactaaatgatcatatgcatttggatctatttctggactaaccacttggttccttttaactatgtgtgcatgtctctgtagcacacagtttcaataaatgacacactataataaattcaatatctagtagcgccagtcacctcatatgggttttttcagaatttttctatttttatttacctttttatttgaactttaaaacaaacttaactagttttagaaaattatctattgatacttttatttagattgtgtttgatttataaattaacttaaatagaatgatgtctattgtttttccatccatgagcaatctttccatttgcttcaggatccttttatatactttagtagtgtttttaaatcttcatatagaccctggatattttttgtttaaatttattattagttcttttacatttcttgttgttattgtaagtgatggctcttcctctaaaaatatacggtaagtcctcacttaacatcattgataggtggttggaaactgtgactttaagcacaatgatgtacaataagtccttgaataccatttccttcaacatctttttgttataactttgatgagaaaaaaaccagttttgttacatgtcattttgcttaaagttgcagtttccaagaacctatcctcaatgttgaggacttactgtattctgtttggtgtttgtatatgtgaaaagtattaatttatgtttactaattattgcacattgttagtttatggaattcttttattgtttgaaacagtttttcagttaattatcttttgttttctagccatgcaatcacagcatcttcatacagcaacaactgcctcttccctctcttttttactgtttttgcttgtctaattgcattggtaagtatcacctgtgcaatgaggagtaacagtactaatagcatagatccttgttctttagtgataattcctttagtgtttcctcaataagcataatgctggcttatagcctgagatggatgtgttttagcctgttaaaaaaaaaaaaatacctgaactatacagatgctcctagacttatggtagagttacgtcctgataaacccataagttgaaaatatcataagccaaaaatgcatttaatccacctcacctactgaacatcataacttagccaagactaccttaagtgagctcaggacacttacattagcgtatgattaggcaaaatcatctaacacaaaccctattttataatggagtgttaaatatctccgataatttattcactactgtactgaaagtgaaaaacagagtggttgcatgggtactcaaagtatggtttctattgaaggcatattctttttttaccataataaaatcaaaagattgtatcaaagcatcatgagtcagggaccaccagaataaccttagccagtcaagctttcttgagtgtattttttaattttaaaatgatcattgaagtttctcaaagctcttttcagtatctatgaagataatatcttttttctcttaatgttcactaatataaaaccatatatgcattccaagaataaaaccctcttgattatgatggattagtcttcaaatatactgctgaaattattttgctactttttaaatgatctttgaattgatattcataagtgggattagtctttggatttccatgtgtgcctactttgtcaggttttggtaaaagttatgcttgtttctcttctttttctatgctctagaacagagttctatgctctggactagtgcatttttctttgaagaatgtatacctatttaaattttttaaaaaaatttctgccttagaaattttggattcctttctgggcccatttgggtaatttttattttcttgaaaaaaatccacttttcaaacctatttgcatagagctgaacaaagtagtctcctgattcctttagtttcctgtttatgccactgttctccacatatcattccttattgtatgcatctgcacttgctcccacattttcttgattagattaactagtagtttattttattgttgtttttttccccatgatatggtttggctgtgttcccacccaaatttcatcttgaattttagttcccataatccccacacattgtgggagggaccaagtggagataattgagtcatagtggtggtttcccccatgctgctgttcttgtgacagtgaattagttctcatgagagccgatggttttataaggggcttccccattcgctgggcactcatacttctccttgctgcttcatgtgaagaaggacatgtttgcttccccttcccccaagattgtaagtttcctgaggccttcccagccatgctgaactgtgagtcaattaaacctctttcctttataaattagtcttgagtatgtctttactagcagcatgaaaatggactaatacacccccaaaccagctttgaaatttattttaactgctttgttttctaactcattaatctcttttatttatttttttctgctttccttctgcaatatttcattttattctgatatagcttcttgacttagatgattaattcatgtttgatcattcttttgtgtatatatttaagccatcagttttcctctgagtactgctttagctatataacatttgttctgctattgagtgatttcattaattgttttccagaaaatctgcaatttcagtttttcttttcctctttcagccatgcattgagtattttttgttttgtttggattttactttcagttaaatgggcttttggttttatgatttagtattaatttccagtttaattgcactgtaatcagagaatattgtattttttctaccttttgggatttattgaggttatctatgttccctaatagatggtcaatatttgtgaatgtttcatagacccttgaaagatatattttcttcatttaatctacagggtttgctatttatcaaccagatctactttattacctatgttaattagagcttccatattgatttttattctttgtctaggtatctggagactgagacatgtaaattaaagtgatccgttaccagcgtgttttcgtctattttctccttgcatctcctaaaatttctgtgttttcaatactgctgtttttttcattgtgatatgtaccttttatacatagttcctttatcttatttaatgcattttaatctgaattccactttgtctaatgcaagttcataactactactttttatatctctattttaaattaacattttaaagcattcggctggtgttccttcactcatccttttattttcaaccttcctgtatcactttcctttaggggcatctctataaacaacttagaattgggttgtggtgtgcgatcctttctgaaactcttcttaaaaagtaagttaaattcatttatatttagatatgacaaataggcttattcctagatctcattttatattatgtcttctgggtttcttggcattattttcgtctttctgtgattgttcttccagtgtgattcttctgggaaggtttgtgtttttattctagtggtaacattcgtaattacaacatgatataataatcttaacctatgtctctagacaagacttattaactctacattacaagcaaagataaagttggtgtattccctttcactgttctttccacagaagcatagaaaaggcatgattggggtggagagagaaagagacgtacatcctgacagccagttgtgaaagtgcacagagatgttaacacaatggcagctgcgtatagagaagaaggaaacacacacacacacacacattacatagcccctaggcacaatttactctggcaatgctactgtctcacttccaccaactgattttagtcaataacatcctctttctaagtgtctaccatttattaagtataattatgcttatattacttcatttgtcagctctcaattatacctttttactccctgctattatagaatgaggcattcagagaacttcctttttccccctttgcctttcaatatttgttggctgtgtcatttctacatcaccagggcacagaacacttacattctcctctgttcttctaatcctcatacttgtcttacttttagttttagtttagttttacagttaaaaatattcaatgctcaccctccatcttcactttgttgactgaagttcaccctctactaatttgttcaggaagggctcatgggaacaatattccctgagttattgcatgtccaaaaattgtcttacaattgtctttgtacttaaaagatggctagaatggatataaatcgttggctcacactttctttctttgcttatcttgtagatgttgtttcgctgtcttctgggtatttggaagttgctgcagaaaaaactgtggccaacctggtatttttctcctcataagtgacttgatctctttgcctggattcccaatggagtctttctttctgtctctctttttatttattgtttacttcaccattctttattaattttgaagtcatttcaaacctaaagaaaagttgtaagaacagtacaaattcttacacctcctccacacaaatcctctagatggtgacattttatattttgctatattttccccatttttgtagagacagaagatagaaacagatatacatttttgttcacatgttcccatcatctctaaatactccagtgcatgcctcccaaagacaaggacccttctcctatatagtcaccatacagcactccttgtcaaaaaatcaacaatgatacagcacagacccagtccacagatcctatgcgaatttctgaaatatcccaacaatgtctctttttcacttccaggtccaggatcctatctaccaacacatgttgcatttagttgtcatctctcatcagtctcatccagtctggaggaattcctcagtctttctctgtttctcaaatctttgaaagtctgaaacagtacagacctttccttctgtagagcctgtgtccatctgatgtttcctcacaaccagatacaagccatgcattcttggcacaacagaaatgatgctgtgttcttctcagcccatcacatccaggggcacactagctcaacctgtccaccactagtgatgttaaccttcatcatctggtcaagttggtgtctgccaaattttgccactgaaattttaccatgtttccatgttatttggttacacttttgtgggaagctttactaatattgtgccaatatgctatttcttatgaaacctccacccacaggacagcacccatcagcaactaccaatctctaccaattaccacagttacggtgaccaagtggtgaatatgtatctccatcattctctctacatttatcagttgtcatttttcggtaaggaagagtctcttctcttgcacttacttatttacttgtctatgtatctattcattcacttatttataacagtatggatttacagattcctattttattcaataggttgtaatctaatactctgattatttgatatttactttgatgctcatattgttctcaattggtcagtggaaagtccttcaagccagctcctgtgtccttttgacacatccccatcttttcttgagcatttcctgactttctggcaagacaaggtctttcaggttcattttatactttttctgccctatcccttaagttagccacttctctgaggccccctggtaacttgcagtgtagggcactatttagaaaccaagatctctgtaatcccagcactttgggaggccaaggcagccagaccacttgaggtcaggagttcgagaccagcctggccaacatggtaaaaccccatctctactaaaaatacaaaaattagccaggtgtggtggcccatgcctgtaatcccacctatttgggaggctgaggcaaaagaatcgcttgaacctggaggcagaggttacagtgagccaagatcataccactgtactccagtctgagtgacagaacaagaccctgtctcaaaaaaaaaagaaaaagaaaaaaagaaaccaaggtctgagtactcaccatgcactcattgctactggagttccactgctttcggacgaaggagttaagaaaaaaatgtatgtatatatgtacatactgacacttctaattccaatccagcatgctaggacttttctagccttccttctttccatgtttagaaatcccctttcaaacagtaaaaaacacggttcctattatcctctttatatttatttacttgctcaataaattatcctttctcttaaccaatcttccaaccattctagccatgtcccctgcccaccacctccacacccacttttctaccctgctttcatagaaggaaaaggaggcaaggggaggggaggggttattccctatctttcgtgtctaaaacttcccaaggctataatcttggtatgagctgttctggataattttgcccaacacccaaattcgtgctctttcaacatttagatttaagtcttcttttagatcatgaaagccttcctaatattttaaatatgttccattgtgtgtgttttctgtgtgtctattttttatgtctgttattttttgttttctttcaagaactaaaattatgcttctgctggctctccactgcctgtcttctatgtcaatcattttctctctaatctttattaatgcttcccttatttatgtttcatttattcacctttcatctatgttccacactgcattttccacagtgtctattttcccttgagattcttccaacttcatcttcatttctgagaccaatttgcctttttttcttttatttcctccttgagttctgccagctcacatttcaccacctcttgccattttgtcatcctttcccaagcatttacctctgcaagttgggtctttcttcacagaaatgattgctttgttgagttctttaaattcactgtgaaatacttgattagacttttcatctgctccctgaaattattttcctgggaatgttccttatttgggggtaattttcgtggctcttgctgacattcttccccctaatatcattgcttctaatctaccaatgatcctactttcttttttattacttattgttgtatgagatgggctttcttggatcatttctttgcaggaagttctgaggatggaaggagggcccagggtagactttcattactgaagtaagctttctttgtggaggagagctaatgactagaaagaggcacatggagatttctgggctgctgaaaagattctgtaccttgatctgaatagtggttacacaaaagtttatcaaactgaaaaatatttgtgtgctttcctgtatgttatatctcaacaaacatgttaaggaaggaaagaaggaagcctcttttatttgctgccaaaaacattgtttcttgcagttaggtgtcttctggatgatcctttgtataaatgcacctcctctgcttctctgaatcaaagcaggcccaggaggtacgtttcttcagttttgctcaccctagtccttatttgcgttgattacaaataagagatgttgctttgcctcttcaggatgccccttatatccaggatgtgtattttttctggcactctttgccacctgctattcctgagcccaccaggtactctcctaaacctctacttccccctcatggcctctcccaaaccctcctgctcaggacagcccttgcacacattacacattccacagattgtatctatcctctaattccactgaaaatggcatttcggagttttctattgttctctttgctgttgtgtccagcaacaaggagactgtaatggtatccaggaggaagagcagaagaggttgtcttgtacagcagccacattatacaggaagtcctatttgcctattccactgattcaccactacatctcaaacgagtcacctcttgagactcagtctctctattagcagaatgggaaggaaaaaaatgctgtccttctcattagcttcttcttatcaaagaacagtagggaaggcacagacatgaggccaagtctgtttgccattatgaagggtttcctaaacgtcaagcaacatggtgctttccatggtgctgatgatttcacctcggtcctgtttctcctttaactttcccctaaagcttgagggctgctctcccatagaccatcagccaaaaaaacagctgattctttaggactaggatcttaccccacacctcagactctcaccacctccccagcaacccacacactcacgctgaaacacacagcagattcttcaaaataccaattagctagctgtcctgtctcatatctctggctggctgcaaaagtagcagtaagaacacgccactacttggcaccatctgcctggctgtgagcaaacataggctccccagccaggcagtgtaattcaggaaataccaaggccagactcctgcctctgaccccacatgaaccctgaagtttcaggctacagatggacaacatcaaatcaccagggccccaggactccaccatcactacatcagtcacaaatattgcccttactaatagaagtggcagatggaaacataaattcttcaaaagcaatttgcttgccaaggactaaggaacgtatgaatgaagtgtgaacagtaagttttttccgagttagggaggctggacacgtcacccgctcaattacacaggcgggctctagaagacctaacccagtttaattttccatcaggctgaaaacatctctagctgacttaaaggcaaacacaagggtttgttctctcttccctatgctactccttcaaggaaggcccagatcttcaagagcaaaatgcaagaaaggtaacactggttggagcattgggcattcggtttttccaaaagaatgaggataaaaacaatcctttgataaaataatcctttgaaatcatatgccctttttcagaagactctgtagcacacaaacagtgtccttggggaatgaggactatataagcattaatcatatgcatgctctgtgatggctgtcatggctggagggtctagcaggcacccagcattcctgtcggcagctccctgctccctactgagctttggattttacaaaggcaagcacagcacaggttggaacaggcagactgaaaagagcttggactatgggcatagaagtcaggttctaagtaagttctgccattaaccagctgatactcttgagaaagtaacttcctctccctagtctcaacatcaaccacggagagggcaagtagacctgatcaactcaaaggcttctaacctcaacaagtgaggattctggttaacctcttgctcagcacagctgttatctcattcccagattccaacccctaacaccataaagggaggccttgtgcttggtgaatcagctgccacttcacccaggcctggaatgcagctgttagttactgtggccaaatgcagccattacttcaaaaccaacagcagtggcaaatggcagagaaaataaaattcagcaaactctcactgcaaaaccaagacagcagatgaaagagtggaggaagtgactgcctatgtaacatttctctgaattgcccaccttttacttctccacgagaaacagataacagaaggaagccacccattgagttggaaaatgcctcatcccttgttctcagatgaattcaggctgctaatagcactgatacttttagaaaactaaagacaaggaatgtctggcttaaaaggagtctgtcagaatgtgaaatgatgctccctttccttccttgagagtataaactggcttggctcgaattatgtctaattaggatgcagtgaaaatgaaatacacataaacacacagacatagagacactcacacaggaactggccccaccgtcctgcggcagtgcggacagattgtaatggacgcgatgtggtacaatcattaaacatctctctagcttatttgcgtgcagtgtgtctcaataatgtgttatgaggtgtgtttgtaattggctactgctgatagtggtccttgaaagggaaatggagtgtgtctaaatgcagacaaagctacttagcgcgccaggacaagatgagatgctcctcacaaggtccaaatgggatactcagggcttcttccacccatagcttgggagagagaaaaaggaataatctgtctcaattttctcagctccagaaacaatatttataaaatagaaggtgatttcagagctcatttattttcctggttcacagtccccactctctgctgacatcattttctaaccaattttatttccaacaatcacaggaacagcctcaattctacttgaaatcgttaaaaacaaatccattctttccttgtctttgagcctcatctttcaaaaactggtttaatttctatactgcctttctttgaaaaaatattccaggcctccgaatagccacaccagatccttccttctccctttcttacctcctaaatccgtgtattataaatgcagagagcacacagcttcctccggacccttgtttctacgcactctattcactattctctggctaagcacatcaatggttgtcccacctgtagacaatgagtgattccaaaggctatgacttccaaacactaggcaccttagaaactgaataagccgaagatttaaaaagtcacagaaagaaagaatcacctttcttacccagaaggcaacctccaatgagcaaaatcagagcctaccaagaaataccaagcatggtgctggcttgcatgaagactgtggccatatcctggcacagcagccacttagagcactagggaagagaatggcagcaaatgggcgagatgtcagccttcctatgtccttccctgacctcccagggaaacaaccacaggaaagaagaaccaaggttcacacggcatgcttggttcttgggcaagccatgcctgccctgtagcaatcaccacaatttttttttctaagtgctcagaaaaccatctgttctaaaactggggggaattaatgtaaagctgattggtctttttctctgagtgggagaaactgactctgtgacacgtattatcaactctcacacaggcactagattcacgtgaaaccattcttaaaagtcagattttttaaagctataactcatcctgactcagatgggttgagaaaaatggtgggaacttgaactctaactccaaatctctgaatgatttgggagtcaagtattctggtcttccctcaatcaggtaccccacttgtaagacagagttagacacactgtctcctacccctatggttgttcagcagagctagaggatttaaaacaacaggcactctggcctctcaaagacagcagctggaatgaggcagagaacacaatcctccctgctgcagctgtgaagccccagcagactacccaggatgcagatgggggctgctacctgttgagctacccagcctgcagggcacaagcctgcagggatcaaggacaaagacccagggattcttcatcagcaagcttcaatgacaccaggacagggaccttccggggtggctagcctgcaggacttcgcaagtctccaggcaaaagggccagggcttaggcttcgttgccataatgctgagcacagcactggacacacagcagatgtttgctaaacatttgtgaaatctaatttgttcactgaatcaacaacaggaaagccaaaaggcagaggcagggaggactaactgcttatttaccaggctggtttaactagggatactttcctataagccccctgtgtggcttttacccatggctttaaactacaacccattaagcagaaaataaactataacaaaccaccacaaattgcaaaaaaagctcagccctgaacccacccttatagggagtcctggcgtcatcgctatgacagtctgacatgcatcatcccttttcagccttttaaagctttttaccttttaaaataaagtgagatgctgcaggtaaacagacatttgcttaaaacattttttttttcacacaaaggtccttatccgatgttagtcatatttttctatgcaagatgaatttcaatttgatcctttcctccttttactacatcttgtttgcttctttttcatattttatttattttttgatgttttaaataggccatcagaagtacggtcaccaacaggacagtcctacagacagctgttgcctctagtgatggggctggatgccttctcccactaaaactgtgtacttgcttttttttttttttttctttgtatccctccttgttccattgaggaccctccaaagtctgggaactgagctcccatttcaattgccaatgccataaaaaactgtcccctgggaaaggctggtggtcacagctgtctttctgctcctgcccatgcagcagaagtgtcttccaaaatgcccctcccagagagcaatgagcccagctccaggcacaggagagcaaacagccagtggctgctttcttagcctaagcaccgtgtgaaccagtcctggacaaaaacctgtgcttgccaacaacactggtacatcggagccaacctcctgatcagcttgtgagacgtcccatagcatttactgacctcgtattcatagacccttagcttctcagaatctcattcctcatggtaaactgtgaaaatgctgcctaacaaaaagtcttggctaagattacaggagatgtatgggacagcaccaggcacactgtttggtatgaaacacatgctaaaaaatgaggatctctcaaatccctcctcatgacccaattattgttagatgtcacgatcgtcaaagaaaaaggccaacatccatgacctaggtcatattccagtccttctcattggaaaggatatttgatgataacatcttggccaactgatttcccagtgaatcaggatccactttgtcccccatcccctgtatgacaaagatccactatcattgtcatgggcccacagtcccctgcagcctgccctgacgtcacttcaaaccttctccttgctatctccagattctcactttgatcctcatgcttcaccaagtcctcctttctcatgttatggaatcttatccccatgtgcttctggaactcttactttgtgatggattaaacctagaagtccccaagtgatcccagtaaggaagtaattccagtctagatgaattaggcctctgcagcagtggtgttatatgcagctactaataaaattctagaaacacttcccaatgaataaaatcctttcaaactaacactgaaacccctctcttagactgtggcaggatagagaagtaaatgcaagatagaaaccttctcattttccttagatttcaaagaaatctaaattttaaaagaatatttgcttggaagtttctatcattcactgttgaaatttcagaaattgatgaagcaattctggataatggtggtttgaatgtgcccctgctgatagctagtggtgtctctctcagcaccaattcaactgcagggagccactgagagcagcacacaggtgtggagtctaagcgagacctcaggatctgccgggctgggtggagaaggtcattgcagggttgagagagagcctggagaatggcatctaagaacagacacaggagcaagatcagttgtccctgaatcctggggaaagcttggcccagagtaggagaggcccctgggaggaaggcaactccagtcgtcaagaatgttctgaggggatctcctgtctctgtggcccagaggaagggatgggaagctgaacaggcctactgagtcctctgtagcctggagctagggtagctcagggtattccttctggtgctgcaaggaaccaacagcctggctggtggtactgctcctacaaggtataggagctgagactgcaacacactgacagagcaggagaatcatcatcttggacaaacaccaccactttaagttcagttccctttctagcctcatgcattttcaaggaaatcacttctaactacaagcagccaaaaagagcagacagtaaaacacaagtaagacaactcaggcacagagggaggtggggggaaagtctcttgggtaactgccaaatttcaccctcatacaatgggccccagtacaacagtgggccttaataagcacattcctttcccttcaggtgcactaagatagggaagctaaaagcagtggggatatgcctgcagctgcagaacaatgtatgggaacagacacacaactctccctcccagataagcacaacaaagagacacaaaagcagcctaagcctctaataaactcccccaccctgaatccttaaaaactcttagtctgtaaaagaatgtgcctctgacctaactgcaccagaagctcttctcaggtttgttttctctaaaataaacctgtcttaactgacgagccacctttcgtgtttctttcctctttctttacttcttacacacatcaccattctctgctgactttgcctgaaggcagctggtcctaagctgcaacaagtgggaaaaaaaaaaaaagccacccacaaagaggaccagaagctggagacatgagcaaacaaaacacttagaaggagaagctgttgatgaaacagagctgctaaaggagacaaagggcaactcaaacaaaaaataataatagcacttaacggtattcaattacagcacatgaacaagaaagactttctgggaataaaaatcatgatttttcaaactaaaaagctcagcagagtagttgatgaaaaggatggttgctgtagagacctaaattagcggcttagaagatcaagtagaaaaatacacacacgcacacacaagagcaaaaatacaaagaaataaaaatcaggggcaaaaagaaatttcgagaacagactctaaaaacccagcttgtgaataacaataatcccagaaggggaaaaaggaacaaatacaaaagagacaagaatttaacaaatggaagtaaagaatttacctgacttgaagaaagacctgagtctgcaaatggaactgagcttcttgcaagagacatgggaaatgacatacagcaaggtgtcctcctaagtcccaaagataaggagaaaatgtcatgagctccaaacagagagaacaggtaactaacaaagaaaaagtattatgacttcagtcatacaccatctgcaaaactggaatccagaagacaatggaaaaccatccaggccaggcacagtggctcatgcctgtaatcccaacactttaggaggccgaggcaggaggaccacttgagcccaggagttcaagaccagcctgggcaacctagcaagaccccatctctactaaataaataaataaaattagccaggcagagtgccacatgtctgtagtcctaactacttgggaggttgaggcaggaaagatcacttgagcccaggaggttgaggttgcaacgagctatcaccatgccattatactccagactgggtgacagagcaagaccctgtttcaaaaaaattacaaaaaaaaaaataatcccaaacgaaccacaaaaccatccatacattgccaagtgtccgaggcagatgttatccacctgtctaatttgtagaatatttgcggatacaagagttcatagaaaacataacccacataccctgtctcaagaagatattctgatcaaaaaataaatgaactcaaacaaaaatctcaagatgggtgagatgaaaagaagagaaaacagaggtgtgatgaaccttgcaatctgcacagttaaatctaattaggtaatattaaagtgactggaaacaggtaatggaagtgacaaataagaatacctgaaaaagaggagggattctgcaaagaaaatctgaacatttagttctagaagtgttaaattatctcagcaaagcccagtaattaggggtagtggaaggtagggtgaataaaagtcttctaaaggcccatctgcccacagggtatgcaagtgtaaggaagaaaaagtactcataaaaggctcaatttactaggctgctgccaggcacagtggctcacgcctgtgaggcaggaggatcactctaggtgagcctgggcaacatagcaagaccctatttttaaaataaaaaaaattaattagctgagcatggtggtgcacaacttagtcctagctacttgagaaactgaagcaggaggatcttttgggcccaggagtttgaagctacagtgagctatgactgcaccactgcactctaccctgggtgacagagagacagatcctgtctccaaaatatatttattaggatgataatgaatgggtgagtaaaacatcctggcagaaggaggggcatgtaaaatcatcattgatatcttgattgcatagaaatatgccttcgaatgtcctggaaagaaagataacagtcagcatagatggtatagtaagatgtccaaattaaaaagggaaagagaaattgaagtagtaattggccaaaccagcaaaagtaataaaatggagaaagataaaaataaaataaatagtatatattcaattatatctactatttcactaatttttataagctgaacattcttattaaaatacaaacattatcagattgtattgaaaaataaaaatatgtattcaggtcaacagagagttatacgtaatttataagaaacattttatgccataaagaaaaattaaaaatagatggtcaaatgcaaatgaaaacaaagcaggacagacgatattaacaccagataaggtgaatgttaaggcacaatttattaaaatataaatcactaagaacaaaacaaaatagcactaaaatattataaagccaaaactcttgatagtaggagattttgattaaaataaaattatagtgtatgatttcaggattgaacagatccagtagctcaaaaaatgacataaaccaagaaagacaaggataagttgaatcaagaatatttatctaatacatatatatagagagaactatataaccatcaaataaagaatatttggccaggcgtggtagctcacacctataattccagcactttgggaggccgaggcaggcagatcacctgaggtcaggtgaccagcctcaccaacatggagaaacctcatctctactaaaaatacaaaattagccaggtgtggggcgcatgcctgtaatcccagctacctgggaggctgaggcagaagaatcacttgaacccaagaggcagaggttacagagagctgagatcacgccattgcactccagcctgggcaacaagagcgaaactctatctcagaaaaaaaaaattaaaaaaaagaatattcaggggctttctttcatatgtccaaaagacactttaaatattgattatgtaattggccattaataaaaacttaaaaattttgaaaagtagagatttgataggccacattctcatctcataattcaatacaatccaaaattaaaagtatcaaaaatcctaaggattttgaaattgagaaacatgctcctacctgagtagctcttcagacaaatagaaaatcaaaattaaaaatataaatagtctagtaagaactgaagaggaagccagtcaaaatgtatgggacacagcaaaggctggctgcatgcaaaagaaatgtacaaccctatatgccctaattatttctaaaacaggaatattcaaaaatagagagcattactagcaagaaaagttaaaattaatgactacaaatgaaatgtaataggaaggtacataaatgcaaaaactggctctttgaaaacatctataagatggagtaggtttaagaaaggataaaatatgtatgattggaaacgtgaatggagatatgaccataggtgtagaacacagaattagaagacactactatgtgcaactttggtaaaattttaaaacctaaaagacatgggttaatttactaacaaaatggatactacccaaactgaccaaagaagtagtagaaaacgtgaaaagacctgttaccatatgcaatagtggaagataggctatgctaacaagcagaagttcctgcttacacagtagtcttgggtaggtgttctggacaatagggaagctttcttccattcagttatttagagaccaaaacatcttacatcatgtggccctgccatccctagagtcttgtcacccacattatctggcagaaggagaagaatatggcagatcgtgcatgggaggttttatagtgtggcctataaatagaacccatcatttctactccattttattggacccaagttagttacatgctacttaaagcaagggagaatgtgaaatgcaatcttgctgtgtgcccaaacaacgagacatcagaatttggtgagtaattagacgtatcatggcagagatagagaaggtgactaaagggctaccattgaagaagtcaatagaactagataatttcacagctgagttttatatgatcattaaagaataaatcggcgaaagttatttaaactattctcatctgctaaaaaacttccctaattcattttatcaaagcaatacacacctaaatctaaaaccaaagtaccaaaaaaaactataaacaaatccaacttatgaaaatagatgttaaaattccaaataaatgtcaacaaatacaagccagtagcataaataaaaataaactgtaactaaatagagttcattccaggaatgcaaggatgattcaaaacaagaaaatcaaaataaatcactgcatcaataaaagagaaatatgattcaatcaaaagataaaaatccaaaaaaactaataaaaactcaaagtaaatcaagaataaaacaaaagttaaaatgtgatatagaatatctaataaaggtgagcagtaaataatgaacactaaagccatttgcatcaaaatcaagagagtccttatactgccacggcatttaattttgaaagttctcatgaatgcaacaaaataagacaataaaatagtcaagataaatctcaaaaaggagagacaaattttacttattttgataatgatgtgatttttatacttaggaaattcaatagactaattgagaagtagctactggatttaataagaaaattctggtaaaaagtatgacattgccatagtaaaagacaaagaggtccatggaaaatggagttcccagaactagaacccaatatttatgggaaattatatgacaaagtggtcttttaattagtgggggaagtgatggcttatttaattaatgatgttgacacaaatgactattcattttggaagaaaatacagttgaatccctacctcaaacctgacataaaaataaatcccagatggacctaagatttaaaagtttaagaaaaaaaaatcatataaaagtggaaatttgggatattctatgtacaatctaggacttacgatgatctttttaatcaagacagggcattcatgagctattttttgaaaagacatattcgactgtatttttcaaagccaaaaagttatatggcaatatataccataaagtcaacagtattaacaaattaatcagaaaaaaatctgcaacatatatgactaataaagaactatcaataacatgcaaagagctcttttacttggcaacaaaaagataaaccgtacagtagaaaaatagggagaggatatgaatagacccctcatagaagggcaagatccttacatgcaataaacatatgagaacatactcaacctctctggtaatcagaggaatataaaattacaattggatcccgtttcatactctttaggttggcaaaacgaaaatgacgacatttataccaaagaggatgctggggaaagagtactctcgtactttgctaacgaaaatgtagattgttttacaaagcaatcttaaaatatacataatataaaaattacagactccttttgactcagaattcccactcctcaaaagttatacttcagaagcaaaagctctaacatgtaagaatatgtgtacatagattatttcagctctgtctgtagcaacaagagatgagagataaagtgtatacccatcaaatggaaatagctgaataaaataagttacatccacactgcagaatattatgcagtcattaaaaataatgagctaggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaataatgagctagctgaccagtaggatttctagaatatatacttaagtaaagagaagatgcaaagtatatataatgtgatcaatctctcactctcctttttaataacaaccaaaacagatctgtaaatgtttatacatgtttacaaactggttacacaatgcagagagaaagctattgaagttcacatatccagattcttatgttgcttatctcaaagggggtgaagcagagggtggtgagtgaaaagatagataaataagttgcagtgagaaatatcacacagacaatagcccatttacgtaaatcatccattttgattttctctctacaacttttttcaacgtatatatcttgttttaaacaaattagtatcctaccatgaacacattttttttttagacagagtctcactctgtcgcccaggctggagtgcagtgccacgatcttggctcactgcaacctctgcctcctgggctcaagtgattctcctgcctcagcctcctgagtagctaggactacagatgtgtgtgaccacgcccagctaattttcgtatttttagtagagacagggtttcactatgttggccaggctggtctcaaactcctgacctctggtgacccactggcctcggcccccaaagtgctgggattacaggcgtgagccaccacgcccagccatggacacaattttgaatcctctttgttttaaacttggtgcataatgagtatatttccatgtccactgtgttaggaccattcctggtttagtttcctaagacagcaatttggaaagaggtgcagtggatcagcacacatctcaaataacatctgcaaatctgccagcctctgtgcttggtgtacacaagaaagaattcttccaggccctggtcacatcagcagggatgtcttcacagttcactttctccaaccaatgtgcatggactcagaccttctgaactcgggagcccagcatgcctgtccaagggcattctaagtgactttggccatggccctgccaaggcttcatctgtaaggaatctagacaggcaagatgacttccccacaggtaatttctctaagagcagctacacaaattaaaattgaaaacaggtggtcgagaaaagccagaatcaagcctggtgaggaatacagaacatacacagcaacgctcatttaggccagaagggtaagagaaagggaatgccaagttcaaatttcactgaattgcccctttaagagcaatggacatactatagacaataaaacccttaaacccaaaacatttactgaacaaagtccccagtgagtggagtataatattcccaactggggaaatctgacacactctggttttagaacaaaaataagcaaacggctttattttttaacttttccgcagtctggcccactcctggtttctattcatctctagtcactcatgctgagtcctgccaccttaggaagacctcgctgcccactgccgcccaataatctccctttctctaagctcccacagaacctgcctcctgttctacaggaagatctcctagattcagtactgtcctagatggtgttagtcatgtcccctcaactgcatcataacatggcgtagaggtgctaggataatgggatatttgtttgcatttgttctcacttccatctacctcccactcccacctctgccctgccccaacccctgacctcagcagataaccaagatccaaatgcttcctggcttccaggaagatggtattcctaagcctaaagcagagataccaggaaataggccatcttctatcatttacaaaagccagtgttatttgaaggaataaatagcccagagggtgaaaaaaagggcaatgcctttgaggactagagagagagggaattcctccagcttggaaggagaatgggatacagccagtcctgagagtggtgggtgtcccagaaggtagcagagcccaattaaaatggctgtgtgatgcccctaggaaggccggccactggacacagggggctccgggtaccacagggaagccactagcccgggataagcagaacgtgaagggcacagtcaatgatgaaacagccgtgatggtgatacctggaagactacaagctcttcccacattacctggcatggaggaagcctccagaatcgctgtgaagccgtgagtagaggaatccccatccccacatgggggaatgggagcttggaatcgcatttaactccaagaaaataaagacaagtggcactgaatgtagagctggtcttgtggagtatgattcacacaggcttttcgtgagcaagcacatcatctaatgcagggcttctcaaactttgattgcacacagatcacctggggatcttactaaatgcagactttgaatcagtaggtctgaaatggtctgagattctgcatttctaatgaattataagagacactaacccttctggcccatgagccacactgagaaacaaaacatcaggggtgttttctataaattttttctatacattttctataaatgtttctataaacattttctataaatttttgttttctataaaaatatacaaattattttctatttttattgtaaagatctaagttttgtgggtcacacagtctccatcacaactattcaacttggccattgtagcctaaaagcaaccatagacaattcgtaaaggaattcggctccaataaaactttattgggccgggtgctgtggcttacgcctgtaatcccagcactttgggaggccgaggcgggcggatcacgaggtcaggagatcaagaccatcctggctaacacagtgaaaccctgtctctactaaaaaatacaaaaaattagccgggcggggtgacgggcacctgtagtcccagctactcgggaggctgaggtaggaggacggcatgaactcaggaggcggagcttgcagtgagccgaggtggcaccactgcactccagcctgggcaacagagcgagactccatctcaaaaaaaaaaaaaaaaaaaactttattgatggaccatggagtctgaatttcatgtattaataattttcatgtgtcatgaaatattatttttccttggagtttttctctgatcatttaaaactataaaaaccattcttagctcacaggccatacaaaaacagtggagaaagtaggggttgcagttgatccataggctacctggtccatggtgcccaaaacgtatagaacccacgacaggtgtcctcaactgactaaataaaagtgggttgctcagcctattccctatcctgatgctggctttcccttcctgttatgcttccactagtgttatgctttgaaacagcagatgctttggggacaagtggattgcggcaaatgcttctttcaaaaaaatcactaaaatgactttaaaagacctccctaaatccttcttcttctaataagcagccctgtggaataacagtttcctattttagtgaaacagctttaaggatgagattaaacttcaaccacagttttctgagctaacggaagagtgacatgatcaggacaggaaattcaaccatgcagaacaacgcctggtaaatttaaaagcaattgtctcaaacttgtatccccatgtaccccggcaaagattctcttcttccccttggcctcacattccactttgactcaaaagagaaaagacagctatccattttgcagttccttccaccattaaacagcatccccagagacacagttgtatctttccagtaatacagcaatacatctaagaggaacacagtgttcgggaatcagaagtggtgagggaggggccagcagagagccactgctacacactccacactccctcagaattcacccccgcttcctacacagggcttcccacacagcagcaccccatatgggtttgccggatgttcggacaaacttgatccagtgacctggggcaggtgattttgcccgctctgtctccccatgcttgacaggcactcaaagggggaaacctccaaggagttcacccatctttcctgcttgccaactgccccagtggcactcctgccagggctctagcatcctacgtccggtcttagttccaccaattattcatggtgggaggaaatgcaaaatggatagctgtcttttctcttttgagtcaaagtggaaagtgaggctgaggggaagaagagaatctttacagggatacatggggataaacgtttgacaattgcatttaaatttaccaggcgttgttctgtaaggttggatttcctcccctgatcatgtcacccttgttgtgttgggcaagatattggacctttaggaacctcaactccctcactggtaaaaataaaggtaatcgatacaccctccagagataatattgcaaagagaaaatgttaacaattagcatggttcaggcactgtttttttgtttttgtttgtttgtttttgaaacagggtctccctctattgcccaggatggagtgcagtggtgcaatctcggctcactgcaacctcccaggcactgtttaaagagaaaggcaccaaccttaaataaccagtatgactgtactggtagcagtcgctgaatctcagcctgcccaccttgtggggtggttgtgaggaatgaataactgatacagataaagcacccagcatttctcctaaaaggcactcacattcacctctcccctggaagcctcttctttctacgtggactcctggccaataacggaggccacaaaccaggtcttctactagcactgaatgcaggacacttgacagtcacttgcgccacttattcagagcatggccagagcctcctgctggatgcaacttctctctccagacatcctggggtgcgcccaggagctctggcagatcatcctacccacagtacccagggcctgcttgggcagaaaagcagctggcacctcacactcctggggacacacagtcaacctacctgtaggaagatgccctctttggtagggaggagtgggtgatacaggcacctgaggcgcccaagggctcatcccagccaccttgaaaaacaaggaccaaacctgaaaatgccacaagaaagaagagcaacatggtcatttctttggcaattaatagcagcattgatttcacagagatcttacccctcacaaagactctgtgcccataggaaagatctggatccagccttgaaagagcccttatttcttccctgagaaaacagactacacttcaccaaggaccttacacgtggcgctcaatgcatatcagctttctcaccccccattcttcaggagaatggaaggaaaaaagaacactttaattgtggctcaatgtttattgacccacaaatatgctcagtatgactggggaaaatgggaagtcttggcacagaaagaaaagaaatgcacattataaaaaggactaagtgtaaaacgtagaaaatatcataagtgcagcttatttatggttaatagcaggtatttgtttttgcagctaataatctaattagcagtcaatccaatacatcctttattatcagctgatccataattactgctccatgctgagtattttcctggcacatgatagctttcaactcctcagcacaaacaaccaaataatgtggtgttatgctaaatacaggacgattcctctctgaggggtgatgctgcagtttttagccattcatgatggcctttgtattttcagcatctgttggttaattcctcagtgtcctctctttaatcagtcttcaggtattcctaaagcaccttaacactctcaaaaatgtgatactttggagacttccttttttaaagtttaaccctaggaccagacacattcccagtcatctgtggcaggacagcattcataaggggatgtcagatagcggtgaaagcacaaaatatttctctgaaaatattgtaaagttttctctttaaacattgttttaaaatgactcatcctgaaagagatagcttctgatgtaagactatttcatccaacaatttctgatctaaactgttcactctgggaagcacagtgaacccaggttctaaaggcaagttgcaaagggaaaaatacattcaagtcctccctttcacagactcaacgtggctgtgaggggagggaaggaagcttggggtgagcatatggaagttgaaagagggtgggtgctctggaggcagacagacctggtttggaatctagatccctggcttacttataaacagcatgatcttggatatgtcaccaagcttccttaagccttggtgttcgtcacatgaaaaaccaacctaagaatgccggccgtgcagtgttgttaaaaagaatagatgactaactcagaaagcacccaacacttactacaggctcagattgttagttctctgcctgttcttctggatgcagaaacaagaagcgagtgttctacaagccagtagctcactcacatcacataattctattctctgcaatcacactttcacctcttacctataactctaggtagacttcatcccagatgtaccatggggctactataccagccaaagtcctactcgcagttcccattgtcctgcatgcccctccactctacgacccatcatcttcctatgatccagcacatactttggttagctggtgcttgtgccatagcagttgctaaatgtctctctgtctataaaagggagtaagacgtgggtaactttcaaaccaagaccttttccaaagacttatttgggaaacagaaaccagtggctatataaagaatggaaactgctaggctctgaccctaaatgaggtgctaaaacttggagtcaggagccacacactcagttcagatctttctttttcaactttttattgaagtagaatgcacaaagagaaaagaacatgtactcaaggaatttcacaaggtgaacgcacctgtgtaaccagccccccaatcaagaaactgaacagtgccagtgccccaaaatgtcctgtccccatccagtcagttaccccaacccaggtaaccatgaactgacttacaatgccagagatgaatttcgcctgttcttgtactttatataaatgcaatcacacagcctgcgggtcaaatctggcctgccacctgtcctagtacatcctacaaactaagaaaggattttatatttataaatctttcaaaataataccaaaagaagaatacttcatgcgatgtgaaaaatatatgaaattcaaatatctgcttccataaataaagttttattggaacacagtgacactaattcatttacatattgtatttcaaactacaactgcagagttgaatagtcacatcagagaccatataacctaaaaacaaaacaaaacaaaaatacttactggcccttgacagaaaaagtttgcctgctctaattcaagtgcatgacattccctaaaatacatagcatttctgttgggtttatatgtaggagttgaattgcagggtcatagatgtacacatatgtttagctttagtagacactgccaagaagtttaccaaaatatacactcaattttaggagaaaagctaaaatctggagcagaaatcataatttcagttttaagacaggcagggagaattatagagagttgatctgagcaaacgattagaaaaccatcagggcttccaagtggagagggaaaatatcagggtcatctaggtttacatttcttttcattcttattccacacatagtttttaaaaatgcagtgtcctttaacattgccatgctcgggggaaaaggacaagagtaaaaaagtcatgtttctgcttgggatcttagagcagagtaccaactttattgtttaggccatgtcacaaaaacaccaccatgggcccaggagcttactggaactgcagacaaaatatccaggaagacatcagcagcctcctgatcttacgctttcctaagtttaaccacatatgtgggcagagcctacataactcaaacccaacctccaaatcctccacaaagagtctggtccctgtactgggtagaaccagcaggccaccaacgagacagaactgaggagttgtccatcagttttcaaggctaaccagcaagacatggcagggtgcccccacattagaggcatggccaggacaccccggcattagagatgcaggcagggcaccctctacattaaggtgacgttggatatcttctaaagtcacttcctggagtcatttccccaggcacttgcttgcatttcaaataggatgtgttaggttctttcaaatgacatttttcctcttggaaggaaattgcttcctatagtttaaggaccacattcatcaagaaagggactcaaacagtttgtgtcttaactccacaaccctgctgatttctaacttggagcagcctaggaatgaacagcacagcctcctgtcctgccagcaaaccctgcaggcccaggagggaggtagtagcagggcagcgtgggctcctggctaggccagagtcagaacctgatgtggggtacttgtggggagggggaagggcggagagcctctctccacttcttgcaccaccgagtctgccgttacagtcccagctctttccactccagaaagcagtggtcccgtggactggccctgactggcccaagcatgggttaaacttggcctttcctagaagaaaacccaaagtcctccagaccctctggtggccttccagagacaagctctgtatttcccttaatcccttttccagttcccttctgtaagttaaaaaataaaattgaaaaaaaaaaaaaacacacaaagcaatgctggtgtttcagcagagggagggcatcttttctcagcaagtgcactagctttttgtccatatgaaaacaaacatataacatacacatatatatttcatcttccctggcaaaggaatctcacctgaagttgagcgtggctctaacagaaacagcatatgcgtgacagtcaaaagagcgagttgaagcccacttgctgattaggctagcttgcccaagtccctaccctgctatcacctcagattcatcacagttcagaaaacgagaataataataacactcacctcacaaagtcgcagtaaggatcaaatgaggcaactgtggatataaatgctttgtaaactgtaaaacatcacaccaagtggtggggaaaaaagctacctcttatcttcttttcctgattcaccctttaattagtaaagtctttcagctagctcctcttctgataaagaccacctgcccaccataaggacattagtcaattcagcacccagctggcagccatcaattggccatctattaatagccaattatctgggtgccttaattaatccacagaccacgtggcctgatctccctgagatcctaggaaacaataagcctgaaatacaggcaccagctaatttttcagtggccatcaaggaatctggcatctattatgcctgcatgttgcagctgcgagagatgggcacataaatattgattggaccagtctctatggctgggaggtggggggtgggagggacatcaatgattactgttctctgaggaataagagaagctacataaatcttcagcccagacaactaaggaagaaaatccttatttccaaaccatagtgcaaacagagaaaagagacagttaacctctttggagagagctcgtcaagagagagtggccctactagttctatagatgtttcaggctctctccttgcctagcatgcatgcagatcgggttgcaagagcaggatcattaggaagaagacagccggggtggttgttctcttcatctgggcattcaaatcccagggcagagacatgtgagtgtgccctgctctcctgcatttccttgaaagatctctgtagtgcttacagttaagaagacaagtgacataaggagaatttaattattttttaagtgcctcatcttgtctccaggaaatggcacgcagaaaaggctttgtacttgaaaccagcattgtccaggatgcaggggatcagatggctctgtattcccagcgataagggctcctgctgatagaaaggccagagtggcaacctccttccttcaggaaagaactagctttgtgtccagagcggtgctctcagaggtggctgctcctgaccttggggcctgcagggaagtgttgggcttctacagagcagagggcagagggccagccaccactggagccctggtcccaggaccctggggctgtatagccaggctggcttttcaggggacagaagaagaatgtgaaggggaggatggagcatggacagaacatcaggaggaaagaggatgccctaggtggcacacacctcccacaccacagagatgtcccctcctctatccctctgtcagcctctagctctcattaggccctgggatggcagcagccactgccaaatgcaaagactgtcacctcagaaggtcacatcaggccatttattctgaaaaaccaaaataccagagccagcacattgcaggagctcctgcagaattccccagggtacctctgtgtgtgtgtgtgtgtgtgtgtgtgtgtgtgtgtgtgtgtgtgtgtgtgcgcgcgcacctgtgtgtgtgcctgtgtgtgtatatgtgtgtgttcatgttcttcggtatcccaaaggggttctttcttaatcagctcaacatctgaggactgagactgatttattttttggttaatctagcatttctggtaaaataattaaaagtaatagacacagagtatctgtagtataattatttatagccataaggtctcacttcacagttattcataactaacctgaaaagactcagactgctggtaagcaagtgggggtcagacagttctagagtgagctgctcccatttcacagtcaaggagactgagccaggaagagaggaatctcagtcacccctggcactgccagtggccacactggctgccatgtctatcaggaaactcggggagtaaaacacacttgatcttgacatgatgggagctagagaaggtgggactctctctatctcctgccgcttgtgtgcagcatgagtctctgaggaccctgtgaggaaaaaggctcacacccagcccaggataaatacaggcaagtggcaggggcctgcagccagtggtagagggcacgggcatgtccagactcacttccccaaacagatggtgagtctacgattctaggtctctggggtggaatattcaaaagccatggcagggttcacagactcccccaggagaggagctggggatctggccctgctttctaattcagattattttccaaaaaatgcattggggactttgggatgctatagaagagtgacaaaactgcaaacattagaaatgaaacaagggctcaagcaatgaaggtcttcaaaaactggttcctgggtgtctgacaatgaataagaccacttcagaaagctgggatggggaggcatggtgtaggatgtaggcacaggaggtaaaatcagatggcatgaaaaccaagctgtgcaggaatcctgggcttcaggcgtcagcccacggcagccttattccgtccctgttcagtttataaatgacctctgatgagtggaaattagcacttttaaatgatacaaccagatgggcagccctgaaaaaggttagtctctggacagactggggaggcttgtgacagggccattaatggatcttcccttcctgctttgcccctctgtcttctctgatttgagtaggtatcattctgtgcctctggggaagtttgagagaggaattcctggtatttctttccaaaaactatcaggtcactttgggaaacaaaggttagggagagatagagctccccagcctgactaaaagagattccatctgcaggtccctgggacagggcctcctgcagggacctgggggagagagtgggctaggagagtgaaaggaagctgggacacagcacatccgccactgactcagcgctgacaaccagaggcctggactccgggccttgggacaacccagaataggccaaaaatgacccacggtgaatttctcaccatacccatgggatagaggctcagtggttttgtttttgtttttgttttagaaaaagcttcttgacatctaagaagtgaccacatatgatttcttgactacctgggatcccaacctgccatttgcatatttctcagtcactcacaagagcctctgcaggagccagctgtgtaccaccacccagacacctgctcctgggaactgccttagaatggaaagaaagcacagcaccttgtacaggcacccacacagcaactgaaaggatgagcatgcatctcatcatgggctacttctggtcatgccagagtcacactgaaattgcctttgcaaaaattacaacaatgagaaaattgacagtgaaagagaactgacctaacagactccatcttgcttctaacttccaagctgtctttgttcaatcctgggtgtaggctgcactaactttgggaagaaccctgaaacaaaaatgaaaacagccgtttgccaaaagaaacccccatcttgcctgggggccagactgcctttgtaggactaacgaattagccataagattaaaaatgatggtttaggagtcatgcagctggaggccacaaaattctaaacctccccagttgctcctagggataacatcactactgtgaaacctaagattggtgcttgagatatttttcagatcctacactgggtggatcagctagcgccacccagatcgataaactggcccatctggtcttgtggcccccacccaggaactgactcagaggaagaggacagctttgactccccatgatctcatctccaaccctaccaatcaatacttcccactccctggccccctacccgccagattatccttaaaaaaaaacccagtctctgaattttcggggagactgatttgagtaataataaaactccagtcttccattcagccactccgcgtgtattaaactctttattgcaattcccctgtcttgatacattggctctgtctaggaagcgggcaacaagaacccgttggacagttacaaaattccctggacagagtccaatatgcacataccaagtatgagtagattaatagggtctctctctaaaatttatgactttttttaatgagagaaattatctactaaatgaggaataaaataacagtgtcatatacttaaggcattggtgggatgcaaatgttacagaaagacaagctattttctaatggtgtttgttgtatttctagtacagcaccaatacacttacatgggccagaggcattttattcaaagcctttacatttccaataccttccttgaaaattaccctcaggcctacaattcttttgcttttactaagccctaaacacctggactatatttagtttcttagaaataagagacaaatttgctgatatttttaaaattttagtcagttattgtatgattctccaaatggcaaacaaatgatagggagagaagaaattaaaacatttttcagctacttttaagtggcatagtatttaccattcaaatacagtctgaattaaaacactcaatttgttacaggatttttcagttagaaattagagctttgctggataattgggggggaggcagtaaaagaatgaaattaacgttaaaaagtcaaatttaaagaactctttacttgagctattaatagaaagaatcagcccttcttgaaactaagaaaaaagtctaataaatttccttaagccaggagtgtagcatgccttcttcacttcacttgcactggggcccagcgaccagagatttcatttcatcccgccctctttggagatcctgtcactaggtgagtggagacatttcctaagaccacgaggaaaagagaacaagggcctgatggcccagaaccagaacctgcctctccgaaggcaatctgctccacagaatctaagggtcgggtagttccccagaccaggagcccttaatacagctctctccaatctctacacctttcccaacttctctgaatacattcaaaggaagggagcccactcctcttgctttggaagaaaagctgactccctcacccatgctgggaagatgcctagaggcctgagcaggaagaaaacctctccaaggcttcagcatgtccaaggcaaagagctgtccccatgattacacgctaggaaaacctacagcacggaactcactcaaaaaccaacttttttccctatgatagatggaagtcccatccgaattcctactgttgaagaaacaatctctgccctggcaaatggcctcctaaaccaacgcctctgcaaccacccaacacagggactctcctcatcagggtgtgctccatccagtgaggggagcctcctgtgccccacatggtgccttccaagggcaggggtgatgtccctccgcagtagctcctgccttagcacctcccttacacaaaccccctgggagctctccaagggtgaggatctagggatgagccaagggagctctgggaagcgggtggggaattcctgctgtcaattcaggcagtctctgggtttaacggcatggaaaaagcaagcagtgggcagtttcaggagggatcccattccattcttgtcctgatgctgccacttggacagcttggttagcttgggccaaatttttcacctccttaatgtcatctgcataaaagtactatcttgtctcccttgtgcagttgtgagtattaaatgaactaatatatgtaaatggagtctgtgaatttgtaaagccctatagaaatgctggtggctgttatttaacatgcatgcataggcttacatgggttaggtccataagcacactcaagaagaaaatcatttgaccatatttacatgcagccaaccaaaccacgatcaacagacttggtattcttcatctagctcccaaatgccacccatcaataggctgcttcagaatcacatgcaaccctggtaaaaacagtaattctagaaccttctcccaaactcacagaggcataatctctgtagtaagcccaaaaatctgcatgttaatggagctcaccaggtgattctgacatgcagccaggtttcggtaccactgtgctcctttggacatgtcatataaatttggacttgtcatacaaagtcacagggaataaaactgttctggcgttacctaaggagtctctgtctttcttcctctcttctcaggtacatacacactaagatacagagcgacatacatacaagggaaaaacaggaagaagaaaaatactaacaaaaaaaaaagaagacacctaatagtaagaggtgtcaagattttctaagtctataaaaattcatggttctagaaggatacagaaaatgaggaaaagaaggaacaagatgttaagacaaagagcaactggttcaaaactagaaaacctcctcttttgtgactgcacagtacaatgtcctgacttctgctactaaaccactccccaccttaaagtaccactcatttgttggtaattctgcctcatcctgcaacttatgtggccccccacccccatgccaaaggacagggacacagcgtgctcatcatagcagcccccaaacccagcacagagcctggcatacagctgcctgtgatagatgtgtgctgagcacacgccaggataagaagaggcaggagaggaggagggacaaagagtgcacaaagaaagaaacaggtctcttgtcccagatccctggtgtaaactaagaataagcaagcttaaggtaatgagggtcgaagcaaaacagagaaagttcatgtccctgcaggtatcattaactacatcacagggagcagaaccacctagggaaaaagaagaaaagctctccagatctatgggcaggggctgagtgagaaaagtgatctggtgctattaaaggtggtttgaagtcatcaatctggcctcgccacctcactgcctgaccctctccaagagtcctcacacccacaagattctaccccacccagcccctacacacctccctaaactttatccctccaacctccacatactttgtgctcaaattatgccaaactcacacaacgtgctgtgtcattcctctgagcctgtttcatgcagttaacctctacctggaatgccctttctacctactgacaaacctgtttatccttctcagctcagctctgttatgtcctcctcctccagggagacctcaggctcccatgacacccagtgcactgaaccctcttagccctatgcacacctcacatcctggtccaatgatgagtgaactcctctccccccagagagtaaattctatctctctctacccatagcacctaacacactgcctgagcacacaataggtgctaaataaatgcttgttgaaatcgacaaagcattggcaagattccagaacataagtgctagaagacttggttaaaaaggggaaaccgagaggcaacttgatatactggaaaccctgagcgtggaggctggagttcaaaccagtagaacgacttaaggtacgtgacttaaagaccctgaacctgttttcctgatctatgaaacaagcatattaccacccaactcctacaactacttatgaggaaggcacctactatgcacctggcacacagtaggccctctgtactgtacttaactggtgagacgccacctcccgcccacatcttcctgtttttcagtctcccatttccgaccataagctcctccaaggcttttgcccagacccctagacgactgttctggacccagtttataaagactgcctggctggccaggaaatcccccagaggcctccttccgtgtccccgggccaaatctgtgaagagaaaacggaaggctaccatgtcacgaaaaactatgatcaaataaattattatgccttttctcctattgatctgccttttgtcaactgattttcagtgaaccttcggagagccatggggaagttttccctttccccctacagggctctgaatctgaaggtaagagtgagcctatagggggaaccttctggctccctcacaggaactgactgagcaggagttggaaaagccacttggattcccatttcctcaactccccgccaataccaaggcgtctgtttttacaggctctttcgtggtgttctgggcacattcaacttccaatgcagctgagagggtcgggaacagttagagaacaggggtggcagccgcccgggaggctgcaaggcgctcgcccgcaacgcacaggcgcgcgcggcgcacccggcctccggcctccccaggtcgggcctggcagctgcgggaaggaggtcagcgcagccgccacacttcgcccgggcgctggcccgacccgaccgccggcgactctctggcagcgcccggagaccgccagcccctgggccgcccgtccgcagagccccctccgccccgggaccctcgcgcgcagctcaagttgggagccccgctccgcaggcgagcgcgcgcccaccacccacacccactgccactcatgcacaccgcgggtccggagatgcccccgagcgttttaaaatccagaaacatcacatggtagccacatccggcggctgttacctgctcgcagcacccagaccctcgccctggtttcccgggagcccgcaaacccggcacgcgggctgcgcgccctcccgcaagccaccgctcagcgccagcgcgccggcaagccgcctaccttaggggtctgcacttcaggtcccgtcggcacctccaacttcctcttggttacccagaagaacagcagcaccgtgatccagagcaccccgaagactggcagaaccagccgacgagtcaggcgccgcatggtcccctttgccgcttcctctccgcggcgctacgtcccgggggcaccccccggcggtcagggttggcggggcaggagtcctggcgagcgcctcgctctggggagctctagacccaggatccggttggaggggcggcaggatcctgcaaggcgcccttcccgcttcgaagagaagcgagcctgggtggggggtgcagggcgacccgaaacgtggcagggaaggaccgagggcagccaagctggacgcccgctccagcgggagaagcgcggtggctgccgagatgttccccacgccgccaccgcggctgccgccgccgccgccgccgccttgcccgctgccgccgatagggaaactgactcgagcagcgagagggaggaatccgaggctgtgccaagcaccccgggaggagcacgagggcggagggagtgagcggggagggcgggcccgacagacaggccgactcggagcgagcccaggtgggagtgagcggggctctgagagggggcgctaccgccgcccgccgaccgaaacgctcggtgctgttgcggggccgccagcgccaagccctgggcgcagctcccagaccatcgtgggttggggcaaggcggggcggggcgggagcggtgcactcgggatgcc

SEQ ID NO: 2572 - DNA, 228263 bp, Homo sapiens; identical to SEQ ID NO: 2571

SEQ ID NO: 2573 - DNA, 219177 bp, Homo sapiens
atgtccagagacaacttctaagtttctctttatttcttttggaaacaacctccattcttcatctctcaatgtagtcctggcctagtgaaaaagaaggcttttctttctggcctccagagactgcttcctttgtaggaaaaggaacaataaacacttcccattaggtttctgtctccagataccaatcagggaatgactggccaggactggaacttaacggccttgagaacatgtgggatttgtctttgagccccattggcttgtgatgttttcctctgtcctccctgagacagttgctcctgtcctggggggctctgcctccacctcccagtccaggatgtctgaggtggttgcaggctgcttgctgcccagtttccagtctgttctggtccagggaagcaccaccccatggcccttgctgcttctggcaggggtcctcaagagctcaccatgtcccagtgctggctcatgagtgaggactcacatgggttgacgacgatttccttgccgttctcggtgccatcaccgaacatatctgtatcgaggcagaggtgggatgctatgtgctcgatgtgggaaccagttttggtccattgctggtaagacaaagaagagagtgaatgaactaggtgccatcagtaacatgggagttccagctttatcagaaaggtaggtgcctcatgtctagggtcactgagagacttgatttcatggtttcataagcactaaaactgcaactaattgctctaccaggtattattgttggtttctttttttaaattggattaaaaaaagttaaaagcaaaatcaatatgtttactaggaaaactcattaggaggcaataactttccaagcagtagcccagaaaacatgaagcgagttagtcacaggagcaacctaagaaacgatccacactcagcatctgcacgatggcagagaagtggggaagagctgggagcagcgagtgtgatggcaggaggggctgggggcttcttcaaaatgtgtcagcacacgacgggccagagcagagaggcaggtctcatgcagcaggttctcacacttgacctcgcatgacaaaggagggactggacacatcaggggaagcaccccggagagggcactgagcacgttactgccaagagacagtcacagctgccctgtgtagtggacattctcaaccccatttcagagaggaggaaatggacatccagagaggtccaataacctgccatgggtcacacagcctgtaaaccataaaacaggcatttgaatcttgttctctctaacaccaatacccagttggcaagaaactgaatggagacatcactttgctgctagaggaactgggcatgtggtgcatccagaatgctaggaagtttgggggacatactgccagagcccagggccctgaaggcaagggtcaagtcttgctcatccttgtgaccctgagatccttgtttgggatcccacgtggggaacagagcaatgacaggaaagtagaagatgactgggcatggtgtggtcagtggaaatcaataggctttcatggggcaggctgaccagtgagggtggatgttgccattgctgctagcatcacagaggggatcccaggcagcactttccctccctctcctgacctctcttatcaactcttcctcttctaacaatttctctcttttcctgctcatcagactaagccctcaacaggcagtcacattacggagttggccacatcccagggacctgctgagcacttacctgtcggtcatctccattcttgcaaaggacaagaaccactggggcgccagggaacaaggtgatgactgacaggcacagctcctcctggaggatctgctgggtgtatgtgaaggcccatacctggggagaaagagaccaggaaggtttgttcaggatccaggaagccaccactcgtgggatacaaccacacttacgggtgtgattagcacaggctggtaagaagcaccaagggtcccagtaggcaatgatcatcaaggttaccttggaaaatgctactcaagtgccagagactcggaggtcatatctccatggaaatctccatccaccccatgaaggggcctgggcctgggccattcaggctgcctctgggagtcctgaacaattctgggctttgggcaggagtctgaacaacaaccccagctgagctgtgtgctccacagtttttgtttggagaaaacatctcgagggggtctgttcccagcacttgacatttcaagcagccatctagcaggtcaactccccacccctccataccagatatctttagactctcccctgttctttgaaaggcagtccaagtcagtgtccagagcacatgagactagagcacatgagagttatgacaagaggcagatggaaggataaatggaacaagtgttccaagggaatgaataaagaagggtctagggaaagaagaatgttatgaggattcaaattatttcaggagggtgcatgtgccaggataatagatcttttggcccctgagctctttcagggagcgaagctgagaaattggattgacaagcagagttctgttggcatcaggaagaagggcatgctgtgtcattcattatgaggaatgattccaacatttttcctccaaagtaccagagatcacagagtaactggattatgaagccacaagcacttcccagttcttaagtcagtggggcagaaagtactggcataagcgttttctcccccaggttgtaaaataaggtaatatttaccctttgcctccgtctgggggcaaagatgattcctgaattgggtcccctggggaagctgcggaggatcctttgagggctgtatctgtttccaccacatccctgaaacaagttgaccctgagcctctggaccaggttactcattggctacttccccttggcccaagaatgaaaaagtccacttagcaggccagcctcctactctaggacaaggtgtcccccaggcagacatggtggtcatctgtctctcgttctccatcttccctcctggtccctggtcctctcctgacctccatgggctgctgaaagctttaattgttttctgggacctgggtggttcggaggaaccactcccacaggctcaggaccttctgctgtcctgaatacgtccaccttgagtcaacctgacttgctgtacaatgacgcctggctctcttgatctgggactcaccggcctagtgggagaatggctcctgcattaggattcttttatcccttttcaaactgttggtgttgggagaagacctagatcagaaagtactccctggggagagatgcaaatatagatgaaacaagactgtccttgagtcttgttcttaacagcagggcaatgggtacatgggcgttctttatactattcgacttctgtatctatagatatttgaaattttctataataaaaagtcatgagatacattccttgggacatatcaagaagttcttctctggccttgtgaccatcacattctacacatcccatttgcctttctccaagataagctgaaaggggaaacaagtctgtccgcacagaggtggtgcaatgaccaggctgctgctgctgctgctgctaataagagctgacatttattgagcgcttatgatgtgcccagcattatcctgacaactttacacagattgattaattttcataagaatcctattaagtaggtattactattatcctcattttatagatgatgaaaccaaggctcggagaggctatccaaagtcatacaccagcaagtggcccccacaccaactttctccagcagctctgctcttgttgatgctggagagttagggccggctctgagctcttttagataaccttaatccggggagaagacacctgcccctgagattcttcttccaggttgtagacattaaaaccaaagatcagctccaccttgacaggggagagtggcaagagattcttcttcttggccagttcccaatgacaacctttatgaaaagatgaacaaaggttgtacccccttgccaaggtctggggtggggcaggccagagaatagtgccctctctaatagagtaattcggccatgagtatgaatggaggcccacactcctgattctacaccaaaccataggatacacacagtgctggcttctagcctgagccgccccgcctttttcttcccctaccttggctgcatatccaagctgagtcattcccctctaaatggtctcccttggacctggggatgtgtactagagacacagtccaccctcggaggacaaacccagggatgagacccacgcagggttttgaattaggctggggccatttgggtgggggattctgaagtcctaaatatccagaatgtgatctagaaggtgggcctagaatattccttggcctgtggggaggagagagaagggccaaaaggtcaaatgcaacagctggactaccaggaagccatatgccctgagatcagtacaagggaaagactaagttcattccttctgacccattacctgactatagagtctgtagggaaccacaaattagtatttcaaaaatgaatcctgccattatcttacaatcaccatcatacaatgacattgtgttttttgtgttaaaagcattaactgattaaatataaaagcctcttttgagagcccactttggcatttcttcttttttaatatcctaggggtcccaaaactggaagtgctggatgggtgggtgggtgggcagttattttgacatcctctacccttgttgtccacagatgcctttcaggaagaaatgcatttgggcatctggtgtgtccccaggccgggacttgatgaaaacatctcaaagacccccaaggagaatgtgtgaacaggcacagctaatgaagccctcatgctaagtggactttccattagctggtatttcctggcatttcaataacttagcctcgtcatgtcccagaggaaggctgatgtctggccacatctgaaagaggagaggagggaggagaagcaggaaacaggagcatacaggtgggaagcaaggagagcattttcggatttccattctgcagcctgtcagacttcccagaagggccatgatgaatgagtttattaaaagaatcctgcagtcagaaacagactccaggaaggcagcagaggttgctcagcaggtctggcctggattcgctgagtgctgggccctctgctggtggcttcgtttgggggcctggcaaaagcctagcccatgatggaggtcctgtggcaggccaggtctccctaacagctgaacaggcaggcctctaagacaactttcagccctgactgagtgggtaagttaaatgttaaaggctgaaagggccagtgcccttttacaaaagcttatatgtaacaaaagcccaccaagagtttgtctaggcttttcctgggccttgaagcatgacaagataatgaaggaattcttaacaggacctgtttaggattaaacaagttttatcaggggtctgaagaaactccccagacctccacaaacaagttttattggggtctgaaggaactccccaaacctccatgatttagcaggagacaagataagagtaatcaccccagcacctggacccatctagattaagtaaatttactgaggctccaggagaaggtcttcaggactcagaccttagttatagattagaagaagttaatcacttatgtctttagatgaatgcacactcacacgtagacaaacagcttagaaggtatataagctctgaaaaactttgtaattttgagttggtctggtgataatttccaggttttctctctgtgcccggttacagaaataaactctcttctttcccagttcatctgcatctcattattgggccatgagaataagcagctcaaccctcggtttggtccgggaaccgtccctcctatcccaaagctgtagccatggaagggcaacccagagactgtccttagttggtgtgggtgaccctgccccctccactgggataggccagctgggggctgaggaggaggggagtcaccaatgaatgaggaggggatcgactgggtcagacagccttaaaaccttctgtgcttggaggacacgtctggagatggccactgctggtgggagcagggaggggacaggcaggggtcagtaaccttctctagcagatgccagtctggccatagctgtggaagctgggatgcagacgggccacagcacccagcctggggcttgtggtcttgcacaggatggcgaagcagggatgaaagattgtcttaagaggtaactaaaagagggtcaggcgcggtggctcttgcctgtaatcccagcactttgggaggctgagatgggtggatcacgaggtcaggagtttgagaccagcctggccaatatggtgaaaccccatctctaccaaatatacaaaaattagccaggtgtggtggcacatgcctgtaatcccagctactcaggaggctgaagaaggagaattgctggagcctgggagacagaggttgcagtgagctgagatcatgccattgcactccagcctgggcaaaagagtaagactccgtctcaaaaaaaaaaaaaaaaaaaaaaaaaaaaagaggcaggagtgaggacgagcctgggcccaggcagaggagctgctcttggaatggcccagggcccctgcctctggtaggcaagaaacaatcagcctggagcagcggctctcgactctccccactcagcggacctctggcagtgtctgcagacatttttggttctatggctgggtgaaggagtgtttctagccaccagtgggtggggtcatggatgctgctaaacatcccatgctgcacaggacaacccctcaacaaagaaggatctggccctattaccagtagtgctgagggttagaagccctagtctcacctgaagggcttgggctctgcaggtggcaggcctgtatctgaaccatgccctggcattactcacataccacctgggcagtctctccaagcctcccttaccccatctgtcaatactctctccaggaggggtgacaccaccaggcatgggcaggacagcactgctggttttgttgtagttagacagccaaagtgacaactgcttgtaagagactctttcaagggccaggcctggtgctagttgcttcacattcattgtctatttaattctcataaccactacggttcccgttttgtagaagaggaaactgaggatcaaaggggccaatggttactctggcaatgccagaagcagaccccagggttgattctgaacttggcctctccttggtgaggtgagacctgagccaagtatccagggccttgaacatcttagtccatactgggtacctccacggtccctgagacatagccttgaagctctcccttcaaacaaggcatctagaatggatgagcctgaattcaaatgaactgccctcgtgatgcctctggctctctgaagcatcagctgcagtgattgtaccaactgtgacaacagcacaagtgagctgatggctgtgctggggtctgcctcagtccctccctggtggaggctttttctccagaggcagcaggatgacctggtgggctcctagacacacctccttccattggaaactttgatgaacccacttttggggtcttttctttatttccagcccattctgtcctttcctcccatgtggcaagattacacttatatgtgtgattaaagcccacactcagtacatcttcgctgggtcatgttgttggatcctggggtgataccagggctagaatccccacagagctgcctattaacctgtgaatttgagcgagttactcaactctgtaccacagttcccttgcatgtaaaatgaggatgacatcagtctctaagagggtcactgcaaggaacaaatgggttaatacctatcccagagtggtgctttccattagcaaatgctcaattgctgtctgctgtgttcacgatggtgaccagggggagccaacaagaagagagaggaccttacagaccttcctttggaatcctgcccaggagctatactggaggcagggatggagccattcccaagactgtgttgacaaagcacaggaaggaagggtggcatcgggcagggagggtggcattgggcagggaggatggcatcgggcagggagggtggcatcaggcagggaggatggcatcgggcagggagggtggcatcgggcagggaggggggtatcaggcagggagggtggcatcaggcagggagggtggcatcgggcagggagggtggcattgggcagggagggtggtgtgtgggctgggagggtggcatcgggcagggaaggtggcatcaggcggggaaggtggcatcaggcagggagggtggcatcgggcagggagggtggtgtgcaggcagcctgtcccaccggcagactcaggctcacacacctcgaggcaccagtgccagtccagattagggggagactttatcttcacctgcccacccagggtacccaccttgcatgctccacagccagtagcccacacactgggagacaggtaaaaggacgagctaaaaatatatcttatgtttttcccctttctttaaattgggatggaaactagattggtgcacctgtattctttctacctttcacaaatatttttctagagtccaataaagttaagaggaaacttgttaaccttctcgggcttcacatgtttacaaacggatgatgtatttctctcgcatttcacctaaggcatcagttttctgacatcttcaatacacactcagattaaatattttgctcccaaggttgacaagtcagccaagagaggaagggaaggcaggtgaggaatggataggactgggggtggagcagcatcgggagccagtgtcagaaccagaggacaaaacagtctcctttcaacaacgaggacgccccagagcctggggctcacctgcctgcagagactgtgggcagctaaagctgaactcagcccttggctcccattctctggtgcttttactccacagttgaggaccctagagtctccagggcaaaaggaccaagccttatttaaaaacctatgtagatctcatccctgggttcatacatggtcctgtatccccagccagttactttacctgcggctttgcttcttcgcctttgagcgtgtcctctgagggtagactatatccctagtacacagccctaggcccaagggggaccatttagttgggagtgacccagcttggatatgcagccagggtgtgaagaaatggggacaggcaagacaggaagccagcatggtatgtgtcccacattctggtgtggaattgggagtaggagcctccattcatgctcttgtcccaatgcccataacataagggaggggactactctctggcatggtcctccacccgagaccttgacatgggggtacaaccttcgttcatcttttcataaagattgtcctttgaaactggccaagaagaagaatctcttgccactctcccctgtcaaggtggagctgatttatggttttaatgtttacaacctagaagaggaatttcaggggcaggtgtcttctcacctgattacacttgtctaaaagagctcagagccagccctgactctccagcatcagcaagagcagagctatgatatgcggccagattctccaaatccatcttcaccgttattggtaggatatgactttgggtaacctctccaagacttggtttcattgttttggcctcggcctgtatctgtacgatgggataatagcaacatctacttaacaggcttttatgtcacttccctgatatggcctctcagaggcaaaagaagtgggagcagagaagactgaacaaaccatgtttaggggtttgaggggcagatgtgactccctctggacaggccaagaggcaggacaagtaggaggacagaggtaggaagaggtgatgggggcaaagcagccataagaggagagaatgtgacaaagcccagtgttagcagaaggggttgggaagtgggaaaacaggacatttacatgggaaggaggagcggacactgaaaagaagagaaaggccatataagtcagtcctatgagagtgtatgctacacacacacacacacacacacacacacacacataggcacacatactcagggagattatcttagctggcatggtcatgtggatttctttcagtcccatgtgggtttaacacctccagattacttggaaatgtatccaagtcgtgccgtaggccctggagggcaggggctctgtctcacccagcatcaggccaccttgcatcccagcaggaatggtccctgggccgtggtacagtctgtgaagtggactgagcgtcatcctgtctaggagtattctcccagcaccccacattcacactgtggtgacaccaacccagttgttctctccaaggcagagaggaggggcatctcagtaccatcttccagagaagatgctttactcacccacaggccatgcccaggatgagtgtgagttgcccccagatgactgctgtccctcccctttttcacatgacaggaaggtcagctgggatgggcactattaccttctggtcaaataaaggcctgacaactctcctcagggccagagcattgcagggcccctctcggaggcccacagagacctggctcctcttctcccacttctttatgcagccaaaggtgtcaggtaccagaaaagtcccctgttctgctggaaacagaccaagcacactcctgccccagggaaagggggaagacaacactctggctgctgcccaccagcactgcccacacacagattcagaagacagggatgtgtgtcccctactcacaacattttgcaaaatgccacttgagcaaattatgtcattctcatccaggcagtcacgccttaagcaaaatcaacacctcaatttcctttcccttttcctgtctgattcaagcagctccctcccctgccctactggagtagagatatgattcctggaaaagccaccgcaagctggagctgggttgagatgcctcaagtaccaaggccaagagtctggcttttgtgatagacaataggagccatcgatgtctgtgctgagactgggaacaatgggttaatgaccacattcaatgtcagggtaggggcagggctgcagccagggcaggagaagcaagtggaggcttttgctgtaatctaacccagtggctcccaactggcataggtttgtccctcagggggcatttggtcatgtgtgagacacttttgatggccgtgacttgtgttgagttgtgtggtggggaggtgctgctggcaagagtgggcagaggctagggatgctgctagacttcccacaatacacaggggagcccctacaacaaagaaacgtccagctcaaatgtcaagagtgctgagattaaggaatgctgatctagcatgaagaagtgaacatgggatctaagagcaacccttctgagatatgagacaatgaggggtgcaggagaaagaagagccacagaagctggaccaggctggaactgagggtcatgggagaagggggtcacatggagagagctagtgggacaagcaggcagccagggtgcctgatagatgctcatggctatctgttgtcttgagtcacaagtgagttcattgtgggcatggactcactcaatcagccagtgttgagaaagtccaggtaggagatctacacctgcagatctgcaattcccaaccctctcctgagatctcatagcatcctgttccccaggacaaaaagcaacctcttcagcacctgcaaatctgcaattcccaaccctctcctgagatctcatagcatcctgtttcccagaacaaaacataacctcttcagcacaggaagagagaccaggattcagctcctgctttctgtccagcctcaccgtctgctgctccttcccctcacatcccactctccaaccctactctcccactgtcctgcaaaggcagcatcctcactagcacccttgctcagctccaggtctttcctgggccaccctttcttcccttcccaacttggcctatttctactcatctctgagaatacaactcatttccaagtccggttggaaatcttccctgagcctcacacctaacttggatgccatctcttgcaacttctatggtatcctggacaaaactccatccaggacagagattacatcatactactttctagcttatttttacattaggccctttgaggggcccttcaggcctgcaacctagtctttcatctctgcatcttcatagttaataaagaagtatctgttgaatgaataaatgaattcatggatagatgaagataaggaatttgtgaatcaataaacaggaaactgtcaaagctggaagcatgaaaaaatctccaagaaatcgtttgtagagaaaagaacagtgagctgggaaccttgatgaatacccgccagaagggtatgagagtgggggtgaggagttagcaaggaagccatagacaaacgtgcctttttttttttttttttttttttgaaatggagtttcactattgttgcctgggctggagtgcaatggtgtgatctcggctcactgcaacctccgcctccagggttcaagcgattctcctgcctcagccccctgagtagctgggattacaggcgcatgccaccctgcccggctaattttttgtatttttagtagagacagggtttcaccatgtttgccaggctggtcttgaactccggaccttaggtgatccacccaccttgaccttccaaagtgctgggattacaggcgtgagccaccgtactttaacgcagtcagcaggccaagtgctatgagacaggctatgaatttgtcagtgacctttaaaacaacagttctagcctcagatgggagaagactgtcccaaaaaacatggcagggagggggagatactttgttgatcaatcaagtaaagcacaggaaacctttcagagaagggaccacaaggggtcctgcagacttaggagaggcaggagatgcagaggtgaagctggggatgaagaaggatgctgcccagagacagggtggcagacagagagggttttaccaaatctgatgtgactacctgccagtcagagctaaatcagctgggagactcacagagcaggcattccgtcctgtcccagaaggcagtgtcacccagcggcagtcttctccctctttgcatttcacatctgcgagctagctgtgccattggccttgcctgaccctgcccacggttgctgccagcaggtaggacaccaactacaacaaactcattaagctcctgctaacttaatgggcaatttcctataggcaggatgctgcctattaaactgtctttcagaggaactctatgcacttggaaagcaagcagtgtaagcacagtggcagagtggggggatcacacctctcatgctccactaccgatctctgggaataaatgggcatctgatgtcatgtaagagcaggtgatggaggcagagtcatctggctgcctccctctactgtgacacatggtcctgtatgcccagccagttactttacctgggactttgcatcttcgcctttgaccttggcacaggggctcaactttaggtttggggtttcttggttgttctgcctttgagattccaggcacttctgtctctgtcggatattgcccttctggatggaggactccttggggatgctggaggagagtcacagggagagaggagagtccactgctcattggattagcaagactaccagctggagagggtgggcagtgttctgagaatggcagggctgggctgttagaaaatatctgcactgctcggggaagggcagggtgccactaagaatgaggtggcaaggaaagacccaggagctacagagggagatgagtacctgcagtgaagctggtgtcagtgagtctgtaagtcagggctcaaacccaagcaggtgagaaatactgctactggctaactgtaatccttcatgctattgattcagtataaggtccctccgggttttaggggtgaacggagccaactggtcttcttacacctctgatatacataaaagccctcatccagttggtcattgtctgtctcttctccagaccaagccagctgagggcctctgctttcagccagccaaagctccaacaggtaggacggatacctgagttcagggtagatattctccaggtaccacttgaagctctggcagcgcagattcttcctcaggtccaatctgctctcaacactgggggcaacggggttgtggacagacacaaagacaaaacacagctgtcagaggcaggcgccagcaacgccagtccagactgagaacacaaagcgcgacccatgcccatgctctgtgctcacatctctctggaaggtgctggggaaattaagcaagaacagatttctataactgcagacagagctatggaaacacttagcaatatctcacaatggtgcggtaatgacagcgaggactggtgcttttacttgaagatggaatttgggggtgtttttacttttcattcaaaacaaagctgcaagaacattcagtgtgttgttaataatttaccgctggggctctgggcctgcttattcacaatttctctttggattctgcagccgaaacaccactccccgctgccccagtctcaaaaaatccttttatttggctgtttctggggcctggtcatgtatttgttcattagatattcattgagcacctactatgtgtcaggcattgtacccaatgtgggatactatggaaagcttttgaacaataggcaaagataatgaaataagccatcacagcccaggtgacataggatgagcaggagggacctatgggaacaactcagagggggacccttgcttgtcgggtccatggtggtcaaggtagtaatggtgatgctggtatctggaaggaaaaggggacattatctagacaaaccagaggtaggggcccctgctagaggcagtggggagagcaagatgaggacatgtgaagacatgaaagaagctctgcgggcaggaagagtgctgcaggatcttaaaatagatgtgtatgtgaatgtatgggtggtgatttggaagagcagaaatgggtgagttgaaagcaaagacagaccataaagggtcccgtgaggcactgccaaggagtttggacttgtttaaagggcactgggatgaaactgatgggttctaagcagggcaagaggtggtttgtactttgagagcatttcagtgctggtccacaaatgggtctgatgggcaaagctggggccagggagggtagtgaggaggcagctgtggaaactcaggtgctgatcatgctttcaaacagggaagtgggggtgggaatgaagaacaacaggctgagtgcctccacacctctcggcacccacctaagttcatccatgtctttttcttcctgggcaaacacatagagctggccttgcttcctgtccaactcacttccttccactccccacctcaagattgcactataacttcttcttacagagcaccaaccacagctcatcaccagactctaagctccatcaggatgggaaggatgtcaggtttctaaaatgctgaatattgggtgtttagcaagggcctgtgtgctcagtgcatgatggtgcagtgttaccaagacttggtgatcatttggatgggaaagagaaggggagggattcaaggatgggaaagagaaggagagggattcaaggttgacacctagatttctgacttgggcaacaggtgcaacgaaaactcttcacggggatgggaaatatcagatgaggagtaagtttaggagcgaacgtcatgagttcagtttaggatttgttgagttggaggtaccagggagacatcctggtggaggtgtctagttgataattggatagaagggattggaactcaaaggataggtttagcttagaaatagagatgcaaatatcagcagcatagatatagtgcttaatgccagagagaatatgtagtaagaagaggctttttaacggaccctccggcaagaccatcatgcaaggagtaggaagaggaaacagcctgcaaatgggaccaagcaagcagtgcctagcagcagaagaaacgccatgcctgcagagttctggaagcctagggactgggggacaccagaggggccgggggtgggagaagactcatgctgatggggcagcgaaagaggacagtccagggtgcaaggaagtcacgagggagccaggtgggagcagtctcagggcttgggggccaggagaaaggaggggagtggagagaggaaagcagaccactgcttcatgaagctgggcactggaggaatggaaaagacagagcatggattatgagcaatgttggactgaaggagggtttttgtagtttgttttctttcctccccttcctatttttttttcttaagatgtaagacactgaataagtttaaatgatgatgggaataatgcagcagaggagagaccggggatcagggagagaatggaggcacccggagggcaaagccccctaaggagtgtggttcccaaacttgtccccatgttagaatcacctggtgtggggtctttagaaaaattctacagcccaggccacaccccagagcaagtaaaccaactctctagaggaggggcacagactgcagtcagtttgaaactccccagggaactctgatatgcagactagtttgggaatctccttggtagaaccttgctcctcaaattgtggcactcaagcaggcagcattgcatcacctgcagcttattagaaatacagacctccagagtcagaattttcattttaacaagatccccaggaaatctgcgtgcacattaatgtctgagaggccctgcgccaggaggcaagaggagatgaatccaggcagtgggaactcgataaatgttgatttatgaatgaatgcagcgatgaatggttcatccagagtacaggtggagggatggagaccacagcaggaagcacagcctgtcctttgagacaagagacagagaaggatgctgcagaagcagtgaagttaatgggttggtttgttttgggaagttgatgtcatctatttcatctgtaaaacagaaggtgtcatctgctgccagcgaaagaggggggtggactaggggctgggaagagtggaggtttaatgaagatcgagggagaacgctagctaggagaggcagcagggccagtgggcagactgcaggccttgctgagactgacgaccacggtgtattattagtagcaccagctggcattcccagttctgttcagcagcctgtgtgcacaggaggacagggtgcaaagtcagattcatccaaggttgaacctggatgaactgtggggatggtgttgctagatggagaacagcacagaaggtctgaggacaagaccttttgagctcagtttttaaaagagtagaatccaagctagagagggaaggcagtgagggggatgtggttgatatggccaacagattggaagttctgatgaggactgaaaatgaatgccttggaggtttggagtgagagaacctgaggggcagcatggatttatggtttcagagatgcaaatcattttggtgggttctgatttaatcctcccactcagtgatgggatcaacctatgaatttaggctgcaaaaaacccatctgctcaacagccttcgtatgatgagtgggtgatgttagtatgacaaaaagccattggttgcccccaaagaaacataaatgatagcattagtgaagttgctatttttctctaatcagccctgggttggggaatacaaggtcattccaagttttgaaatcagacaggtgtggtttgagccaccatcccccctctgccatggtgtcatctagggcaagaagcttaacctgtagaagcctcagtctcctcatctgtaaaccaggagtcattacgcccattcctcagagttgggaggattaatgagatgccttatgtaatggtatctagcttttatttatttatttatttttaattaattaactaatttttttgagatggggtctcgctctgtcacccaggctggagtgcagtggcgtgatctcggctcactgcaacctccgcctcccaggttcaagcgattctcctgcctcagcctcccgaatagctgggactacaggtgcccgccaccatgcccagctaatttttgtatttttagtagagttggggtttcaccatattggccaggcgggtctcagactcctgaccttgtgattcacccacctcggcctcccaaagtgctgggattacaggtgtgagccaccacgccaagcctggtatctagcttttaataaacattcctttctctgtcctctcctcccatgaaacttgagcactgctgtagaggacacatctatacacatgctgttcctccaaggaaggagagagcttaggcttggatgacctagaacttggagggaagaagtcccacctagaaggactaaggctgtctagtcctgcctccttcctgtctgcaaaaagcaggaaatattggtccactgcacaaggcacagctcagctcccctagagctggcagtccaggttgccaggcagtcattccacaagagctgcctaaagccctgcacatccagagctgggcaggagctctgaggaataggaaagaagccacagccttgggccctgcgggagctgagggtagctaagctgactggcctatcggcacccatttgcatcggtcctaggagctgggctcttttgcagtctctgccctcctcaacctgaagggacacttacttcccgaagggcctctccagggcgaatggccgggcagcgtaatagtattgcttgtattcatccatccacacttcagctgtccgcttggtgttcctgggaaaacaaggagtgacaaggggtgtcagtaaggggctgtctgagaggccctgtgagtgccagttaaaatacacatgtgtgggctgagttggcaacaccacctaggtgggggccaccatggtcaaccgactatcattcctgttcccagggcactgagcccagccaagccccacccaatctccaaaggggtctttaccccaagacacaagattttagtacaggttgagtatcctttacaagaaatgcttggaatcagaagtgttttggatttggggttttttaaatttggaatatttgcatatacataatgagatatcttggggatgggactcacatctaatctaaacatgaaattcattcatgtttcacatacaccttacacacatagcctgaaggtaatgatatttttcccttggggatgctgaataaactgtgggttgtctacctgcattttgactgcaacccgtcacatgaggtcaggtgtggaatttgccacctgtggcatcatgtgggtgctcagaaagtttcagattttggagcattttggattttagatttttggattagggatgctcacctttagtaacaacaaacctttcccccaaaagatacagaccaggaaaatcatgccagaaactgaacttctgtggctatcaaagaaatagggagaaaaggctcaggaaccctactggcatcccttcactgccagtaaccaagagtgcaaaggcagggcctgcatgggcatctagcttctggctgtcctcgggctcttgctcctgggttctatcctttaccacagtggaagtactcaggtcccagctctccaaggggaaagtgggcacacacaggtcttcccataggccatgcagttagcctgctgcaggtgtaaagaactaagtaatcaggcttctctttccagactttttgctagcactctagtttttaaaatcaggttatctgccctgactctgaccccacgaatcacagaaaaggagacagacagagagacagacactaaggatccctcagccatcaggcgtaccagaaagagccccagaaaagagagaaaagatgtcagaaaagagtcaggtggctggtggcctgggcagcagtggtatctgctgaggccaagtaagggaacttggggcctaactgaaaagggggtgctctttcagatgctagctctgctttagagcagaagcattcaagagaggagcgtggcaagcccttctaagctaggacctgcaatgacagtttatgcacacacagcctggttggtggggcactggaggcagttaacagtgcctccctggccccttccactgacctagccattagcacattggaagctgtttagcagacatctgtgccacaatcttctagaaacggaatgacctaccagtgtcatgcaggatgcccactggccagggcccagtctcaaagacaatgactgtctggagccccaggctctgcccctcatttccaggccggcccccctccaggcggccacatggctcctgcagagccaccacttccctgtgccagacatccccagctcacctttactttttaaaacctgagagctgaggcagccctgcctttgctccccactgcttcctggcctgctgattttcttatcaccctacccttgcccttcacgtttttgtaaaaggtgtggccaattttcccattgctcaaacccatgtctcctcaggacagctgtgttggggtggctgtgtcaggatgtgatgacacagctccccctaccccaatggaccaaatgacagaaaaaaaggaagaggagaccaagtggaggagaagctatcagatgacaagagatagagggtgggggaaagagagagaatcaagaggaaaagatggaaagaggaatattcacgaattattctgaaaggagaagagaaagatcgaaagaggagaaatggaggaaaaaagagtggatgaagggaggaagcagggaacaggcaagtgggcacccttgggtctctgagtcccagtaagaaccaccccccagacaggaggagagcacaccagcagacaggagcccagggtctcaggccctgccccagcctggaccctttgactctgctggccaggccctggagcagggacctaagctgcatcccttgggcctccccattccctgcatctgcccaaagacctctcccctagtgacccagcccgaaggtggggcagtggctcttctagaactccaaagtaaaaagggctgcccttcccccatctcacaaaaccccaaatatctggagcccatgccctgcaggagggcattgatgggtgacttgaagcccacgaggcctcatgtggggccttccgaagcctcagaagcattagggaagcctcaggccctaacactggatgtgacaggcctgccttccctatccaagcagagtctgggtagtacgaggtgcagccccggccagttcaaatcacacaggcagcctaacagagcaccagggacggctgcaacccttaccagcagccgcccagccttggctgcctgtgctgctgcccacccgcgctgagcccctgggcacttactttatatacgtgttggcatttccatcagggaaaacgtaggggtgcttcttccggaagacgtgccccactcggctgcaggggacgatctctaggctgcccccgcacatccacactcggaaggagatttctgcaagacagtcacgcccctcctatgacctcttatcactgctgctgcagctttgaggccccaggtctaatgaaacggtgaggcccccgcagaggcgaaagaacagactctgcagccagtctgtaggctccactggctgagagacctcagtttccccatccataaatgggaatagtcctaccactttggagggtggtataagtgagcagggaaacagtgcaaaccaacacgctggcctctggagcatattcaggggccagcatggcggggcaggggctctgctgcaacttcttagcctggaaaggaggagccttgggggcactaagagagttgccttctaacttgcggaagaattcattgtggaagtctggttagatgcactccctgtgatcccagagggttagagtcaggaccaaggagaaagaaatttcaatcgagaatacgggagaattttctaacaatcagggacaaggtgaccattgtgagaagactcaggacaggctagaaaacttcacggcaaggatgcaacaaaggggactgagtccccagaaggcctcagggcaaggtgtccacaaaagttccttccacagtgaatgcaattctaccactggggaagagccacctgaatcataacccaggaggagaaagtctgtgcagttaactagagctgaaagcagttctagaaaatgctggaagcctcaaagctgttgttgctggtgtcccctaggtttgtacacacacccatttcttcctggttggctgctgctatgggccctcagagaggtgggtgggatggagttagcagaggcggctgtggtgagtgtatttctccccgggactgtaccccagcaggcttgaagtagtgcttctgccctgagaaggaagtggtggcataccaagtggggagggagggaattttaccactgccattggttaaaattgccagtgcatggtgacattcaaaagcagaatgactgtgagtgttatcattgctcttaaattttctacagataatgtaccccctaactgaccacagcgagggcaggctgcttcctgcatcccactgggcctgtcactggtagaaaaggcagctcctcatgtgtaggtattctggtctggctgatgcttctgaagtcgagcccaagcatgtggctgcccatgtgaggagccatggggaagcaggctgggtgttcaggggaagggaacaaggatacaggtattacagggccttcgtatcacatgtgtgtcctgcaccctgctctcattcccctgtccccagccacctttacctgtcacctacctgtctcctcccacgtttccttggaaaggcccctggactgaggtaagacttctttcacactagccctactccaccaccttctctgcacctgcccctctgcctactgctgttcactcccaggaagcctggattcccctcagggtggggaccatgtagactcaaggaggaagagagcacttctcatgactgctactgaatcatggcaataacatgggggaaaggaaacaggaagaatttagcttcacagtcagcaggcccaagtccgcagtaaccagctagctgtatccttgggaaacctgcttaagctcgcggaggcctgatttgctcttatgtcaaacaaatgtcataaaaacactccactggaatgccgtcagcatcaaatcaaatagaattttgagaacaactgtgtaaacgctaagtgtgattgaaagatcagcaggagttattatgagacatccctctaaagccaatctctttaaaacatggacatcacccacctgtgcccccttttaatttcttagatgacttacagatgcttcttcccatcttctgccacactgcaggagacacctgaaatgtgtgcacttcacatttgagatttcgactctccataaagtcccactgtacagagggagttggcatttggctggggcactgtttgaatcgtttttcacatgagtcattgagcaaggagtgagctcagccaactgcctggcacccacatccccatcttgcagtagcacatagaggaacctggaggtcggtgcgtggagttgtgtcagcacgtgtgaatttcagtctcatgtctgtgctccaatcaactcctctccagagactcaaaacagggcctgctccagttcccaaaatggaaaaccctccaattcctcaacactagagatggagtccttgctcgctagatataacttacacatcttgtgccagctttcttctaaagatatgtacgggtttcatctacagtctcttcctttccttgtattcaaatgagacatatgtccctttgcaaagcgaatccctccaacctgggcctctaccccatgccccaccaccgttctccactagctgtttcttttcctatgatccctcctcccagctctttatttctctctgaatctactgacccctcccttctgccacagccatgcacaggtccccagctaggccagcaccattgcctggccctgatccttctctaccttccttctggtctccccatgttcttctcctacatcccctcaacgctctgcctctgagcattttcctgacactgctgtcgcctctgctcccagagttcactctatgctgaggactcacctccatcctaccagccccaactctgccccaagctctggcaccaactttccatgattggctgaggtatctattgagatggacgggacattatcacacccaagacatctcctatgccctcagcatcttcctacagcctgctgtagccctgcctcctctaaagacattcttcctccttctaattttcttatgtctgttgccttagtacaaaaattgagtattgcaattctgcaagcattagccatgggaggaaaatgaccccttcatttacttctgggccaggcaggcagtagctgattagtcctaacaaccctgctccattgttattaatgttcttattttgcgatgcagaagcaactctgataggacaactgagagcgagaagctggtggcattcaaaagcagggaagcacatctctccaactccgaaattcatgctcttcccctgacaccaccctgcctccatactgaacatcttccaccagccagtagagctgtggatgcaaagaaaccaacttcaaggcactcacaaactaacaagagtgacaaatacatagttagctgtcacattcctaccctatcaactcactcatccagtcctgaaggatgtccatctcaggtctccttcaggctggctgctgccgcccagaggaacctgcagccgagatgagttaagagtgtctctactctggagttcagattgttatgcctggaattattggaggcacgtgtcttgacatggatcgctgtgctgctgccagagtcaagaggcagtctgagggatgcggcttggagttttcagatcagtgtgatgatttatagggatgacagtgtgggttatttaaaatgtgggatatacaggtgctctacccttatctacatcaccagcttcaaggaaatgatgtgtatcctctcaggattgcaggccaggcctggtggttcgtagatatctgctgagacctttgggacagtcacaggacctgaggtcctgtgaagggggcttggacaagtgctatcagaagtgctgtagattcacgtgtgaggtggtggaccttccaggtacagattagggcctctgatcttcgaggctgcagcacctgcacagtcatcatttctgaagtgagggaggagggaacaaaaaagaattgtgtagagagtttgctgggggttcttgctgagtcagcgcccacataatctccctggtgatgaatgccacttcacggagacccaaatccactttgaattccaggcatgcagatgtgtaattattccatcctcatcggggcactgttataatcttactttctttaaacgtcaggtaaatatttgagagcgaattgccctcccgccctccattccccccactttccttctgtctctccatcagctgatcagtagtgcttaccacccctcccagggtcctagcccttcaccagaaccaacttctacctggcaagcccatggatggtgggcaggaattcaggggagaaggagcagctttctctccaggaagcaaaccacgactattcatatgccactgcttggccatactggtcaaggttctaatttcattttatagcctggtttctaaacaaaggcaaagagaattattacacgtgggtactacattttaaatggagcctcgtataatgtatatgtgtgtgtattgtgtatacaatagcattgtccattctacttttggccaagtttaaacctctgtctgagaaacagacactcacctggctactgtcattcataagtccacacatatttatgtacaatggggaaccttgcctttcagtaatttttaagttcccaacatctactgggctagaaagcaagttctgttattactctttaatgaatgaagggacttgggtagagataatcttattggcccagaaaacatcgccttgaatctgtgagcaaaactgcatttcacccacagctgggacaatcaagtctccatccacacctcttactctagacaagtattgaccacaggcatgccatgatctgcaatgcccatacgactgcaaatgccaggtgacacctttatctttccatattctctatgcaaacagagcaactagtgtctgatgggactcaattacacgtagggaagttgagaagcagcaggaaaggacggcctcagggggtctcccttgggcatggggctttagccagtagctcagacaaggaacaaagtgctggctgcattagctttactctccatctgggggaaaagctgacttgctatcacacttgtatgctcttctcagatgaggtcatgtccctaatcttgagccaccaatcatggaaagggtgaggctgaaagagaaagtcaagcaataaactactccagcaggtcacacataatcctcgtttaacaatccctgctctctgaaagagaaggcagctcaccctggtggagaacaggcactttcattatctaattaatctttgcaacagccctgtgatgtggggcctactaccattttccactgttgcaataacaaatccccacaaacttagtgggtgggtttggcggagccctctgcttagggtctcagactgaaatcaaggtgtcaacaggatggcttctttctgaaggctctgaagatgaatccactttcaagcccattcaggttgtttgcagaactcagttttccttggagttgcaggactgaggttcccttttccacctggctgtcaacttggggcctctctcggctacttccatgtcgccccctccagcagccgtggtcggtacctctcgggcttcacatctctctggtttcatctgctacttctcttctgcctccagcctgagaaagttctctacttttaagggctcaagtgtttaaattgggtccactcagaaaagccaggataatctgctaccttcaggtcactgattaatgacccgaaacgcatctgggaaatccctttgctacctaaggtaacatcctgacaggttccagggattagggtgtggacatctttgggagggctgttctccctactatggggatcagtctccactttaaagacttaggaacaggctcagtgaggtgaagtaactttcccaaggatgcatagcgatgattacaggatttaaactcaggcctatgaatgcttagtgatgattataggatttaaactgaggcttacctgattccacagcccacattcttcccataacacacccacccaccccccaccacacacatacttacacactcaggagagccgagcctggcatagcctggtgtccctgactacattctgggacagcaggtggtggtacttcctctctgggccccaactcacctctctcttctcggcagccttttgtgcctgctgtgctttggaaatcccccattttaaattcaggaatcccatattcacccttcatatatgtgccaagggctcctttttggaaatatgcaccgcttacatacctacacacacacatacaccctacacacacacacacacacacagactttatactagggcaacagattccttttacacacacacacacacacacacacactctctctctctctctctctctctaacagactccttttatctctaaagaccaaaagctaaaagtaggatgcagctcaaagtagacacattacatgtacactgtgttatgtaaattgcagtttaagcatccaattttaatgcaaatcaacttctgaaaaaaaatctaaaagccacatttccctaacatctgctcataggctgaaatgcacatgtaatgatcaaaactattcagctcaccttagaaatactttggaaatggtggcactgaggtcagggcacgtgagtgtatgagacacggctttcacatggccatggcagccaatccatcagtggctgcttctaacccatgaaaaccaagatggggtagggcaagggccatgtgctattgagtaggtcacagacactctggccagagcctgtcccaatcatctcatgcgtctttgtgctgtgaaataaagacaacacaatacatgcaaacatgtctagaacacacagaaattctattacttagaaaggaaagatgtctctaccagctgctattattctcgtatttaaagggaaacccttaaacatgtctctctagggctccatttaatccaatgaaacttattttaaatggagcctcatatatattgcccttcccatcttgaaccccattcccattcagtctctggctttttgaacccacatttagtgagtagtttctaccactgctggctcaagaatgagaagtcaaatgaatgatcttgcctgtaaggagccccaggtttggtagaaggctgggcggcagacacagaagaagaaagagacaaacacatacaagggctcagtgcagtgatgaagagaacctggtgctgaagggtgcagaatgagggagagggtgggccagaggtagggcagggaaagctttctggttctagaggaggtggccccagggctgagtcctgtagagggtcagcttctgcagcagagtaactttggtggaaaagggaagctaggtcctaatagtgggttggactcactctgggaagagtgggaggttctgttggtacctctggacctaaggctgaggcaggagcaggctgatgaggctggagaggcaggcaaggccatgggagggagggatccagctgaggagtgtgagtctccccttaggacaaaagggagccactgagaatgccaggcccggaaggggtggggaggtttgcatttcaaaacaagcactttggcaggggtgtgagagctcagattcgatagtacaatagagatggaggaccactgaggagagtattggagcagatggagagaaggcgacggatgtgagtgatgctgagggcagttgatctgcaggacttggtgacttggtgggtaggaggcccttcctgccacactctggagccaggactcctttcttcaccccttagtgccatctccccttcgcagctggagcatcactcgtacaccccatccaaatccctgatcttcacggggaccctctttcaaattcctccttcacgcactcaggtgccttgttatccccacccgcagatgtgacactgtccacgtgacacagccaccactggaaaagcactgcattttctggcatataaaatgccaaaaaaaaaaaaaaaatccagaaatggctttcaaagtgctgttagctggctataacataatggaatgttggggtgggataaaatgaagtgttccctgtgatagctgttggcagtgctttttttgtggtttaaaaattttgtgatggattgcaaatgtctctcccacacctcccagcaccctctccaacttctctattccaatcagcccttgttgatgccaaaagagtcggaagccagctagatgagattgctacttgatttgagcagatgtgtgttaacattgctataaggaaaggtattgctaccaataccaaaatggaccagactgtgccatccttgaaattcatgctgcctgaatccaaatagaacttccatgtggaagaagaatcactttgtgcagttcaagagggcactacaagccctgacagacagaagatggggtagctaggctttgacttagaagaattctctaatagttcaacaaaaaatatatctacaacagaatatgccaaactgtgaaatagcgaatgcatcattataagaaacatttcagcagagattggatggctgctgtctataagaaatgctgtagagaggattcatctgatggctgagagaaaggctggaacaaatcactaactataagaaatactgaggttgtcaagacataaaaatgggctccaccccataagagagaagtccctaccccactgagaacaccaaaggtccacctgctccaagttctcctgggctggtggaggcagacccagcctcgaaccccacaccaacagccccctatcacattccagaaggccttcatgggctgggtcccagggaagggattcgattttgtgtgggtgttggggtgtttttctgttttgtttgctgggcatccagtctggaccctgtatggcaggagactgacttttctgatgcatttctctacactgcccagtttgggagaacagatgctgtgggtcaggccagaagccataaatttccaggaaataactcttagtgactgagggagaaagccataaaacaccctggaggcagaaacaggagaaaacaatggcagcagacaatgcatggattactgctaaatgctgggatgtgccccatggatcattctcttggcctgagcccctgctcagagagcctgtgtcagacatgtgccacggtacccagagagggaagggtcctgacactttgggaggctcccttttactctactgtgatgtgttcattcaacaaatagttacagagggcctcctacctggcagccactatgctaagcactggagacagccaggagcaaaatggaccccaacccctgccctcgtgcagcttctatcctagtgatctcctaggtctcacctgctggagggaactgacatgtattatgcctgcatggtgccaagattttacacatttacttcaatggcttttaacagccccaagaagtagagctagtatcctgacgttaacacctttaatacacaagggaaatgagtattaagtatcactagctagatggaatgggtctttctgactgtgctgtttctcctgtggctgcaagcctcagctctatcccaccatgaccagatccaaccatctgtttgtacagttttgggtcctataacccagccccattccctcatcccttcctctcccactataagataagggcaaaatatccccagaccctcctcattacccgaaactgagtgctgcaatcaaagaagccaacagactttaatggatgttaatggatgtcactgctgttcctgttcctcattctttctcttcaagctccttccaactgcaaattttcaaatgcatcactccttgctcaagcctgtatctgacccctcagacttggtgctcctccttggtcttcctggctgttgcatctcagctttcccctaacagtctgtcagagcgtgtttccctggttctcaacatccatgcagccgcctcatggagagattcccttattatcaacaccctccaacaactattcctttggcaccctacccgctttcccccaaaagagtaactcaccatctcccaggacctcatccaaagcacgtgtcactctctgacagcttggtgttggatccaaaaccacagaggtccccgccccaatccccagggtgtatagaacagcataggtcaggatgcagaggcagggactcaccaaagttctccccaccccagatgtccatgtccatatcatatttccccaggtaatcaaaccaagctttgtcgatcacgaagagccctccagctatgataggagtcctgtgcatttggaagaaaaagagaggggatcagttctagtggggagatcactctcaaattcttcggccccttgagtctgaaacacccatttcccatttggggaaagaaaaccccattgagggaagaaaactctcattttcttcccatttctgttcctctcgagaagggccagtatattttccagttacctaaaatgagaacaagctccagggtttttcctgtgattgtaaatctcctgaccttgcagacaggcaaattcactcattagcatatctcccatggggacacagggctcactcaggactcctgctattccgatgacccagggagcttccccaagcctcttccacaggctctgcacagcagggctctcttgggagctctgttactgggagaagggacagtgggctaccgaccacgcagaggagaagggctgaggcggcacttggtagcagcacatctgtttcctgaaactgggctctctctccttttttttccctctttatgcctctgttatgggttgaattccttcttaaaaagatatgctggagtcctaactcccagtatcttagaatgtgactgtaattggagactaagtctttccagaggtaatcaagttaaaatgaggtaatgagcccaatatgactggtgtccttataaaaaggggaaatttggactcagagacagacacacagaaggaagagaatgtgaagagacacagggaagacatggccatctaccggccaaggagagaggcctagaacagccctcagaaggaagcaaccctgtggacaccttaatctcggacctctcctccagaactgcgggacgatacatttctgttgtttaagcagccccgtgtgtggtatgctgttacagcagccctagcaaactcacacaccctcatatttttttccttttcttcgtcccagtccccagacttctctggagagatgccagagaaatgcctgaaaaggggctaccaaggaaggcaggaggggagcagattccaagctaataatcagtggctggataggtgggcaagccctcaaagacctggcccccgttcagtggatccagagggtgaagggagttttcttccatatcaaagaagtaattgatggacagctggtcagaagcccaggtctcctgatgctgccacatcctgctgttttctgagaactggcttcatcctgggaaacaagtgccctctgatgagcagagctatcccacaagaagagaacctgtcctgagaatgccacccctgcgacagaggcaggaaaaccccatgggagctgcacagcatcaccttgaccctttgctcttcccacacccacaccatgcactgcccctggtgaggagctgatgtgagctgtgtgatgctcagcataataagaagctcctcctccctctccctttagaaatgaaggactttgtcctgggtaccaactggctccaattttcctcttggtatctctccaaatagagaagcctggaggagcaaggaggggccatcaggtagatgagaccaaggtcctaccccacagtagagttctcagagtccccacccccatttggaaggtcaccattcacattcccattcttagctcttgctagtccctttatcctcaatttgacttcagccaactcaacaaaaatgattaaatacttactatgtggcaacaccagagacacagagatgcctttggctagtcctgggcatccctaatctggactgagaaatccagtggcctctgtatctatccatacacttcttatcctcctgctgccctgcctgaggcaggcttgttttagcttaagtattcccaagaggcccgggactggtttactgtccagtaggtaggacaccaagaccatcactcttgaagctgagaccacaggctcctctgtgtggtgaccactatgctctactctaccccaagccctcagttggtccccaggccccatgcaaagccctagccacaatatgctgtgggtcacagtggggcctgggagagaatgtgggtcagtacaaagccacccacagcctggcaaagagccagagttcatgccactgtcatcttcctgcagagaacagggcagctgtgcttatgaatatgtcacagtgaccttcatattggcctccacttacagcagtggctgactcaacatctctgggctgaatcctgatgtccaagaccctgggactttgctcctggccctaagggaccatctttcccctcactagaggccgaatgggaccactcaaccaacgttgggctccgacattagcaggaggcacaaggacatcatggcatgtgtgagggtgggcagcacacctcagcacaggcctctgctggcccccatccccttagcaagaagtccccaagaggatagaaacctcctaaaataaaggcaaaagtggagatggcctggcaaagggctccctttgtctgcttgatgctttgacatctgatattgagcacctccctacacttgacaggatccagtggtgatggtctgcccacccctgcacagactcttcccacttacctgatgggctccgtggggtccaggcgccgagccttctgctctggggagagctgctcccactggaagtggaggctccagtcaaaccctacaacacagcaccaacccacctgctttggtctctcaaaagcacttgctcattctgcaccctctccagaaggtcatgaatgtacccaggtcctggagaggtaggtctcaaagaggccggtccctgggattgcaggtttccctaggctgatcagcagcatggctgccaaagcgccgttcacagcttcctgttcttcctctacccactaccacctctctgagccttctctgctgtgtagggttagaaataaagggcagaggataaaaagcctaggggtaggggccgaggatgacaggatggacagtcatggaatgtgggccttggcactgagtctcaggaaggtgtgagcaggaggtttgtgagaggctcttaaactacctgagtcacctaaaagtcattcttgaagtgggggcaacagtgggccctatgtggagagctggggtgggtctccccaaacatgctcccttctctaaggtccctactcctgttaacagaataatcacgtctctaggagagggtggtgcccactgctggcatcagaacaatgcaggccacatgtagctgggaaatccttgctcccatcacatttttggacattaaatggggtgagccctatcttagagctggagctctgggtgctgggagcatcctgcccaccccctagcccttccatccacagtcctggtggtaagggccaagctaaggtaattatagtgcaggttgcaggctgagctttctcgacaagcaactaagagcttttccttcactctccccacttaaaagcagtgactgagaggaaaagaaaatccttactggggaggaggtgttagcccaactcaccccctctgagctccgaggcagactcgatgtaggtgaaggtgtccaggttaatgatatcgatcacagggcacaccacccgcgtgtagtcctgtaagacaacagacccgcacttagcttatggagaggagcccagctgggagtcagggagcttgggatggcctcgtgagggtagggccagagatgagttttgtggccttcatagagccctttcatctctggatcttaatttttccatctataaaagggggtactgggcaatgggacctctccagttctgatgcctaaaatgctaagaggttttccttgactgctgggacctccctgccgcagtggccatctaagaaaggtggacatgatggaggctggctggagagtattgcacacccagaaaggggcaatcgagaagaaggggctccagaaggccttcaccacgagtggggctctaggaggcagaggacatagttagctggtgatacggtttggatctgtgtccccaatcaaatctcatgtcaaattgcagtccccagtgttggaggtggggcctggtgggaggtgactggatcataagggtggatttctcatgaatggcttaacactatccccttggtgctgttctggtgatagcgagtatgttcttcttgtgagatctggttgtttaaaagtgtgtggcacctccccactcatttgctctgttgctcctgctctggccatgtgaccagcctgctcccccttcaccttctgccatgattgtaagtttcctgaggtctcccccgaagctgaacagatgccagcatcatgcttcctatacagcctgtggaaccgtaagccaatgaaacctcatttcttctataaattacccagtctctggtatttctttatagcaatgttagaatggactgatacagctgggaaggtgaccccaagactgcagccccaagaagcaaaaccgtacacccatggtgcttcattctatgcctgtggttcatggataagttgatgaatagcatctcccagagtcctaactttaattgtcccctgcagatgaatagtcacaaatttgtaccaggccccgacttccctgttagcttccagacccagatataatatgccattggccacctccatgtgaatttcactcacctttcaaaggttgacttcactgtcttctccccaaacatgctcccttccttaagttccctatttctgttaacagaatcatcacctgtcttccctccccgcagcactaaatgaagaagcttcacccagcccatcaaccagaccaaatcctgctggttctaactccaaaactgctctttgagttcagcctgcctcttctccatcccctcaagcctggagtactacaatggactcctaaacccgaccccactctatctcctgctcttctccttttattctacatatggctgccaaagttgtctttctgatttgcaaatctgactctgccactcagctgctaaaaactttaactgcctctaagacaaagtacaaactccttagcatagcatcccagaccatcaagaacaggcctatctctagctttccagcctcattacttgctacgtccctcaggccaccccatctacggcatcaaaatcatgcaggaaacattttcaaaatatgcaagcctaagtcaccagcttcttggagccatcgagccactgtacatatatttttcaaatttctcatttctgggtgagtagccctgtacctgatgtgcagtgaggaaaactccccacattgcccagagaggtgtcaaagagctgtgaacaccgaaacttttggacagctaaatgggaatcaggcagcccatcaaaaccagcaggtccctgggaaccaggcaggactgcttttccaatcctctgcaccaaccaccctttggccagcacaggcaggaacctctgtttctccttgaagccatttaatttcctggttcattctttcccccaaatgaggttgtcttcttattttaaactctagattcactgagtgcctgattttaagttcacagacttaatttggccctcagcctcccacatgtgactcattctgacagtaacaaggtgcctctgaaaaccaattggcccacatggaaagaaatgctcattttcaatgcattacttctacctctgggatgtcacagatggttcattcatagtcagcactgcacctgcccagctgccacagttcctctggggctcttgggccactgtcattgtgtgtctgtggatatgtcaacaggatacatggatacatatggatacatactgcaggcacacaaacaccaccatccacacaaatacctggacgtgcacacacaaatacacacacaattgttccttgaattctgaaatgacctcagaagttcagagatatcttctgtatgtctgacaaagtcttggttttgcctttgctttgagctttggggcctctgcagctgtactaggtccttctgtgactcttatgcaataaaggattaaccatgcccaaagatatgtttggcccttgcccagctcctgggaggtaacctctaaccccttggaatgtcctgcctagaagactgtctttgtttacctggggctgtgggctacaccagataatctatgctaacaatgtggtttatggagaagaccttgggccgtgtggtaccaactcaacttgacctctgaaaaggcatggagaccatgagggtagttagccatgtctatttactgacacccaataaaaaccctggatatcgaggcttgcggggagctttaccctttggcaatactctgtgatgttgcctcacaaccttgctaggaaaagtaagtggtatctgtacaacctactgggaaaggacaactggaagcttgtgcctggactcttcctgtgcacctttacccattgctggttttaatttgtatcctttcactgtagttaagccataaccatgattctaacagttttgctgagttctcagtccttgtagcaagttattaaacctgagggtagtcttggggacccccagactgcaatcctgttttgctttgactttaaaaaaaatctttccccagtatttaaaacctgcaatggaaaataaaatgctggttgcttactttggtcacagacttccccagaagccatgcatgggctctgtctccagggctgcaacaggctctggtgcactcctcctgtaagctctgaggggttctgtccttctattattcctgtcatagctcacttgtggtatctgcttggctgagagtcttggaggccagataggtagtgagggatatttgggtctaagtatgtataaagctatgaccttgaatgggcctgcaagaggctttataatgagtcaccaaagtcaggacacgacctctctgagtgccctgggaggtcagtacctgctccgcttttgtattcctcagctctggcccaaagcctggtgggcagcaggtgttcaatctgtgctggctaaaagagggcatctattagctccctctaaggacattgtgtcagtgctgctagcaagcaggtgggtcaattacagctgaataagatggcttctcctcctgtaggctaggggatggagggactctcaattaaagcaccgaggcacactgagttctctgtgtgcatgccccagcaggatgtatctttaaagcaaggtccatgcttaggctcaagcaggcagctggtggaacccttgcagatcctggaccacactccctcctctcccctcctccaagcaaatccaagtccctactctccacccaactcctacccaaccctcaccaggagcaactacaagaggctgaatgcatcagcccgtggccatctaccacccctgccatcaggcctctcatttctccgctgagtcatgtaattaaaaccacattgtgaatgggcaatcaaaaagctcctagagatgtccactcttgtgatcaaccagcactcctgagcacctactatgatttaggaatcgtggcaggtacaaggatgagtaagacctcacagtctagagaaggcgaggacaggtgagtagatggttctgatgtgggtatagatacacagcctaggggcctctaagctggcctgaagggaggggtggggaacacagggaggaatcctcaaggaggtgacattgtggggaaagacaaggacagctgggttgacaggacacctgggttcccattctgattctgccatctagaatatgtgtgacctgaactaaatcagccagctctggggactcggtttttcatctataaaagaaagacaaattattatttgcaaaactatcctgcctctctaactgggcttttgtgaggaaacaagagagaaaggcatgtgataagactttgaagaatatgtaagctatgatttatataaatttaccaaatgctttgcagagattggagtttcttaaaatcttttttttcccactaaagaactacgtggataaggagactgaaaaaaaaataagcttatgtttaaaaaaaaaccccaacttggtacttgtttcaagtatcatcatgtaattgaaaggaaaagaaggaaaattggggaggttttcaatgtggaaaacaccagctgaggacagcggatgacagctgaagcccagtctctttcttatctctttctatttttgaaaatcccaaactccaattacagcttaaaatttccacttccactcacaggatcaaatcatgtcctactctgagacaagacacatacaaagacaccaggaaacacaggctgactcacgccctcaccccctgtccccaaagggctggcccagaggaactgttccaggtcattaaaggagtcagagtcttagcaaaaacctctgcagccctcaaggccactgcagacctgggagggtgagagctggaccatggctcctgggtttgtctctttgctaacctctttgctacaaaagctttagctcaggtggggcaaggacccaggagcttagcttaggaagagaaggagcgtcggcagcaggcagacattgctcacattcggaaacgaagagatgaaggctttgcccgaccagcaggtaaggctggccatggatgtagaaaggagagcacttttcagagagggtttctgagatgaacttgggaccactgggatggaaagggcttcagaggttcattaagtgcccaaagaaagcaaggctcccttaacacattctgcagggacaaaatcagcctgggggtccctgcaggttaagcatcaatttaccatatgagccagcagcaattcacatatacacccccaaataattgaaaacagagactcaaacaaaaacttgtacacaaatatttataactgcgctattcacaaaagtaaaaaggtggaaacaacccaggtgttcatcaatggttggatggataaacaaaatgtggtatacacatgccatggaatagtattagccatgaaaatgaatgccaatacatgcattcatacttgaaacagtatgccaatatccatacaacatggataaagcccaaagatatgctaagtgaaaggaaccagtatcaaaaggccacatgttgtgtgattccgtttatatgaaatgtccacaactggcaaatccactgagacagagagcggattagcagtggccaggggcagggagaagaggagaatgaggagtgagtgattgcccatgggtatgaggtttccttttggggtaataaaaacttttccttttggggtgatgaaaacttttaaaattaagcagtggtgattacacaaccttgtgaatatactaaaatcattcaattgcccactttcaaaggttaaaatggtaactttcattatatgtattttacaacacaacacacaaaacacgcacacacatgcacgcacacgtgcacacatacacacatgcacactcatatgaaatcagtttgggggcagtggccatggggactgagtccactgctgtgacggctgcacccatagaggcctgggcacagctctgggcagagagctcctgggttcaggtctgagtctttaccatgacctcacctagcagcccccaatatccaaagagacctggggccccaggaacttcagttccagggtgcatggtcagcaaactgagagggtaaggggtctggtcagaggcagaggtcctgaggggtgaacagcctgaggaggggacagaagtgccaagtgtgcactgcaccgtgccctggacctcagcccctcatttctttctgagatgaacttcttgactgcaagcgtacactacaacgcatctgccattctctcggcaaggagcaaactgccttagaaaagttgctcagaaaatgcttatgtataacattaagggaaaaaagcagaatacaaaaatcatataaatacagtattatagtaactatttaaaaaagacactttctgcaaaggaaaaagatactgaatggaaagaaaggttaacagtggatgtctttgcatgatagaattttggttgattctataaatcatgctgctataaagacacatgcacacgtatgtttattgcggcattattcacaatagcaaagacgtggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataagtgggaattgaacaatgagatcacatggacacaggaaggggaatatcacactctggggactgtggtggggtggggggaggggggagggatagcatcgggagatatacctaatgctagatgacgagttagtgggtgcagcgcaccagcatggcacatgtatacatatgtaactaacctgcacattgtgcacatgtaccctaaaacttaaagcataataaaaaaaaaaaaaaagaattttggttgattcattttcattctaccagtccatattttccaaaatgtctgcaatgaccatgggttactgttgtaatggaagataaggtaagtcgcagcctactccatcccctgccaaggggttttccactatactgcagtccctgagtttgaaatccactttaaaaatatgacctgagtttaagtaaggaacaccttgtctcttctgtataaaatcccctgtaaacagagacactatctccaactcccaccagtttcttccccagctaagtactcctagactcagttctgattctgcaaccttaacctttagtttttgtttaacatactccggtttccttttaactccaggcatgaatggcagcaggacgacatagctggccctagggtagtgtcaacaactcacaggcagaaagacatttttggggaggtaaaggttcctgctgcggagtagagttcctctacttctataaccaggaggtgctcaaatgttttccatatttcttcctcacaaataatttccttcctttttttttttttttttttttgagagagagtcttgctctgtcgcccaggctggagtgcagtggcacaatctcgattcactgcaaccactgcctccctggttcaagcgattctcctgcctcagcctcccgagtagctgggactacaggtgcgtgccaccacactcagctaattttttatatttttagtagagacagggtttcgccatgttggccaggatggtctcaatctcctgacctcgagatccatccaccttggcctcccaaagtgctgggattataggcatgcgccaccgcacccagccaaatttccttctttctagagtttttgtgttgcttctacttgctgtcacttatactgtgcttccctttactggaggtcatttgtgaagcagtgtggcaccagtgcacaaagaacccagcggaccttactaagcagggtatggataccttttacacagcccattccaacccttgggacactgcccaaaataggtgctcaggaaacgtctgttgattcatttaccggtaggaagcaagcttgattttctcctcttccaaccataacacctccccatggcatccggttttttattatcatttctgaacactgagcacctactctatgacaggcagggtggccacaaggagtcattggtgcccccactggatttgtaagctattaggggaggcagaggactaacccagaagaggaaatggtgggccaagggagcaatgactgccagtagtgatcctagctggccacgcagtcaggaaaggctgcctagaggaggggagccgtggacgaggccccacagagcaagcgggtttgtggagaggaggggaagggcatccagggacaggaagggcttggtcagagctggagcagtgggaatgtcatggcatgtccagggacaaggggctgcagaagagagcatggagggaggcgtgcatttggaagggacttcagtgccaggagaggcccttcaacatttcccaatccagacctctttgcctagaagatatcaaaaaagagtaggagaggagatttttcttcttcctcttttttgtttttgagacagaatttcactcttgttgcctcagctggagtgcaatggtgcgatctcagctctctgcaacctctgcctcctgggttcaagcgattctagagaggagatttttctaaacaacactaagtggaagacgagccatcccaatctcagagaaaatggttactgatgggccttaacctctaggcccatgtgacagaactttgtaaacccactgaggttatctcattggaatgaacaatgttgggaaggatttccttgttttcttctgagcagacgacatagcttgattctttagtcctcttaacaatgtcattatgcaggtaggagtttaggagctaccatgaagagtgagcaggaaataaccacagcacagggaagatgctgttgaggtaacgccagcgttctggtgctggtggtaccaagtagaaaacatcagacctagtgatataattgccctgactgtttcctctttagtgaagtgggtatattaaaaatacctgacctcctacttcacagaatggctataggagtcaataactcaggaagaggaacacagtacgaatgctagtcattgaattgatactgccatctgcaattgccacacattctgtagatcagtagggaagtggatagacttcagggaatataaaataataagaaaaattaaatttcctttcactttttggggagtaattgagacactggaggaatgaagcatccagaattgtagagtaatttaagggcaaagaggggcaaggaattcaggtctcttagcatctagcctgcctgcttggtgtagcctttgggtgagggtagaagtaagacagaggccccaggaattaggggatgaagcctggttaagtttgctgcctcctttctacaaaagacacccataagggttcccattctggaaccttctgctctccggtagaaccggttctgggcagttcattcctgcccaggaaactgcatatgttatatcccagctgtcccaagtgcaggcctgctatgggtgacagtcccagtcacaacacatcccggtccttgctccaccactgactgccatgtgacctcacacaggctgctctaccttagttccttcatcaataaaatcgggactgcgatctgttctgcccacctcccagaagaactgggggttgcacatgtgaagtaatgagcttgagagagagcctggagaaagctggggcacgaggcccggccctgctcctcagcctcactcacctctttgaccctgtgcaacagaggctggagccagtccctgttcacctcacagtggctgtcgaggaaagtcagagtggtgccctgggcgatgtcagcgccccgaatccgggaccggaccagacctgcagtcaggaacaaatgacgaagtgggtgccactgtcactccattgtccagcgagaccagggagaagccacccagcattccccactgatcaccccaacacacacacaccatcacaccttcgaccccccgacactcacactggaggctcccgcacaacagctcagacctaccttgccgttcattattgcgcaagcatttcaccttgggcaacttgatgagctgtttacagtcatcagctgcaaagacaaaaggttaagccaattgagcgcccagggatggacctacgtgttacaattgtgtgcactgcaggtgaacctgaagggtaggtgaggcagccctgtccactgtcccctaactgcagagtgcagtcctgactccagggtgtttccaggctatgagaggctgacagatcactgctgtcatacaaggtggccagtctagggcaaagaggcctcaactgggccactttggaacaggtcagtacacaatggcacctgtatacttgcttgaaaatgttccaggtggaaaatcttggcctagtcacctggggacatttctcttttcttttttgttatttttctctttaaacaatttttaatttaaatttttaatctttaattcttatggacacatagtagatatatatatttatggggcacaggaaatgttttgatccaggcatgcaatgtgtaataatcacatcatggagaatggagtatccatcccctcaagcatttatccttgttattaatacaaacaatctcatttctcttttgtttgtttttgagacggaatctcgctgtcgcccaggttggagttcagtggcgcaatctctgctcactacaacttccacctcctgggttcaagtgattctcctgcctcagcctcccagatagctgggaccacaggcatgcaccacaatgcctggctaatttatgtatttgtagtaaagacaaggtttcaccatgttaaccaggctggtctcgaactcctgacctcagatgatcctcccgcctcagcctcccaaagtgctagaattacaggcatgagcctctgtgcccgttccccatttctcttttcttataggccattcaaagcactggtcaatttagtaggtctggtaaaaactgctggaaggccaagaataaatgagattttagactttcctttcagctcacagacctgcttttggaagggtcccactcagcatgcctcccattacacagagctggttcacttctccaccatacaggaaaccccatcctaagcatttgtccctgttactccctggcttgcctgctgctcctcactcctttggttcaccagctccctggctctgaactccatatcttggctccaccattgtggttttgctttattagtttattgaccttggcctccctgcttggctctgaactttaaagaataacagaaaagacttacacaggcttctgggctaggtactgttctaagcacttcaaatgtgttaacatgtttaatccttatataaaccatatataccatctctgttttataacaaggaaactgacatgcaccaggttgattatttgcccaaggcacatagctagtgagtgatttacaggtctaggatttgaacctaggcagtctggctccagagtccatgttttaaccactgctattctgcttgcaagtgaatccagcagcactctcttctcttgcttcagtgccaggctacccctcagcagggccagtgtctgcccacctccaagctcttcctcactggggaagggagagccgatcctcacgttccagaactcagagtcttgatctcattactctaggcctcatgtacagcccacttctgcatcacccccagaggttctgaggcagcaccaatgggtaggggtttccagccttcgtacagcagaccgcagtgtgggggtggctcccaatgcccagcttccagcctcagaactagtgggggtggactccactctgataggacctggagctgtccacagtggtcattccatttccctcagttcgtcaccaggaagagggtgttctgcttggttatgattgactgcacagaactgtacccaggctcctgggaggacggccttcaggtgaggtgtcggcactaccagtacattacttctgacaatgcttcaactattactgtacatttcaaatttgatgcacagtgtctggtaagacacacatgtttttcttggagagagtggatttgctgtgaatttggatgagactcaggttctttgataggataactggaggacacaaggtaggaaatgagcaagaaaagaatgcggaaaggttggaaggcaaccctcactgtgtcatggccaggtgacaggatgtcccacggggttggggaggtcccaaagacagggcccacctagacctcccaggaaatgataggaagagggccttagctcagactgcagattattgcagagaacccgagaaattgttttttggatataaagcttctctccttctgagcctagccacggacgctcaaagacttccgtacctattacaaacctgggcttttccccattcccagaaaaccagtggactcacctctgcctgttacagagtggctgggaacagacattcgtgtctaaagagcaagtgagcaacatgacttacggtcattgctgaagtcatccactaatatgatttcccggatcagatgcgtaggggtgcggtttaatacactgcaagatggaaacagaaaaaaatcactggaacttctagtggcaaaatatatgtactaacccgagttttaaatagataccattgcatttaaggaatgaaaaatcagagcaccaacgggcttgtccagtcatattgcttatctgtgagccaggaggaatgtaattctgccttcaccatcttagtgaatacctccaccacccgcaaagccacccagacagaagcccaggagttaacctcggcaaccctcctactccctgaaaccccacagcaaatcagtaaagactggctggtttgactggaaaatgtcactcaaatcactttcacttcttatatctctcccctgatttaacctcttctgtctagtttatagcctcaacttgccccagcctctcccaggccatcttgctcgtggtctccagagcgaactttctgacaaggagctttgattgtgtgactctcctcgccaatgcaaataaataaactgacagccccccaggggctcctcactattgacatcccaaatcctcagcacattcctaaggcctttgccatcagaagctggcccacatttccccacctcccatgcccagtgccgctgtctgaagctgtcctgctcattcataactaagagcctctctcctgctgctgccgctgcttgaaatgcccctgtgctgcccacaaggaccagtttgaatgtcacttcctccctaacagctttccaagccactacgtgagaattaattgcttcctcctctgggatctcctagtagtttgtatctgatcctatgacttttctcacttcccagccctgaagtttggttttgtacctcacccgcctgtggtcccctctggagggaaatatcccagggcaagacccttgacccattgctctctttattgccagagtctagcacagagccttggtccataactattccctcgagggatatttactgaacacctactatgtgctcagcactgggcatatgatgattctaccctccagaagcttgtggtatagcagctacttactacaagctgtgtaatctcgggcaagttactttactgctctgtgcagcaaagaatcccatctagaaaacagggataataggagtacttatttcacagtgcagttgagcaaattaaaggagaaagtgtataaaaagcatttaacatgatatttggcactttatgataacaaatggttgcaattttttattatcacttaatttggtgcatcattaatgatttttgaatctaactgactcacttacccctcctgtgctgtggatctctatccaggggcaaggttaactctgtgtcttaggtctgactgagatgactggatcctgcttctcctgaacaccccaaaccacgtgactactcagaaacatggctgggccacaccagctatcacgggattccctgtgatgttggagagggggttcagaatgggtgcaggtggaggcgctgtatgcagccctcctcccaggaggacccttctgagccctgactggagagcactaccccttctatgcaggatgcagactctactggaagagaacttagcctggagctaccatatttatgaagccttgattctcaccatggcaactagtatcagatggagagaggaaccccaacacaaagtcgtgagctcactgtctctgtcttcgggagctcatggtcagggaggggaaagaaggctgcagcctctgccagaggatggtggaatgggactgttcaccatgatcgtcccaaagaaaacacatacaaacaacaaccagccctctaatcagggagggaagcaggagacagcggaaaacctgctggaagaataacccctaatgaggtttgattacggctgtagcttctgcattcaattctgctaaatccctgccagctctttgaaattcaagagttctcttctgcgaacatcaaaaggtaaatcgcgtgcggctctgcactggttgaactgagagatgattagtgaataaaaaatgtccagggtttaaaacagaaaagaaaaaaaaaagaaatagtcagcagtgagtgctaattagaccatttcgtggtaacacctggcttgtttttgcttctctaatcagaacaattggagcgatggcggagtccccttaaacatggcctgcagctgggagggcctgaggtgggcacgtgctctgggtggtcagaggagaaggtcaagtccagtccaagggacctagcctggcctaggtggtcctccagggccctccctcatgcacacccactctcattccctccaccctgggagggaatggttgctcaggtctccctcccttgctctcaccactgcctctacagcaaagcaaatccattcgtccaggcccagcagaggatagctcttctcagcctcacccccactccagctgccttccccacacccttcctttgcctcagcatgggaataaatgctctcctcactctgcctgggattgttctagaacagagtcttctatatgcagctcatctctctgccagagggcaggtacacaggtggcttctacacctgctgcaccctaactattggccctcaaggagcccccagaggccgcagggcagcgtgggcagtgtaggctcagaggccaggtgggctgcaccacccactaactgtgcaatcctgaaccagatagatgttggttcgctcccagccttcatttcctcctgtaattacattttccttgtaaaagcaggcgatattaatacttgacctacttcacaggcttttgtgcctgtgaaataaggaaatgtatttgaaattgctttgtgaactccacggtgctctatgcaggcaggttttatcaaacgctccataaataccagtagaatgaagacccaaggccggctgacagttgagtttagtcattctggagtgagactaacttgggttcaagtactgtttctttgtatccaccattcactagctgggagagcttcagtaagtactgaaccttcagcactataatttcctcagctgtgtgaaaggagctcaccatgcctggcacacagcagctgctctctgaatggtggtattgatattaataatattgaagctaataatagcaatatgcataactttcccaagtgggatcctggagccagcagcatcaccgtcacctagatacttgttagaaatgcaaattcttgggccccactctaggcttactgggttagactttcttttttttttttttgagatggagtttcactgttgttgccaagactggagtgcaatggcacaatctcggctcactacaacctccgcctcccaggttcaagtgattctcctgactcagcctcccaagtagctgggattacaggcgcctgccaccatgcccagctaattttttggtttttttgttttttttagtagagacggggtttcaccatgttagccaggctggtcttgatctcctgacatcaggtgatctgcacaccttggcctcccaaaatgttgggattacagacatgagcccctgtgcccagcctgggttagactttctacagatggggcccaagaaactgtgttttaataagccctccgggagcttctgaagcctgctcaagtttgagagcccctgcattagaactctgctgtctgccagggctggaggctcacaatatacacctgttgtcaccgctcaggctcaccatatgccaggcactgctccaagtcctttccctatctgaaattactttgtcttctccacaatgatgtcaggtagttattattagcagtctctgttttgcagaaaaggaaactgaggcagaaaggctaacttgcttgcttgtgatcacacacctgttaagggcagagccatgaaaatctggccccagagtccaaattcttaaccaccttactctgagaaatggctcccctagatctgggatattataaaaaagcaacagtgagaagactcaacacataaagggatccattgcccatgcctcagagcccccatgggaggggtggcggtgaaggatgccccaaaaggaaggtgacagcgctgggtctcccataaacatgcagactcactgcatcaggagtcaagataaaccactcttcagggcttgttttctctctaagtgagaatgtcccctaattcatcaaggtcatgcttctctacacccaccccatcatctgtgtgcccgattgagcctctacctggctctgagttccccacgtgagcctgtctagtccccagctaactccagagcttagggggccagagggtctgggcaggggggttgcaaagagcctgacaacaaagcctgtccagaattccagaaagttaacaatgaaaggtactttagagaagatccctttattgaagacctctgagacaggacatgtccttcagtcagtcccctctcagtggctagtgattcatttgtgcaacaggatagagagtgaaagggaggtatagaatcttaaggcatggaagtttctagaagtaatctttcctgcctccacccctaacattcatttctgccctgcctgcttttgatataagctcctggttgtctacacatgcctctcaggtctccattttgctgtttgtgtgtgtcatacttgggtctgagctcggggctggctgacatctgaagttcctaggaggcaggaaacaggctctctcagctaagtcgtctggcacgtcatgggtgtcttctgaaaagtacagggctgatgggcgccaagaaccctcccagagtgcagggttccagggcctcagggcagccctccaacaggcaggcagacagaggagccgcgctgtacctccaggaaacccaggaaagctgacgcctgatgcctctgctctcaacaagtgcaccacctgccccacaggctcaggatgaggctccaactggagtgagagaaggaatgtgttctgcaggccacaaagctcaggatacatttaacacggtaatcttattaagtatcattaataccacatagaggtggaggagcggcaggaagaggagaaacatgtcttagagtctgagcacagcagctaaggtaccctcgaggacataaacactgttagggaggcctggggggcctagaagcccccatattacatacactgtaatgcccccaaatgtctgagacattccccagaggaacgtttattgtagaaatgtgatagaattagaaacatgaaagatatttttatcatcattttctacagatgtagttaataacatgccccagggtcacacagctaggaagtggtagggtttggatttgactccaggtcttctgactccaagtgtggtacccttttaagtatcccatagcctcctttctttgatcaagcatttattccatgccaggcactgttctcagtcctttagccgaattaacccttagcaaccctatgcactaagtacgattagtattctcatttccttggttaggatactgagccattgggaggttaagagatggataagataagtccttgccctaaaggagctcactgaaggttacatgctgaaaaaatgcagcaagtactggagtagtgatatgtagagaagggcccagaggaagcccctgatggggtgcatgtgtgtgatggtgtcaggggatggaggcacccagcatcagagagcttcttgcaggatgggcagggagaggccagcctggaaagcgaggggcctctctcaggtgctaacgctgttctcatggaaacatctggcaggcatgcccagtcatgaccggtggagcagccaccatggcggtggggaaggcagaggttgcagttggtctgctccatgaaccccccctggtgccccagcacatcacaacggcagggctgtggtctggcacttcagaaccagccacctccacctccctgtgtgtcctctcagcctggatgccccagacgctcctcccctcaccacaggagacccaggagaattgggcctcctccatccctgttgtccccacacttaaccagccaggcgctttgttatcgttaatctaccccgagactcccggtgacacctgacagtgacttggcacattttcttgtcaagagctattgcctggttgggaaatcaaatttgaatcaggtggctcttggggtgattacagaagccaggatgggcacgtggctggaggaagaagccagcctgacattgccaaggatgtctaaacagcagacagggctgtccccttggatgggtggaagcactgggctaaaaactgtgtgtctgggcaggtccctccctatgtctctaagggatgtggtgactgtatacagtggacattcatcattcatgacaggtggagctgaagatttggtgccttccctcagggtgaccctactgcaggacttacctcccatcacctggaacttcccactgcccacagccatgcggcggcgggagagacaggaaaagtgtagcctgcatgatggaaacaatgagattttgctgtgtttcgtgtgctctctgacccatgtttcatcatatttttttctctgtggcatcggcaccagctgatgtgctgctcagcaggacaggaagggtctaatgagccgcgtttcatggggacatggaggtactgggggttcttgctcagctgcgggacgtggctgtggcattcctggccccgaaggatgctgaacaccaccactgggactagcctctccctactcaggctgacaagaaggaggactctgagatcagagtgcaaggcctggaatcctgcctcactatcactggctaggcgacactggaccttgatttagtatctccaatgtcagtttcctcagctgtgaagtgggcgtggcagtggcctcctcacctctgcagctgaggtgcacagaatatgtgcgcagaggagctggagtgagggcggctgctgtcattgccatctgagaggtagatactgctggtggcctgagggagggagaagaggacagatgacttctggaggggagggcgggcatgggggaaggggggtgaaacagccagagtctttggagaatctgggggaggaaatcctgggtaagccttctgggtgcaggtctatgttctgaggggagttctgctagggactggcactgggacttgggcacatcaaaaacccacgcaggccagaggccatccatagcaggatacacctattagagcaagaacacgacccagaggatgagtggactgaagcccaggggaacggggatggaactgcaggtagatggtcaggaaggcaagccttagtgattgctgcaggccgttctgatttgcatggcccctggcaagtgtgtgggagggcagagaatcagggtgctgggtgctgacccagcctgatgctggggctggggtgtgcactcagcctttcagggcctcagccccttcctcatttgtggaagtcagaacccatgctctagaggcagcctggcagagtggggaggccgagggctctgaggctgcttcttctacttattctctttgaccttctgcacgttacctaacaccacaggcctctgtctttctataaaatgggataatagcctcccttacaggaatgtgaggagtgactgagtggacacatgtgacatatagaatagtgcctggcacgtagttagatgtgtctggtgctcctagtacagcgctgggcacctggggagcagacacactgtcaccaagtgctggcccagagctggccaacagacaagcaaggatgcctcacctgcggatggtcctgagcagcgtggagcgggcctcgttgtggaaggtgatgatgatgctagtgggtggaaggtccgtgcaatacaccagcagtgtgcatctggggaaggaaaggcacagggcaagtgagaccttcagggacaaagcatatctggagggctagaaccgagggcatctgggtgggcatccctatgccagatgcttgatatctagaagggcttccccagctgcagagtactaggtaagaccccacggcttcacctggccctaagaggggctggggagctccaagaatgactaaatctgaattttctaccaccttgggggaacctaggcttggagacgaattgagttgatatactgaaaataagtgtggtatttcttgcatgcctgagccagtgcacagtggctcctggtagctgcatgaacacaaccccaagtcgggctctgcttcccactctctaccctttcagcccatctgcccacaccactggccagtgggtagattccagtcggcagaggcttcactgtgttctgggctaacagcttcaggctaccatgttgtgctgacgcccagcccctgcaacacacacctaaatgtggcatgtaaaagaggcagagccccaaaccctggtataagtgataaaaccccatcttgaaaaggcattcacttccatgtatccaggattatttcctatgacaattacatctggggtaatttcaatttaatacctcgctgcaagtgaaaattgtagcctgcagcttgaaaattactataataatgaaaataaacccgccaagtgaggctggtggcaccaggggctatcactgggtaaatgcttcctcctgtttcttgctatttcgggggatgttcaattattgcggggagctgggggatattaaaagatgaagtaaataacagactttagggagtcaaatatttgcttttttcattatctatttttttcctaggcctggggcttttaatatagggttcagagacccagggatggacttcaagggacacgtgagccctctgaaattgtttgcaaactgtgtgtataaatgtgcatttcttttcccctggaaagatagttcatagttttcactagtctcaagaaagtctgtggcctaaagcatttaagatccttagtcctaggctaatggccctggtgtcatgttggcctctcagataactctgatcagttttttctataggggcataggctgaaggctcatggtgtcggtccagagaacttatttagaaaaagccaggcagctctgatcaggactcaagcatgggctgggcgtgggtcatccaggaggagccaaaagttagggaaggaaggccccaggagcagagatggtggaaaaggtaagtcttgtccttcaagcctgtcctctctgccagaaacaatttctcaccatgtccttttgccccacctcctgaattcacccctcctctcatgcccatggcctctcagacagtccttttttctcaggggagcactgcagcagcttcctgacccatctttctgccttcagtctctgcccctgccagtcatgtcctgtccaccacatagctctgccaaagcttcctctggtttgaatccctccagcagttcctgatgtatgaagtccaaactccctatcacagccttctacacccttcaaaatcagtcttgtatgctgccatgactctccaccattgctcatgctattacctctgcatggagcaacgtcctttctccttcctctacctgaggactcttattcaaccttcaagacccagagcaaatgtcccctctgctgtgaaggtgttccatactcccccaaataggtaaggacctgtcctttgtgttgccatcattctgtacataactcttttctcgcagttctcgtgatgagactctcctcaacttgactgtgagttcctccagggaaggcccatgcccttgtccatctttacatcactagaacagggtttaagtataccagttgtccattgatagagaaagggagaaagtaagtcaggaagtgcgttcctaggtcagctgaagacagcctcttctagctttctaaggtgtgacagccagccgccgatggctgccactgatcttcactaactgggttttatgtccttgtgtagcccctccctcactgaagcagggcagctcatatgacccatagaatatggtagaagtgacggtgtgtgtctcccaaggttaaatcacaaaaacattgcaggctctgccttggccacttggagggaagccagctgccatgctgtggggacactcgagcagccctgtctacggagagatgtccaggtggagaggaactgtggccacctgctgaaggctggcaccaacttgccagccacatgaatgagtcaccttggaagtgggtctgaagctccagtcaagccttcagatgacagtggctacaacagacttccaactgcagttcaatgagactccaagccagaaccacccagccaagatgctctgaattcctgacccacagacactgtgaagataatcgatgattcttgttgttttacaccacaaagtttaatcaggagtgatttgttgtacattagataagcagtagaaaaagggaaggagaatgccttgaaacagctcccagtgagaagagaccttggccttgcttatctttggacacagacctgactcacttaggagcagaggagagggagggcattgctcgtaggtagttgaggtggaaccagggttgagggagacctggagggagtgttagctggcaggtggcaggtctgtgagagcatggaggggcttggagaggcccaggcagaggggaaggagccagcatggtcagccccaagaggaacaagtggatgtcagggaggagggccagcatctgtctctctaacaggaggcaacaagtcacagagctcagcagagcctcctggtctctccataagagacagcagaggaaaaagagcccaagcagagtgactcagcagcctgccaccaccaggaccgggtgtgtccaatggccaggcctgaagctgctcctggctgctgtggtccctgctatggggaaagatgctctgaaatccctcatggggttaggacgaaggcactgccttggggatgcttcctattccacatgctgggaggcagggggaccacacaccccagcttttgtggtacaagttactcaggggcaagttggggagggaggtggtactgagagttatctcctttgagagcttttggggacaggggccatttgtcctgccttggaggactagctgaggaggcaggtatattgaccacagtgacacagatgcatgcacacacgcagttacgcagaggcataactctgcctggagtggcaaagatggcttcgtggaggaggagctgctggatctcatgggggtaaagtagggagggacagacagaaatggggcacagaattccagtcatgggcacagaactagacctacagaccacgtgaggcagttcccagaatcctggcttgggggatcaggataccactgaccagctgtgggtacgtgagccaatcacccacctctccagctttccatctgctcctctgtaacacggaatgggcccaaggctctcctgctaaatgctctcacagcatcagctttcagaagctctgaccatagctaacattcaatacgcatggttaggaatgtcacaaatgccattttgtaactgaggctcagttgtcaatgggcatccgacattactttcccaagcctcagtttcttcatctggaaaatggagataacaattctggaagattttctcccttagactattactatgttaggtgattacatagtgccacgttagatgcttgacaaatagtaactattattatttttagcatcggcccaaatctgcagacgactctgcctgctgggtggaaccagatctcacaggggctggaaaggcatctttgctggggggttctgtcctgtcccacaagcaggtaaggggcattgagaggcaagaggaggagcagagatcaaaggatgcagcgtcaatgtgagtgaaaagaacctgggctctgatgcctgcatttgagtctggacatgtcgagaaccagctgtgtgcccttggacacatcatttaccctctctgagcttcaagactgttccctgtaaaatgaggataaatacacatttttgttgtgaagactgcagatgatgcacgtaagcacgtggtgtttaaagggtgctgaggaaatggaagctagaattgctatcatcacgcccagagagtgggtgagccggcccgcacgccaggttcagctcatcgactagaatcacaagctcatggtttagaaaaggaaaggaccatggagacgacgcagttaaacctcctaaactgggcccaccttactgacacaccaggtgtgtgtcagtaatggcttactgagccattgtcctcctggtctctgagacccccagcctctgtccctgcagagtaaagaacagggctgtaccctatgagctcctccagcacaggcccagggagggcaggtagtggggtgccatcccccacctcacaggctcaaaaagcttcacaggactctcctcctgcccctgctcacagctcaggagcctggactcaccccttgtctcaggtgaccctcacaaccgcccccactccacagatgagctgaactaaggctcagaatctcgctcaaggtggcacacctgctgagtaactggggtgagggaaatccacatcctgtgactcctaatctggtgctcgtccctacagtctccctgtgaactcaccggggttcaaggcacctgccttggagccctacacacgagtcatctgtggtccaaggaccaagggatgagcatggggataggcagcaacaaggttgagagtctgagaaaaaaatccagaaagctggacatggtgaggagagtcggcccagacagtagggtttctgtgggagagatctaaaagatcaatcaaacagtgagatctattaggggcacgagggaatggaaaaccctgccaacactgagctctggcgccagcagacagacgagcaagtacgttgataatttattaaagatgcagtgttttactggaagaagagccagtgagcgggaaagattgggggcggggtgtgggggacaccgaagagtctccatgagccaggaggagactctggtctcagcctcacctcctggggaaacagaatcccgggatctctatacgtgatggccacagcagctcatgaggaaggcatgcttttctaagctgatcgctgacatgctgtttctttctcttccatttttaatgaatgactcagtgaagactctcaattttccccaacttgaactggggctccaagggcttcctgcactgccaggctctggagcattcagtgccacttactgtccgaaaatgcttccaggaaagtgctctgagatgctaaccccagggtctggggaggagtggcccctctttcctctgcacagtcactgcctcctgctcacccccacaacaccccccaccctgcacctgaatatgtgacaacttggcatgtcagaaacatgctcagtgatggttgctgtcagtcatggcagtcatgtcatgatgcgtgcgatgccttttattttaccccacgagctcattacatcctggcagcagcctataacggagagcgtgatgatgatcactgtcacccccatttcatcaatgagcagtcagggctcccagtgcttccgtggcttgtctgccggggccaggacccaggccctcggacacccagatacatgatcttcctcctgcggcatgctgccttcatgggagaaaagacttggtcataaattagaaacattcaggattttattctccagcatgaaaccaggagggagtgatggagaggcatacccactaactctgaagtggagaggagagcgtaattattattactgaaatgtcagtgtcaaagagaagccgctctggcttctctggaattgacaatggctccgaatcttaaaggtgggctctggcatcccagacgggagtctgaagacagttagagaatgggaaaaggtcaggcaactacacagcacaatgaaatggaaatcaaacaggcctggcgtggcgtgggacacactgggactgaaccttcgctgcttggagctcccggtttacagtgatgacggtatccacctcctggaaagctgttaaactactgctcattgaacctttctcagcaggcaccacgcagagcacctcacatatttactgctcacagtaatcctatgaggctgctactggtttacagattcactaatgaggaaactgaggcacagaaaggctgaggaactcactccaactagcaaagggaatttgaaccaggcctgctggactccagcgtcctcgtcacatgttgtaatacctctgaaccaggactgttccaattgtgactcaggtctattctgtggccttgtacactgtgtatactcacatgcccactcttgaatgaccacccgaagaggcggtttctactgagctctggaaaccagcaggtacagcgacctgtccaggagggagggactggctgctgctcctgggtggtaacaggaagatgggaaaccgctggtgggctgccacgggtacatcctaaacaggggcttccactggagtctgatcaggtgggcgaagatgtgacctcagcaaggccctgggtgaggtgattcatgcacatctattactaaacaaaaagctatgttgacctaaatagaaattaggatttccttccaagtcctgcacttccagcacacattgcagaggccagagccacaaagagaaaatgaatgggtcattttcatcatgttccattttccctaatttccagggccagaaaggcaaagagaaacacaaacataaaacataaagtgggaatgggaccaacttcctgggagagagctctctgtccccatggaggtgacaatctatggatcccaggtgcaggtggcgtaggcacatctttccctcctccacatccctccatcactccatcaccagtgctagcacagatggctttgtagacaatgcctcatcccttcctttcctcaccaccagccccaactcagagccaatgtgtgtgaggaagaaagaatgagcggagaaaagctcttggccaatgacctttccagaacgtcagttatctcagcactcagggcagtgatcttgctactggcttttagaatcacagatttcatttttagatctgagaacatctaacacctccacagctcagatctatgtaaggaagcctgctctcagctatgaggaaaaatataaaatgccgaatctgtggctggccccttggttcaaactgaaccctttagaagagaaaaatgcaagcagtatgaaaagtatgacaactataaaatcaaaaattccttttaatctcatttcatgggcaacactgatacactgtaaggaatgaaatttttgcttcatgtcaattttgctgggatttcacatgcagattaattcgttcattcacataaacatatactgctcttattcttgcctcaatagccaccctcactttggttacagaaatcctgtgtctcagaaaagacccttaacataacagtgagattcgctattccattatatcaccacctttgaagtgctgaacatattattaattccagtggtctagaaagggaataagtgggtcagaatagagaagtgaactgcttaggaacttggtcgggtgctctggtgggcagctttcaaagagttcccagtgcctacctcctttaacctctaacactaaccctgatgagcatcttctcttgaatgaccccatgagatgaccttgtcatccaccctctgcttcccacacctcagccaagcctgctgaccctcctgagttccccagctcactatgcactatgtgccaaaaccaagagatattctctaatcctgcctctttctgccccagacccaatgtgattaaatgtagtcttgtgcatttgtcttctttatctctccatctggctgtttctctccacttccattctgtcttttctagattactgcagcaacttcctctctggctgtatcccttttcaatctaccctgcatgctgcagctagaatgatctttccagaactgcgtctttaacctctttcaatgctgctcaactgctcacaaaatcaaactgagactcttaatcatggctcaccatccttagtggcctggcaccacttctgactcctgccctctgcactctcaaagttctagccacattctgcttcacctgctctttgtcccctctggaactttgcaagtgctgtctctctcccatatatctgaaatgcactctcctcgcttccaacgccaggctattttttcctcttctaatcttggcttggaagttacttcccctgggaagcatttcagtctcccaaggcttttccaacgtgcctctttaggaccctgtgttcaccccattgctgtaatttattaccaagcactgtgaaattacttttctgtctcctctaccgactgttgctgcagtgaaggcaaggacttatttgtagttgtaacctcaatacccaggatgatgactaaacatactagacatacgataaatgtctgaagaatgagtggagggataagtgaaggtgggaggcaggtgaggcttacttggggtcaaagctggagaggaaaatgtcctttgccaagctatgggtgacaccctcacagggagctccagagcagtaaaagctgagcaaaggccaaggtcagtgatacagcaaagagagaccaaagaaattgcccaaactgaagaagaatctggaagctgaagtatggagccatgagttggggagggggctggcgataagaagccttgggctaagggtgtcctggggaatatcaggtggcatctggtgtccgtggagaggtcttaagttttgtctgttatgctggaaatactcaactgtgtttaaaaggctgggatgttcttgtttaccaaagttccaagaatgatgaaaaatgtcgatgatgaagcaagaggggaaagactgaagccttcgacagactgaggcccagacaccctcttctcctagacatgcattatgcagtagggcagccatgagccacatgcagttactgagcactgtaaatgtgtctgctctgaatggagatatgctgtaaatgtaaaatatgcccaagatgtcaagcacttagtatgaaacaaaggtgaactattttacttatcttttttaaaattgatcacatgtcaaaatgttagtatctggatacattggagtaaatcaaatctattactaaaattaatttcacttcttttaccttttttaatgtgactactggaaaattttaaataatatgcagctcacatctatttctattggaaatcattgtcctaagttgtccctgaactttaattggtatataatacaaattaaaatttcaatgttactgctggataatggtttctaggtcttggttttctggtatgagtaaaataaaataaaaacattatagagacagtaattaagttcgtgacattttactttgtgagaaagtatgtatttttaaaatcccatcatttaccatcatcatcatttcaaaaagaaagagtatttaaacaccagaaaaggccacaatctcagaataattaacaactctttaaattgtaaaatttagcttgaaattgtaaaatttagaaaatctccctcctgtctcctctcttccccaattccatggatcatacctgcattcatttaccaactggcatctgaaagaactgttcaagggtttgttccactgaattatgacaagcctttgactactctcagcaaaaaacataattactgaacacagaaggccagacatctcccactctttgttctggaaccagcagatccatctcagctctcagtgctgctcaggatagcaagttgacagggtttttcaatctctggccccaatctacctcctcaggcagttctgctgcctgtactgactcgtgcaatctgggctcagaaggaccacatgacttaaagaacgtagactcctctggctgcatttaaagacctcctagaaatggccattactccaatgcaccaggatccttctgtttttctaaacaactaatcttgatcttttacattgcctagccccttccaagtgagtggaacactgaggtttggtggaaaccctgggggaagtggcagcttctgctcttcaggaagatcagcagatctatggaggctgcaaagaggtttctctagggacactggcaggacctgtgttagccggtaccaagcaccacccagacggcagctgtgtgtgcatgtgcgtgtgcgtgtgtgtatgtgtgtgtgtgtgtgtgtgcaaaaaagaatcttctcaaaaggcaaatgcagagcctagctgggacagaaagtgtggagttgggccaagacttatttttgaaatgtttcctaaaaaagataccttggtgtctgggaccagagctccttcatgtcttattttagccctgctcaaatcacatcatacaacagtaataatagatgacacaattgaatcctcactctgtctcaggtattcttcccagagctttcagcctgcacagtaactccccgaggtgggtgctgcaattcctcttctcatggtggtggagagggaaagtcacaatgagtgagtggtggggcctcaacataaacccagatggtctggttcccccctaccagtcggtgccctcacgagctccacgagaatgccctttgaagattatccacactcactgcctctgaaacctttattccatattggcttttctgtctttttttttttttttgagacagggtctcactctgtcacccaggctggagtgtagtggcaccatcttggctcactgcaacctctgcctccggcgttcaagcaattctcatgcctcagcctccagagtagttgggactacaggcatgcgccagtatgcccagccaattttttgtatttttagtagagacagggtttcaccatgttggccaggctggtctcgaactcctgacctcaggtgatccgcccaccaggtcctcccaaagtgctggggttacaggcgtgagccaccatacccagcccttctctctgtcttttatcttgaacgctgcatgctggaagattctggaaagatggaaaatcatgggtgtgggtcatccctcacttgctaaagcatagtatctccccttgatactcctagagctatttcatgatatttttcagactttccacctaaaggatcagagaagcatcattccctcctttcacctgaaaggggaaagttcctccaattgcaacagctataaggagcaaaagtaaggcctgcagccaaggaactccaggaatgtgctagactcagcaccctgagctcaggaatggtctgtttgagggtcaagggtcctatgcctcttccccaggggactcacatccgtgcgccattctggtctgaagcagggagggaaaaagcaaaggcttcccataccttcctgcaccttcgtacagtcaatccacccctgagccaatactgcactcaaatctgcctcttttttatatcaccaagcctgatctacacccctggtttgccctcctgcaacagcttcctaactattcttcccgcctgcagaagagtcacttccaaccactcctcccaccctctccacagccgttctctcttccatcttcctaacacactgctctcactgtaggaccctctcccgaccttcagagccacctgcagttaaaccttcaccagcatctcaaggcctccaccctcgtgttagctcttcagcaccctgcccccacattcccttgcaggagccttctggccctgctaaaccagcccagtcactgcccttgactgtacctgtgtcacaacctccacaaacctccctagattctgttaccttccctcctccagctgcccaaactgtcactgttgtgcagtttcgctgaaatcacttcctccaccacactccacatggccgcctggtatgactattcccctttctaaatcactgtgccatcttcctaggtaactactgccttcttgcaggcaggggccacgtttctacttctttaaattcctgtggacaagttattcaagctaccggagtcaatttcttcatctctaaaacaagggtcatagcaaagttgtgaggctgaaccgagagaacatatatatggtgcctcccacacatcagggggatggtatgatcaatacgtgtttgccaattgtggcgctggatttatgcgtgaacgtggataattctctgttgagcgaggatggttttaaatttcctgtgatttgattttctccctctgttctgaggattcactcgctcaccggcacctgcactcccaatccctgatattttcagtagcttgagaaggaatcacgaggtgcgctttgggcccctattcactcagctgatactgatggacagtgtgagtgccaggcaccgtgctaggctcaggagatgcaaagataagtcagcattcctgtgctagctgctcaggggcttggaagggtgatagacagtaagctgatgtctgcaatgcacagcaaggggtgctgctcagggtaagcatagaggatggaggggctgccaaattgtctgaggggcaagcggtcttcctgaagaagacaccctccacccagactcccaaaacacaaaagggcatcctgaatagagaaagcagcaatgatgaggcctgaatcctcacagcacagtcggcacaggccatggcctgatgggggcggccttgacttcagggttggggtggtgacaggagctgtgtgcccacagcatgtgaagagtttcaggtgaggagtgatccttctgcatttagaaagccagagtcaatgaggagggcagctagggcctgccgcagtcacccagacgagagggggcagcggctgagtttggcagcaagatatctcagggagcaagagatatctcagaggagacaacaaaatgggagtggggggagagcaggatgatgccacagatcagggcttgggtgaaagtctgaagggtggtggcacccggcctgagatgaagcagacgggagcaaagagggtgtttgctaccttgagaggcagggcaggaaggtgtgggacaaggagtacatgatgccaccttatgaggaatcaaggaggagagacagggaggagcagggaagcagaagagactcaaccaccacgccagctctggccaggccacggttatcatgagagtcaggaggggagagcagtttggataatacaataaagtttccatggagatcagggattcctcttgttgcctcagggacagcaaagataagctcaaggacatttactgatcttgcccctcactaggccagtgggaccctcactgctcagtgatccacagagtccccagcggattcctgcttccatcacatcccattgtgcctgcttactttgccagtcacctggggcctcacgtggccctcagcactccatcctgtgtctgccaccctcggctcagaggtctccctcccacagcagcccccacccagctgtcatctcctctcccgctcttttcatctcttgtcaaacacattttgtagttgctggcccccggctctaaatcactccctctgctggccttggcttccatccccagtatctttcaagcacaaatttcaccagatgtggcactgcagtcgcctcctcgctcattttgctttccagtttttaaagtaagtctgacattcaggcaaatggaatgttcagagccaggagccaaggccgaggcccagagctctctaaggacttccctgctcacatgccctgcacccagcccaccttgttctcagctccactgtgactcacatgagccgcagcaccctgactcagagctggagagcagggtgcagagcctggacctctctacattcatccatgtcacccgtttctccacccctggccctgttacctgtctgccctgccttccagacctgctttggcccacagctgcggagcagcaggaaagatgatgaaaccagaactgttgctggtcctgatgccccctcttgcctgggtgactgcagcaggccccagctgccctcctgatgccagtactaacttgactactcagggccacagctagcaaacagtcaccaagtgcttactagaggttaaagatgaggctcggcatttgacatcaattatttcacctcaccctgaggaccattattattcccattttacagatgaagaaatggggtctctgggagtttgagtaactcacccatggtccagctagtaagtgacagagatgttgtatgtcaaagctcacagggctaggagacctagcccagccactcagtcaaccagttacgttgcctgggtctcagcttccttctctgtgaaatggcaatgacctcttcacccaaagggctactgaggacatgagaaagagctgggaaagcacttcgtgaagtcctatagaaatacaaggcatgggccgagcgcggtggctcacgcctgtaatcccagcactttgggaggccaaggcaggtggatcacctgaggtcaggagttcaagaccagcctggccaacatggcaaaaccccgtctctactaagattagctgggcttggtgacaggcatctaaaatccaagctactcaggaggctgaggcaggagaaccgcttgaacctgggggcaccgtggttcgagattaggccacttcactccagcctgggctaaagaaatacaaggcatgaagagtcttactctaagggcttactgcatggttcatcctctcctgtaggaattatcccaggaccttcgtcccagcacagagcctccttgaaatttcctcaagccaatcctaccagccctatttcttcctggcagtagaggcacatgtgttatatcataagagccagtggttctttgaagcacttgggggcaaatggtaatggaacttgacagtgatccaggttttaaagggaagacatctgtgtgtttcagctccttattctagactgaaaaatgtgggcaggtcaccaatgtttgcagtcaaactgccttctacgtgatgtgccaactccaggagcaagcatctctgctgctgctgtgtttaataggtccggggctttcagataagtgagaagacatgtcaaatcagcctacatgtgcacctcaggctaggagaggtctggtgacctgcactgcgtggagggcatgagagggtggagaaggcctgcatgaagaaatggacaaggtggcaataaaaagggctctgatgctctgcagggccctggagtcctgttaggaagggaagtctgcgaggggaaagagtaatccagggcagggggaggggcaccactgccgagcaggagggcttcatgtttctggaaatagcgtccaacttacttagtacctaagccagtttccgcatgcttttaccggcagaagtattttcaaaccagcagacagagctggaactgaccttaataagcatctctggcttacttctctcatgttacgtgggaggaaacagacacccagggagctgaaggcattgttgggcagtatcttagaaagggcatgcactttcgcaggctcaggccagttatttcttccccttactttatcatgctgcctcacaatgttggacaaaatggcaaaaaatatccagaagaaaggcaggttactgaggggggaactgacagccaggccctctgtgcctggttcttgggcaaaaggcatagacagatgcagagagaaggggcaaaacgcttgctcgggtatgcaaacggtcaagaaacttaggaaaatgtgtgccacttcattgcagcagggagaggcaaatttaaaccacaataagacaccaccactcagcctcctggtaggcaaaaatgaaacagacagacaatagcaagtgattgataatgaggacttggtgcaacagggactctgctgtaagtacttcattaaatatttgatgatatctacagaagcttctaggggtacaccctacagaaacacatatgcctgttcaccaaaagacaagtagaagcttaatcatagcagctctcgtcataaaagccaagctggaaaaaccccaaatgagcactgatagtcgagtagatatagaaattgtaatatattcttataaaggaatactacacagcaatgagaataaacaaactgtgtcttgcaaaatgtggctgagtttcatgcacagaactttgagggaagccagatacacatgagtacatactgtgtaatcccatttatataaagttcaaaaccaagcaacatcaatctacagcttttgaagacaaggtagccacggagaattctgatggggcacgggcataagggtggcttctggcaaacacagaatattctttaacttgatgtaggtacttgatgcaggaacataggtgtgttctctttggaaaaattcttcaagatatacctgcaggaggtgtgtacttttccatatgtatcttatatttcaataaaagatttccttgagaaaagatgaagagagtttctggtgttgcggcagattttggttgtgcaagaagatttcaaaagccactgaactgggacatggaaagctcatgaaatagacaaaagctgcagccaaactcaacagtattgtcttctccacccctcctgtgttccccataacactgaggagagcacccccggaatgcagagtgcaaatccagggaatcttcttcacccctcttcctctgtcctttaaagacagataattcagaggcgagagaactgataccacactgcccttggtgttactgaaaccctgagttcacgggccagggcttattttcaaggctagcttaagggaccatgcctcctgtggaaagtgatctgtaaggtggggaggtactaggggcctggggagggtagtaaggtagctcccacttgtccacctgagggatttattcactgggggcattcaagttccatgagggcacactttcagtctgttttttttgttgttgttgttgtttttactgatctatacttaatagtcttagactcaataatttgttgaatgaattattcctggcaaatatttaatccaaatcagttttccatcctgggcattgaaaatgtctctacatctctttccacatctctttcccctgcctcattccccaggtaatgtgaaatgtaggaggcaaacttagggagggagaagggaaatctgtccccagaacaaagaccacttggtacctttcgaagccacacaaggttcttcttgggttacctgcccacaggcatttggcccagatggcagaacaccagatgacactatttattgaattatatggctgaaatgtagtattttagtacctctgggcaaagctaaaatataataatcaaaccatcttaattaggaaacccagaatcctcatctatcacctcttctctttccccaaatcacaagtcaaacacacacacacacacacacacacacacacgtatgcacacacacacacactttctctaactcagtgaactttagacataataagaagttttatgtttgtgacagaataaaataaaatatatggacccacaatctgaaaaattgattttgcatttcagccaagcatggactagctgtgtgaccctggacaagtcccctaacctctctgagcccgggtcccctgacctaggtgtggagttaatctgctagtcttgctgttctgctcaagtctgtgcagcccacactggtgctcagtctggaaacccagcagtgagtctggggatgaaggacagagtccttttccaggccctatcagctccttctcccctaagactagctcctgcttctcactgttcctgcctcacttcagaacgaactccccagtggaagatccaatgtccccaccctgaggatgaaaatgctttcaggccaagttctcatatcaggctctagctcccgggccagcagcctgttcagcctgcactttgtttgggacagttgtccagccttggggcaggggcaccactcctgcctggtactcttttctctgtcacactttggctttcttcctactggccatggtgctggccaggaatgtgttatttagggcatgtcccagtgttgctgtgacaatgaggcagtgacagtgtgaacatggaagcattccagggtttactgaataaactctaatctccttatcctgaattcaagactttgccacaacatgtccccaagttatcttccagagtattctcctccattcctcccctccatcattctacaccctaagtaaattgggcttactcctataaaacactggctcttctatctcctgatatttccttatgctcttccctcaacttgaaatgcctactacctggtaaaatcctacgtgccccactcgccagcacactaactgcagcccacgccatctccttcaagaagcctctgcctcccagccacgtgtaaattccttctccttcacaggccagcctaatgctattttgtctttttcacaggacagctcctaactcctgtgctgtgctgcatggctaagatggaaataactacacccaaaccagggacagggcaggagctgggtgcctgaacactgagggcaggaaattcgtgtattaattccaagagcaagggtatggccttagcgcaatccacatttgagcatcaggaattggtctcatgtccatttctcccactaggccatgagctcctagggcccactaggccatgagtggagactagttcctaacacaggacttggcatatggcaattgctcaataaatgtgtggagtaaaggaatgagcaaatgagtgagtgaatgaatgaatgaatgaatgaaatgtacaatgcaaggtcaacgttagcaggaattcactaggaaacaaggtgcaagaaaataaattagctaaggcagtttagatgaattctcatcagtgttgttgactggtccccttttgaagtctgaggagttaccccttcgggaaatctccctgaaactcaaaaaaacaggcactcaaagaacacaggaggggcctgcaggctcaggattcaaggaaatcaggagatcaagactggggaggaatcctgacccagaggcccttgctaactcctgtgctttgctacgtggccaagacaaaaataactacacagaaaacagacagggcaggagcccctgtggccgttcctcccctcttaccctggcaagatggtactgcaaactgccccgggctgtggacacagttctgctacagagccacttccaggatgtcctgcaactcttcctgctcttcccttcctcccccagaggaggagatgctctggagtgaactcagagatcaaactcagatgctctggagtgaaggcacttaggcccactatcaacaggctcacatcctgtattgaaaagtggcacatgggggaccagaatgtcacagacggggagagcttgtttgcaaaagctaagtatctgtgatgggctccccctcccctcccctcagccttggtgtggaatcactaacgctgtgctgagctagtggaatagccttgactctgagggaatatgaacattttttatgctttgccattccagctgtaaagatttttatcctattactgctaagtgacgagtacaaggagagaaatgatgatgatctttggcagccattccaaccgagtaaatagaaggagggagaaatgctacgagaggctgggccactgccccttcatttcccaggaggaaaaggagccaaggaaaaatgtcttcctggtgggatgtatcaaagtgtagaattttccctacaggcaagtgatgggcgccccactgtctgagccatttagcaccgcactggacaaaggctgggagaatatgtggaagaaaacacacagacccagccaggccaggcagaggtgacccaatgaggcttccccggctagagtttccagcccatggctcacgagctcagtccaccctgaatctgctccctgaaatcaaagcaaccccataataggcgctgctagcaagaacatacatatgctttatcaaaatattccctccctcctggaggggtgtgtctctatttgtggctgcttgtctgccagatgttttatgtaccacttggataatggcaaatccagctgttgtcaccagaatggggtgatgggatggaagtgggatgactcgaaaatgaggactacttgttgaaccggtcaatgctttatgtattgaaatgtaattgtggctaatagttctctattgtattaaaatgtaattgtggttttttccactaaaggtaatggcaaaaaacgcaattacttttgcaccaacctaacatatgaacagcagaactcctctggacaatcatctcagactcaccccagctggaagttgtctcttccttacagtgaattcgttatttaaaacacatcacctacctcccacccccagtacatgtagccccattttattcatctttgtgatctcacaggacttaagcagtgacctggaaatgaagtctctcctctgtgtgagcagaattgttgacctcatgaggggaagttggagctaggatgtccccaggcaagctccatgttttgttcgattgaggtgagtgggggccagtgtatgagtatatatctggaatgaagagaccataaatggaagaatgcattcatctataattgtgtggagacttgaggaatgatgaagcttcgaggttagccagtctaacacctttatttcacagctgacaaacgaggctgagaagagcagggatgtgctgaaagccactcaggggtaccttgttcttgccttgtcacctagcctgagactagggatgaaaggacaaggttgcagcagagacatgcatgtctacaggctgacgacagaggtttccatctcaacagtgaagatcacatcaaatgcatgtaaggggtgaggtgggcatgggaaggttgctaagcccaagcatgaatgagtagggcatgcctgcgaagctgtagaacttaccttttgagccatactggatgtagcatcactcagtgcccactgccaaggaccctggaaatcctaagaaaggctcaaagcctgcccctgtcttagcttcttctactcctgccctctgccatctcacactccacatagactggactgtctctcgtaaaataccgtggacttcacaggcgaagaaccaaaagaaaaatggctactcgcttccattccagatacggaaattaagcccccaggcctctctgggcttcttttatcacatggtgccctgcatggcttgcttgtaaggggtccacaccgccggtgcatctggggattcaatcagcacagctgcctgctgggtgaaacttctacagccttcctcctccctccccctcctccccctcctccccctcctcccccacctgctgcctcccacatcatgcggcatcttcagattcctgagctgctcaccccaacacccgccctcctggcagcacttgctctaatgctcagctaatagttctctgtttcaggcactgtccaaacgcatcctataaatcagaatccaattactgtggtaagaaaattggaagcaaatttaataagctcagacccctcccacatgcggtttcttcacccttcttttttcagtaacgagaactctttaagggaaaagcatttttcctttaactcagagtctattctcctgattccttctacaaggcccctgaggatcgaagggtgaggagaaggggcttcctttagctcctcttttccttgctacacgtaaagcaggtgggagagggtggtcaattgcttttccagggttaccctccctttcatttgttcaacatttattgaattcctatcacacacaaggaaagcactgtaggagatgctcaacatgttactcaccccagagggcaactgatatcagtaggaccttagctgcaaggcatgatgggaacacaaaggaggcccaccaggggcaaagactgtatcaatatgattgggtgtcctcaaggaaccagaagtccagagtgggccaatggcgatggggccaggagtgaccccacagtaggagcttctcggtagaggtgatgccaattgctaggaggatggcaggacatggagcctgtgaatgaagaactgggaaaggagggaggagcaagaaggaaccagagaggccaaagtctccgcagagcccgagacagaagtcatgtcagtggagaaatggagagggctgtagtgtgtgggggaggtggtggccttattgcagggcctctactctcgactcagaccctcagccttttggctgcaccagtcctacctatgaacttcacctgggccacaaaaataagccacaggtacaggctgatgctctgtggtttctaaacttgagccggcatcagaatcacctgtagctcttgccgagacacaatcagttcagatcgctaaactccacccccagagtttctgatccagtagttctgggtgaaacctaagagtttgtgtttctaacaagttcccaagtgaagctgatgctggtggcctgctggtttggggaaccagaatttgagaatagttgttctaagtccctgctattcaaagtgtgatccgtggactagcggcgttggtatgacctgggagcttgttagaaatgtggactcacgggccccatctcagacgtactaaatcagattttaacaagatcctcagaggggttctttgtttgcctatttaagtttaagaagcgcttacctagagcagtggttcttaaccctggctggggagcttagaaaagagatacttcagctggttggagtctggatatcagcattgaaagaaagcaccacaagtgattcttgtaagaagcctggattgagaaatgctatgaccgatgctaaggaccagcaccccacactcatggggatttgacaccactcacttccacttctctggcattgaacctgaccttgaaacccacctctgttctcctctgcccccctcaccatccctgacaacttagtgatcttaatgctctttcctggtacttggggtatagatgtgtgctccgtttgggggtttagttgcatctcttgcctgatcatcttgagttttctcacagaaacctctccttccattcctggcccttcagtatcagcctacccacataccctgtaataatagcaacaactagaatttgaaaaatatttactattaggtaggtaaataccttatatatatatatatatatataaaaatatatatattagtagatatataaaaatatatattagtatatataaaaatatatatattagtatatattaaaatatatatattagtatatataaaaaatatatattagtatatatataaatatatatattagtatatatatatattatttgatctttataaaaactgaattaggtaggatcattattgtgatttttacccctattttccaaaagaggaaactgaggtacagagaagctaggcaactttaagtttactcctagtcagcagcacaaccaggactgtaaacagggcaatctgatcccaggatcagtatccttagcccctgggctattactgccttccattcaactctgcttttaaaaagaaggcttggccttgtcctgttgctggtgatggggttgataaagcatatttacatttcatttttgagaacttaggtaaaaagcagaggtggattcacagcagagatcttcactgcaatttcgcctcaaggggatgtctatggcaaggtggggagacatagctggttgtcacaacttggggaatgtgctactggcatctagtaggtagaagccagggatgctgctgaacaacctacaatgcacaggacaccctgcaacaaagtattatctacccccaaatttcagtagtgctgcagagaatccctggtccccagaacacaggtcaccagcagcattagctgttcagttctgaggcagacagggcccaaaaggccccagggccctgtcagcccagacaggcaagctccaggaattgcatcaggatgaagccgggacacagtggggaggctggaatcacagaaggattaagagacatagctgatgactccaacctagagtcagggtttccctgagaactaagagctggaagtgtgagatgagatcctatagacggaagggcccagttgaaagaagaaaacagggctttgctggcagtctttggagctctcatcaccacaagggtgacaccagtatggtgactaaacttggcttggagattgctgatccagttggtggcccctcacagtgctagcctggggctttgcacatagtaggtgatctatatccctagatggctgctggtcccatgtgcttgccctcattctcaatcacctgacctttccttttcatgcacattcagagtaagttctttaagtgtgaaattctctgagtaacacaatcccagctcccacagggcaaggctcgtgccctgaggcagacatatggctgatacactttccctttttgtcttcccaaagggagtctaaattctgtctaaatcctctcttcccttcttgctgtaatcccagcagatcacactttcttaacagacggaacacactgggctaggtgcaaagcccggaactggacaccgtgagctgggctccttggaaacaggctcagttcttcatcacctaccaccacatatgcctagcccttgcaaaatgttagtttctgcctctaaatggtagaagaagttaagtgtagaaactagtcctgctcagggtatccccaagtacctgcctgctcagtgaattacttgttgccttctttctgcaggtgggagcagtcacaggtgtctctcggggggctgtcatccaggtgcgccagcaactttcctggctaggagaactccctttgtccctcaagaaagccctggcctctggactcaggacaagggtccacctgcctaagacccagcggagcttctcaggttcctgtctcctgtctcctccctcttcccctctctcctatctgcagtttctgctcggggaaatacaataacctaatatttaaataaaattctctcagatgccaaggagtaggacaagtgcccaggaatttaaacaggaataatacaagactctgattttcagacactttcaggccagtagaagggagtaagcaggtatagcccacgctctgggtctttggcagtaggggactgccaggaactgctgctaaggcagagcctcatgggtccctcgaggggagagttaaattcacagaaagtcagagttagaagaagctgtaatatcatctagttcaccccccttgctatattcatagggaaaccaatacttcagctgcttttggcaatgatggggattaacaaggactggttgagtcactccaaagcatacatgctgtttagaagacaaggtttccaagtagtgcaacctagttggggaaatggagtccgccagccttcacagggtaccatcttaagaactgccagaggaatcagcctcataagtcatgaaaatgcctgctctactgctcataaaccccagtttccacaatgtgagtacccacagacccaaacaaatataagaggctaagaagctaacaccagtaccacagcttctcagcatgccagtctgctatttaagactggtgcaaagtcaatttcctgcagcagacaagaaaggcccacacaggtctttggcatttctgggcccccagtttggaggccaggagcccgggagtggaggagctgagattgagactgacctgcttactaggtcttaccagggagcataagggctgctatgactctataaagggtcggtcgtgaggcagaaagtcttcacaaagcctctgcttgctaggaaacaaaactttctacgtagctccaggcctgatctctgcaacccactgaaggcatggcctgactaaaggctggcaggatggagctgtgtgaatgagcccctccaaaggcagacagaagaaccaatggcaagctggctcctcttctcacatggtgaaatgtccaacggctggcactggaaggctctctcccagtcacagaaaacaccgcccacctacctgccccagggtccaatcatcctgccttcccctactttggaacccagcctcgggtgtgggaatctgccagggaaaaacaggccttggctgtagtgtttttggtgctctatgggttcgtgtcaaatgatccctaaggtgaggagcaggttaaagtgaaagaggccacccctgcccccagcctcctggtgggacctgcggggtttgggattgctctcagcagtaagcagtaggcaacacagccagggtcaatcaccaaatccgaatccctttagtgttcaactggcagcagatggtccagcccggttcttagcactggtgctgcatacagcaggccccagatcaagcctgctgttgatctcttttgactgcgggggtaacagagtgggagaaggaggaagtacctcagatggcgagtgtccgggatggcccgattgctggagatccgctcactctcccgctggttgaaagcatacagcttataggggtcgtcaccaacgcgccactttttggcattcagataccgccgctcatcaaactggtcccacaggtcgtcccagtcagcgtccgaaggctgcgtgacacgaatgggaagtctgtgagaacggctccctgtcctccactagcccccgtctgcctatcagtacccaaccccagagaccaggcttattctggcaaggtttggctcaaagatggggtcagaagcagaacataaactaaaccatcagcaacaataaaaacagaactatgacaacgatggctgccaccattttctgagcacttctatatactgggtgctgttctaggatcttgactcacattacttcatgtagttctcagagcaattctatgagagggatgctgtgcatacccttattatacagatgagataacagcctggagaggtaagtaccttgcccaagatcccacagttaggaaatggcagaactggaacttcaattctagtatcccaaccccagaggccatctctccagggcaatctgagaatacctggtatgaaagtgcttgccccatggctggcacagagtttcatgaatgactgtcattcctcctctgctgtagaagggccagcgatgggaaggaaggaggagttccgtctacagtggtgtgctactcaccaccaccctatctgttcctttcttcctcctacccaggaatctggtatttttaagaagcatcaatgggggagtgagtaacaaccctcaccgtacatggatagagcacttcagaattgtaaggtggcttctgtattcatgatctcatttcatcttcacccaaaccttctgaactgagtagggaagatgaagttccaaaaggttgactggcttgtctgaggtcacacaggtgggaaggggcagagctcaaagcagagctcagtctctgtggcccctccagcagaggaggcaagggaatgcctcctagccacagcccaggctgcctagtgtgggtctgccctgcccacaccggttccacagccaacagactgtccacatagctagcaggaggtgtggacttcaaggccttgagaagctggacacttaaatttggtggtcacttcccaatgcatgttagcactctcacccctggggaggagctggtctgtatctaaaacagctcagaactttcaagttcataaaacataagactctgtgtttccaggaagaaagtgctgatcaggttctgattggaacatgagggttgttggtatgctggggctgacattgtccctgagggtgggatgctcattcatgtgttactgaacccagtggccgtgcaagtgtctcaagctgcatgggtactaactaagggcactgagctgagagctgcccatcccattactgagtagaatgcacctcctgcactcgggaaacctgaccagggtggcccagggcaggctccacagacagcagtgcaggggcttggcccacgtggcaggttaagaggggctgctggccagtgtgcatgttcatctgggcaccatggtgagcttatccagtaattgatctctctctctctgttacctcctttttaaaaacagcattctcctgctaatagcataaaatgaagctttggagaccagagatttttatccaataattgattttattaatgtcctgtgatactgcggctacagaacattctagaggaaatcggtgggggtgagaaacccccagcctgtgttttgcaatgtcacagcctgatagctgtgacctctgcttggaacatcaccccacggtaaccttgaaatcccatcctcatgggaagggccatagaactgtctcccactggcttgtttccaatttaattcatcacaattttctaaataagttgtgagcccttatggtgctccgagctagagaagagcgatgtggagctggaaggcccctgctctcgaggggattgcaacattgcagagagacatgcatggagatgcctgtaacacaccgcaaagtgagttcaattacatgagcacgatgacaaggctatgagagcagaggagtgaggggaactggggacagcttcttgagtaaggtgtcaaatgagttcgatcttgaaggatgagtagggatcttactttgcttaagggaggatagagagggaaaataagtatgtagcaaaaagccagataaaaggcagtatattagtcagggtcctctagacaagcagaaccaatgttgtgtgtgtgtgtgtgtgtgtgtgtgtgtgtgtgtgtgtgtgtgtgttcatgtgcatatgtatacagccacatatgcataacaacatttcagtcaatgacagactgcatatacgacagtggtcccatatgattataatactgtatgttcgctgtaccttttctgttttgatatgtttagatacacacatacttaccattgtgttacaaatgtctacagtattcggtgtaggaacagctgtacaaatttgtattatagcctaggagcaacaggctataccttacagcctatgtgtgtggtaggctctaccatctaggtttgtgtaagtatatcctatgacattcacacacaaggatgaaattgcttaatgtttctttttttagagatggggtctcactctgtcacccaggctggagtacagtggctcaaccatagcttattgcagcctcaaacacctgggctccagcgatcctcctatctcagctcccaagtagctgggatcacaagtgtgcaccaccatgcccagctcatttttttacgttttattttttgtggagacgggatctcactatgttgcctaggctggtctcgcactcctagcttcaggcaatccttccacctcggcctcccaaagtgctgggattacaggggccaccatacctgggcactgcatagtactatatgatcttttatatatatagtttaagttgacacagaaaaatatgtattataaataggaattggcttatgtgattatggaggctgacaagtcccaggatctgtggtgctggagatccagcaagagctgatgtttccagtggagtctgaacgcaggaaaagccatgtcgcagctcaaagacatcagcaggaggaattccctcttagcctttttgctcttttcagaccttcagtgaattagacggggccaccaacgctggggagggcaatctgctttcttcagtctactgattcaaatgttcatctcatccagaaacaccctcgtagacacacccagaataacatttgaccaaatgcctgggcaccctgtggcccagtcaaattgacaaataaaatgaaccatcacaggcaggaaggcccagagaaaaaaaatctgttcagggaatggctaactgaggaatagcaaggccggaatgtggattgcaaagaggacatgagtgaaagaaaactccagaatgtagttgagtctgcctgaagcaggtcatggagaaaacgtctctggccacacgtggaggacaaggagaccagctgggaagcggcctcagccatctagccaggtgggaagggacgctggaactggggcctgcctagtgggtcattgcctccctgtgctggagaggcaggtggaggggcaggcacgcatgacgacaccagagagggtgggcacaactgacctcttggcctcaccccccctctactctctattcacaccagatagaggcatgggcccaagagggcccgaggctgctggtttccctacagggcagctgaacatcccagcatccctggctacagtgccttctgggagcaccatgtgctgtgagctctccagaattttggaactctggaattctgtcccccagcaagccagagcagcagccaggctggcatgagaaattgaaagaagtcatggaaggtgtcctcggaggggcctgttcccctcagactgtcatatgcacaaagcgcagtcatagtctgctgcactgagaccccctgagggggaacagcccatactgggagctgggcttttctacatcaatatctgaatgtattaaataatggtgaaggtgtgtttaaaataataccactacataaagaataaataaaataaaataatatcactatttcaatagcactttatattttataaggcagcttgcacgtatatcatcatgcaatcctcacccaacccctatatgtgcagggcaggaccagtttagagaggttaggtggctgacccaaggtcatcggctgttaagtgatggaaccactgatttaaacctcccaacaccaaagacagaaacaacaagaagcatctcctctactgagggtcggtaggcagagaaagaccctgggagttggcttccaagctcttccattcatgagtccccacatccagcttccaagagcccaaagtgccacaggagggcacagtgtggggtgttctggccacaccatcacaggacaccagcctcctccctgactctgcatggggcctttgcagtacattgtatctatactgtgaattccatttcctggctcatacaaatatccgggaaagcttctgaacacacatgctcaccttcccacacttccctggtacaggaagtgatacgtcccgggaaaacaagaacaaatacccaggagctcccaaagggctccactcagaactgggcccactcctgtggggccttcatcagcacccatggcccccaagcaagcccccgcttcactttctgactagaatttattcaacctagagggaatgtgtttcaaaagtatgatgccacaaacagaaaacacaaacgttatcccgtttaaagttttatttttaattaacaaataatatctgtatatatttatggggtacaatgcgatgttttgttacatgtagacactgtggaatgatcaaatcaggctaattaacattttcatttccttaaatatttatttatggtgagaacatttaaaagtctctgttctggctattttgaaatatgcaatatatttttattactaactatagttattcctcctgtctaactgactttgtactctttgaccaacatctcccccagcctctggtaaccaccattctactctctacttctctgagtttgactttttttaggcttcacatataaacgagatcattattcagccttaaaggagcaggaaattaagtgatttgtgacaacatggatggatattatgctaagcgaaataagccaggcacagaaagactaagacataatcttttcaacagaaactgtctcgttaagtctgccaaacccctggccaagaccattgcttaaataatctggcatcaaaaactaaagctcgatggcacatccgttaagttgcttaatttctctcctcccaccatgcttcaaggagaaatcttgaatctccttttctccttccttccctgggactgtttttactccctctcacttcaagcagattatctggctctgaaatcctggtgtatccctcccttctgttaggatttaaagctgttgtacattcccactcatgcttttgtctctctcccttctttcctgagcttggtactactagttctctcttactgtcccaattgtcttctttttcaccctgaaaatgagaaactctttatccctttgatacagcttctatcctaccatgaactgtgtctgatcctgaagagaacgtctcaaatttaccctgtaataaatcagctaacacccaggaagaatacttactatgtgtcataactatttacatttaatattcacaataataggtaccaatattacctttccataattgggggtatgtaggcacagaaataacaggtcccaagtcctgtgtctgatatcacacagcttgtcaatgctggagctgggattagaactccggcagccagctccagcccccatgttctttgccattaggcagcacggccttatcacagcctcactgccattttcttggaccatcttcaaagactcactatctgtgcatttcctgtcattttcctcagccaacttctttctttgcttcgggctattcctccttcaaaggatgtctgcactcccttcaccatcagcccctctactcttcactctccttgctgagaaacccttctcctcccagcagtgagcttattcctaacagccagggccaaaaaaggaggtattctgcagctggattcctgcaagaaggcggggatgtgctgccaggttaacgtagaagaaggtcagagtagaaaacagcgatgtaaattcttatttaaagaggatatcatgaatctatccatccaacgttggaagcttcagcataacatgccactgccccatggacatccctcctgggtccagctagtgacacagaggtcccaaatagcccactccaaccttaaagaactgcaacttctagatatgtccttcttatattgatcaagaatctgtctcctggtaatatctcccttttggatctggttatgcccccatggccatttggtactagtctaatctttctctttcatagtcttcaaatatttagtggcagctattataatatttcccagatcttccaacccctggtaccatcactgagatttgcacctccgaaaaattaacacacaggagtgtgaaacaggtagcaaagggtctaactgttctagaccaactgaagtcagatgggttcatcaaggaattcaaacacagtggagaccctgccatatgtgtgctatgaaaagggagatatcacccagcatagaggctaccttttatatcaacgtctcatggacagatgttgttctgtgaaaatgctgtgcctatggtaatgcctgccattcactgggcacttactatgcaccaggctctacaccatattttatcaggaggagaaccctcttctcctcacccaccagatcatatttccatggaagagttatctcctaagaaaataaaatatggtgtggagcctggcacagtcagtgcaggagaacacgtaaaaccctatccagggcattgctgtgagtgtcgtaaacacttccagtgtttctttccatcctttcatgctcctccccaagagaggcaaaactattctcaccggttggagccacacatgttttgctggtgagcaggactcctgtgtggtaaagccatggcctagccctctagtctgcacttccactgtccaggtggaacaggttgtcctgttctatttgtccctaggtagtaagcacacactaggcttactttctagaagcaagcctatctcacccaagcggctgtttgaatatgtagatctggggtctgtgccaccatctctccctaaaccctgagtgttctggtcccttagtttagagctgaagtggggatataggaagctccacttcatcctcaggcaattccacgttgtccaactcagcttttacccaaagcctttccttaggattagaggagcttgcttgtctcaggtcatgaaattaataaaagtattattcgtttcccatttgtttgcagattcttgtatgtgtttctgtattggtcagggttctacagaaaaatatcaccaactgtgtgtgtgtgtgtgtgtgtgtgtgtgtgtgtgtgtgtatacacagaaattgagaggacagattgattgattggctgattgatttctaggaaattggctcatgtgattatggaggtacaaatccaaaatcctcaaagtagcctggagacccagggaagagctgcagttgaagtcctaaggtggtctgctggcagaattccttcttgcttggggaggtcagttttgttcttttaagaccttcaactgatcggatgaggcctacgtacattatggaaggcagcctgctttacgcaaagtctgccaatgtaaatgttagtctcatccaaaagacaccttcacagaaacagcagaataatatttgaccaaatatctggacattgtggtttggccacattgacatataaaattaaccatcacatctccccttattagaatcccagagggaactagtgagtgaggggtacctaaagtgaattctaacccccacaaacttaagatatagtaagaaactatatccccaattttcaaatgaggaaagtgaggcacagggaggataaatgatttgcccaagttcacacaactgatgtctgtctcaaagcctgtactgtcttccctcttttcaacagacctagttttaagtagctgtggggccctggagttctcgtctccatgtagccaggctatctccaggaccacagccagctctggctacctgatacccctcagagtgcccttgctttccactagctggaagcttctgttatctagcaccacggcaaaccagatactcccaggggactcttcatgctaaaccataactagattctacaagggttctgatgcatttctggtctttctagaaggaaaatcttcaacatgaaagaaggagtgaagccaggaaaaaaatacaggatgcggaaactagaggtagggtagttgaatgataagcagaggtaaaatgtgaggctgccctcagggtaaaggtcactgagaaaataaaccgtggctcccaaaaggtggaaaagctaaacctgagtcttctgtaattaagcccaagaaggggacaaagtggtccagatcagttgtaccctggctcccagaagaagcaaatgtaagtcctatgtggaggaaaacatctccaatttaggaccccagaattcccacaaagctcatcaaaagatgaaaccacaatacaaaattaccagacacacaaggaaacaagtcactataagacaagacaagtctacaatgtaagaatcagtggaaactataaacagatttagatgctccaaggactctggatacaggaatactagatatagaataaggcataactgtagataaaatgtttaaaatatggtataatgtaacaaaactatacttgtactccccaaatgtatacaaataaaaataagtaaaataaaatatggaataaaaattagtaaagaacaaaagacaaaaaatggctgggtcgatttgaaaaagaaccaaatcaaactttcagaaatgaaataataatgatggaaagtcaatatcaaacaggcccaagaaaattgtttataatctgcgaagcattttcacttgaatatctcgtttttactacccctatgaagtagccaggctggttatactgttaccacttcacagatgaaaaaactgaggctcaaagaaacaaaggggcttcttcaaatcatataaacagtgaattcaggccaggcgcagtgactcacccctgtaatcccagcacttttgggaggctgaggtgggcggattacttgaggtcgggagtttgagaccagcctggccaacatggtgaaaccccatctctactaaaaatacaaaaattacccgggcgtggtgatgtgcgcccgtggtcccagctacttgggaggctgaggcacaagaattgcttgaagtggggaggcggaggctgaagtgagccgagttcatgccactgcgctccaacctgggtgacagagtgagactccatttcaaaaaaaaaaaagtgaactcactactgagattctaatccaagacttttcatttcaaaactgtgttccttccatatcaccagatgctccagtcagccacaagaccactcttccccactgtcagctagtcataaaaatacaaaagtatctgcttacccctatacctttctgttgtccagccagttagggagtgactatatttttccaagggccagccaagagagggagacggtgcaacataatccccagtgaaatgctaacatatcaccatatgctcccatatcatactgctaatataactcccacctgcagagaatggatggtctgggaagaggatgactgtcagtggcagacattccccacagcgtgcagaacaagttccagtgaggaaggaggggcacccagcccttcgcttgcctgggctcatgcaaaggaaagagctggaaaatcctttcccctcaccgagggaccccacatcaattatggattattagataagatcttcattttaatatttcctccatgtattatcaccttcttcctctcactggaattctgtcttgggagttatttaactgatgtgcagaaatctaaatttaatttattatgctctaactcactttagaagccaaattaccctgcactggagaaggatcaagtcaatatcccacttggctttctatttatcttctgtgggggtttctctccttctctttagtattcatttttatctcaggtactggtaataaatttaaattttcctcagaattaagcaattgctccttcaatgttgtagtttaatggttagtattaattatatgaaaggcactccttaaatagtttgatagatagaatggacatataatagaggaagaaagggcaatttctcgcaccaaatgaggtagcacataattcagcagggatgagtttacttttctgttctacctcctcctgtcccttttccccactttcctcctcaccctcctccctcaacagccaggtgcctagaaaataagtctgctaagagttgctctgctgtggcatctctgagcccccggagggtctgccagccaggccaagcctggatccctctttagtgtgggagtctttttccatttgatttctctctcatttagtctctgacaacaaaagcaaccactgcccatctctctcctccccaccacttcgcccataaacactctccccacccatgtctcaattgcgctccacatgcattacaactttgggggaagcttccagctttctggaagaagaaaagttccaataattattataattgcctaaaaattccaacagtgaaacataatatgattaactgaatggacagaagcccggtttttgtttctggaatagaaaaagaaactcacatatttggaccttctatggagattaatttacttacaaattagcacgagaaggaggtgccagggaagtctaagtcagcatgactggggaagcgggcctggctcccaggcacgtgccaggaagcgtgagctctaatgctgatgtatctgcttccttcttatcaacaccctgtaaattccaccaccaaagactgaacccaaaactcccttatgtcgatgggcatcctggattgctagtcacttgtctgaagaacacatcccaattgccggtggacatgaggactgagagagctggtcctacccacacgctttatttctgcatccccttctctttgtgttcagagaccagagcggcaagctggtcactggaacaggagaagagtctgtgtcctccagctctggtacccagggagcaggtgatctaggaggcagggagccaggtatccacaggggactcaggaaaaaaaggatttggtggactgggtggaagcacaggagggtgaatttgcctataaccaggaggccaatactggaagagaacaggcactgagaacaggaaccagtacccaggagagtccaaggggagggattggatgtaggtagagcaaagctggaagtgactcagagagggcagcttcagctggatggagctggatagagctggatgctgaaacatgctgtctctggtgtgcacagttgagccatcttggatgcagggtcaactcatcagacagagggcaggtctgcaagggtgaggctgcagccatctctcagagacagcaatatcagagaaaggaggccaaatcctcccagggtggccccacaatgtggccagagcagcctccaacaggacagggaggggccgagtcagatgcccaccccactgaaaaccactaggaggaaaataaccctaaaaataagatttggatttatcagggacagagcagctctccctccaaaagccaggcttctctcccctccttagctcactgcaaaggactggaacatatcttaaggcaccatcagaaagctctctagccataagaaatagctacagggaaaagcaattttcaagaggccctctgaaccaaggtatctagcaggggtcatgaatgagcagacctggagtcactgagaaatgtgagcgagagtggatggcttgtaggtgccgcacaatacctgcctagttacactgctttaaacctgctcttgggcaaaacaaaacatgcccatgggctgacattggcctgctggccaccaaattgtgacccctaggacactaagggaatacaaggaaaagggtaaagaacggaaaagaagggaagaatcaaacaatggaaaagtgatcatagtaaacattatgcatttgtgatttttctccttcaagggatcctttgttgttttcaacccaattttagctggacagaaatgcagccccaagagcttctgtgttgtgtgtgtgggggtggggagtggagatgggctaaaaagggaagcgcagccccagggatgactcctctaattccagaaagctgggtcctgagcttggctcagctaaacatatcctttctggtcagtttcagaacctcgtggtcagtttcctcctcctcccaaggacaatactaatcttcaccctcacccagcttcatagcccgaattaggcttcagaagtgagatgagacatgaaaaattgcttggtaaaacataatgcatacacaacatattatcattacaacatagctgtggttactattatttcttttggtgactgaatgctaatggagggaaaacgcaatttacagtcagtcaatttaagtttagctgcttctcccttccctgtggcagaaatggggtctctgacagcatccacagatgaccgggtgcctcacctcactgtccgtctgtgagaattggtcattatcaatgtgaatgcttcctgggactcagcaggtgttttctacccaaagctccatctcacacgagtttgagcacagtgccatgcaaatgataagacaagaaaactattttaagaagcgtaatacataaggttattatcagcttagaaggctagaaattgagctttgtgctaacttgctttttatgcacgtggagagtgggggctggagccagcacagaagctgtgcagggtgattctggagagagacttgggtgagattagaagcctggacctgcctgagaccccatactccgaggaacctggacttcagagcttcctgcttgacttctggtcccttctcctcgtctgaacttagtcccgaagggacttctccatgcctcccaggactttggctccatgggctggaatggccggtccaacagtcacactcacgaggaatgtgtttagcatggtttgcagcttcctcaaatctccctctaggttcttgccaggcaaagataaccttgagagaaataaagatgggaagctgtgggaagccaggcgaaagaactggctttaaaaagtgactacttctcacactagatacaatcacccagaataatgacaacgacaactactgcaactaatagtggtgtagcgtttactacacaccaggctctatcctaagaatgtccctcgttctatactcagaacaaacccaaggcaggtgcttctattaatcccattttactgaagaggaaaccgagtttcatggtgctaacgtgacttggccaaggtcacacagcaagtcagtggaggtgctgggatgaaacccaggcacgcagattccatgcacaaccttgcaaagtccctgccatgataggggatcattcatagagtgaggcttccaaaaccagtgcctgtctggagatagacctgggaaggatgaaggaggaggcatggcaggaagcacagttgtacattttctgccaaggttattctggaacccccttccttaatccacgtgcccaaaggtgctaaactggaatatggctaggaagacagtttcagagtcaagtgcccctaagccctgccactcaatccccaaaggtgacattagcaagaagcttccagctttcagctgagcagaatttgttcccctctcttctacgcctgctagggggaggatagatctccccagatagtatgtacagcaagggcccagagcttagcacattttctgtcttctctgtaaataaggtgacatcaagataccctctagctctctcaaaactaggtcagctgctgaatatgtaggtgtgggatgggagcgaatgactttgaaacgactttatctcgtgggactctgtgggggctgctggctggcttttaatagaaaggactctttttatgtcaaaagcagaccccgagtatccagacgctgtgcctgctgaatatggatagggcaggatggctgcctcaaccaagggcgggtttagtgctacaggcgacgtggcaagtgaacatggcagtgggctgagaagctgggagaaatcctacatgcctgatctcaacactggccatctccaaaacgcagcaggaacctcgcccagggaatcttagatgaactatcagaatgggatttatgatgcacttgcttatgtaaacaagacctacagggacatttccctgacctcgggaagcataagtaattgctccccaaatgacacgcgtgtcaccaatcattcttgtccattcatcaaagcactggtggcatgatcccttctgcaggtccatcctgaactgttggaaggatgtaaggtgttagagtgacatttcgaatgtctcccacatgaatccaacttctttacatccacagtggccttcttttcgctttttcagaattaggtgtgctctttaatcaaatccggtaactggataggaatccagatttgcaattcagatgcattgggaacagattaatcatttcaccagagctgctttggtttacgttttactttataaaagtactcactgcaagattcccttaagttatccgtttccttagtgcattaaaatcagattctggagacaaagaaaattgagtatctaaacaaatttccagagccatattctggaaatgagattaaaattatcaaaacccctgtcacccctttgcctctgccttcctatgcccttgccctcaactcgcagtggcagggatccaaagctctctggcccacaacctctgagcagggcatttccctcctgcaattttgttatgctgtgagaatggccaaggtctcaaaataactctcttcttcccaagaagaggaagtcaaaaccaatgggatgaaccccaaccctcagatctatttattcatttatatattggagacagggtcttgctttgtcactcagctggacttcagtagtgcaatcattgcttgctgcagccacaaactcctgggctcaaacaatcctcccgactcagcctcctgagtagctggctgggactacaggcacacgacaccatgcctggctgatttctttattttttatgtttttgtagaggtgaggtctcactatgttgcccaggttggtctcaaattcctggcctcaagcaatcctcccatcttagcttcccaaagtgctgggattacaggtatgaaccactgcaccctgccaaccctcagatttttcaacaccatcagctctcttcagtttccaaggaccagattctctctgaggtcccttccttcagaaccttagatctgcatgggtgtgacatccacgtctcactcactaaatggctccccccagccttgctgtctccagtcctgtcaaagagtcactctcagcacattaagcattaaggctttccaggcagaaaagatgactgtaccttcttctcgcctgcctccaaaatcaaggctggaagagaggcagccagcatgagtggtgggaggatgcggtgcatagagaaagtaggtcattagtggtaaagactacaattttaaagcggttgttaatgctctgtttatacggatttcttcaaatgtgacattttaatggcataataattgtgtgattacagtgcagtcgacaccgctccgggaggaaaggcgacagggactctagcttcctgctgggggaggcggctccctgcacgggtggccggggaccatgtggcactgctcaggccaggatgccagacaagcatgagaaatggctccctggagggccctctgctagacaagggccataggttcccaggaaacttgcatctggcttagcccttgaacaaaatcaatgccccgggctgcaggaggggagataatgacagcagaacttgcaattcacttcattcattcacttcatgcattcatttatttattcattatttcttgagttcttactgtaaactgagggaaaaggccaatagatatgcagaaagaatgaaagaagaacaaatggaggaggcagagggcaaggaagaggatctcacatttattgggcacctactggatgctcagcactaaggcacaatttggcacattcatcttccttggcccttcagcaacatcctaccccctggaaaagccccccttcgagggtccttgtctctctgtttcagaatactttctcctgggcttctcagactttggcatcttcttcatttccttctctggctcctcccttcccctgatttctcattgttggaagtgtgcatggatttagccctggtccctcctctccactcgttacactctccctacaggtgacttcctccattcctgtgccttgacaaccttctatagatggaggattccaatatagttttccagcccagatctcttttctgagctccagaacaatatcaaaaaaacgcctactggacatgcccacttaaggtctcacaagcatctcaccttgcatggatttcaaatggaactcttgatttgcccattggaactggtgcctcttccaggctttcacaagtaaagaaatggcaccaccagccacatagctgcacaagtcaggaatctgagagttaccctcgacaattccttcttcctcattctaaatctcactctaatcacttgaacccacacacaactaacccatccccatgtcctgttggttctgcctgcaaagcatgcctccatccagccaccctccttttcccatctctacaaccatacccaaccaccaccaactgcattctggaatactgcatttgatccctccaattcattttccaaagtcaccttgttttgttttgtttcgtttttagacatagtcttgctctgtcacccatgctgcagtgcaatggcatgatcttggctcattgcaacctccgcctcctgagttcaagcggttctcatgcctcagtctcctgagtagttgggattacaggagcccaccaccacatctgcctaatttttgtatctttttagtagagacggggtttcaccatgttggtcagcctggtctcaaactcctgacttcaggtgatccacctgcctcagcctcccaaagtgctgggattacaggcgtgaaccactgcgcctggcccaaagtcgccttcttaaaaacgacatctgtggctgggcgtggtagctcatgcctgtaatcccaacactttgggaggccaaggcgggcagatcacgaggtcaggagatccagaccatcctggctaacacggtaaaaccccatctctactaaaaatacaaaaaataaataaataaataaattagccgggcggggtggtgagcacctgtagtcccagctacttgggaggctgaggcaggagaatggcgtgaacccgggaggtggagcttgcagtgagccgggattgcgccactgcactccagcctgggcaacagagagagactctgtctcaagatgacattcgttcccgtctctcccattctggctcagaatccctccagcggctcccactgcactcagaatgctgtcctcactctttcctgtggcccccaaggccctgcctgatcagaacctgcaaactctccacacttacccctccccatccctcttagctcattatgttccagccacactggccgttcttccctttctcatccatctcatcccatctcatagggctttctgcctggaatactctcaatctgatcaactgtggccagcaaggaagtggcaagatgggaaaccagaaccattttgcctacaaaaaactttcaatgggcctggcttttcagaaaagagaagaccagcaagggctggtgccatcagggagaggttcagcagggaggcaagccttggcctaggcctacaggaattaactagactgagacagaagcacaggaaggagggagggaagggatagggagggtggacacccacgagagctgggtctgcaatctctcctccagttactgtctctgtgaccttgggaagtgacttaacctctctccctcaactgagagttagctgtctggctgtctattctgcaaaactgtgatgccattttacggatctaatggactaaaataagtaaagcactaagctctgtgccaggcatacttttagcactcaaaaaagaatagctaccactttggtagcaaagtgaagacaacgttgtatgtccatggggcagtaagagctgacttttagatctggcctccacaaccttgaatcctcgggtaaaccatttctgctcactgggtctctggttacttttcccacctataaaatataggggttacatagcagaggcatccttaactatttgaggagacagggccctatttttcagtgtaatagaagccatggtcttttcttccccagaaatagatgcaaaattctgctcacaggatctaggatccagtgccaccctggggccacaggaggcacctggctgttaagaggagagggcgcctctctgaaagatgagctcacactggcagacctgtctggcagcaaataaatctatgatactctcccttctccctcccagctacccctcagggggccaaagctggctcctcagctctgccagcctctgcccaccccatgccgagcacagtcaggaggcatgctgtgcagagggactccataattggtccctgctctgtttgtacttcaaacaacaaccttgagatgtgttctctggacgtgccgcctggctctggctgccataacgctcagccgggaaacacatctccagagatccacagcactggggaaaagctaggcattcttcagctgatgcccaggagctgaaggtgtttgaaacgggcaggggcaaagaagggtggggaacgccagtctgctcaggaaattctctactccttggtgacagtttccagtacagaagatatctcctcattctctttgcagagccgaccaacagataagcgctggggatttatgtctttagacctgtatttaatttttcacactgctgctggaatggctcttctaagacacggttggatcccactcacagaataaaggccaagttctttgccgtggtctgcaagtactgccctggacttttggtctggcttaaccctggttcccacacactggcatccttccattaaactgccaccaccatgactttaaggaagcaagcaaatctggtccctgcaacctaatagtgtcccctcttcttatggcagcacctatagttacctgtttattgggtctcttccacaaaacagcgtgtgtcctggaggcaggagtgtggcttttctctctgagaggttggtaataaaaactgctcacagcctcagtgcagctctcccttcccacctcactccaccaaggccctcaggctacagacaaggggacagacacagaactcacagccctcaaactatgccttgtggaggaaatgaacaggctcagacatggtgaaaaaagggttaagaatgaacttgccctgaatcagggtgtgtaggtcaagcaagatgcaaaggaactgcatggcaatgatgcaaacatgcccctgtgtgggtggggccaaaaccaaaaccaaacaaaccaacaaaatggaacacagtatgaaaaaaaatccaaaaacaacaccacccacacacacaaaacaaaaaccccagtctaaataaaaacaactaaacaaatggaaggaaattacccaaacgtgcttcatgctatggaatagcttaaaagcatgaatttaataaaataagagctaaaggattagatgattaaataaagcaatggaataaagaatgataaaactgagaaccacaaaacacttttgcagaaccaataaatacatgttgaaactccaagaagcagtgcaggcacagcaggaaatctaattactgataccaactaaagggttccagtcctggctctgacactcttgagcagtgggaccttgggcaagtcactgggactcagaggagaaagatttaaattattaaagcaactacaggagagaataaaatgtatagaaagagcaaaggtgatccaacatcagaaaactggtgaacctgaagcagagaaacagatggaacacacaaaacagtcttcatctttttaaataaaaacctcctgagatgaataaagatctgagtctgcacatcaaaattgcacaccacattccataaaaaattgatacaaagggattgacacgaagatgtttcctggtttaggtatcgaacttccaaatgcaagaaagaaatcatcaagcacccaggcagaaccaacaagtcacctacagaaggggaaatgttcagctgacctcaaacttccccgcggcagctttccatgtcagcggataatgaagcaacacccacggggctgagtccaaatgtgaccagaagcattttaacctgctgaggtgccgttcaagtacggacagcaggagtgtgatattcccacatccaagctcagggatgacagcacctatgagcccattttgaagcagccactagaatccactatggcagacttctaatttggaccccagtctgtctggcccatgctctttctgttaatgccatttctgctttatatatgaattttgttcccacatgcagtcaatgaagaggtggttcaaaataaaaaacccaagaatggagcagaagaaccagtagagcactgaatctatgtaattacaaaactaaaagtaaacagctatgggaatggtcatgaaacactacaaaagtgttatagactctgacaatctaaaaataacgattgtgcagacaatggctttaagtttctgtccctgtaagatttcatgaaagctgcacttaaggaatgaaaacagatgaacctaaattttctcaagacctatgctctgacactggctccactgcttactgtttatgtgatttggaggaagctgcttaacctgtttgaacctcagttccatcacctgtaaaatggggagaataatgcctatttcacagggttttaagaattaaatgaaaatactgtaggtaaaaagcagtggcttgcacatagtaaatgtcaattaagaggagaagctgactaaagatgagaataaaagtgaacatctcccttcccccttcctccccaaaaaaggcaagggggtacccatcagctctggatctggatagctagtgaggctctgggctctccagtaggttgctgtatcaattcacaatgttgcaactcattgcagggagaagcccctcccacagagaggcattgggcccccagtttccaaccacacagagagcaaactcttttccccaggactgaggcagagaaactgaagactgaaggaaaagcaagccttcacctcctggcaggggcatggtgagaagcagtgtggatccagctgcttgccagtggatgcccccttctgaaggcctgaacaggtccccatatgactagccctgaggaacgcagcatgctgggacacacgatacatgtaggtcagcaagtcagattctagacccaatctatctgccacccactagcagtgtgaccttgagcaagtcacttgaactctccctatttcctcatcgtagaataagagggtaggagtcaatgatccctaaagcacccctgcgtttaccatgtatatagagtgcaaagttctgtgtgggttgtacccttacaccagtctttcctgccataattaattcaacaagaaccccagagaaaggaagaggaaggagaaggaaacatgagacagaagtgtaaattagcaggtgagggaatgcataaaggagggagggaagggctaaagttctgtggcctctgaagaatcaaccactcgctagctttaaagaggcaggagcttggccgggcaccgtggctcatgcctgtaatcccagcactttgggaggctgaggtgggtggatcacctgaggtcaggagtttgagaccagcctgaccaacttggtgaaacctcatctctactaaaaatacaaaaacgttagctgggcatagtggtgcactcctgtaatcccagctacttgggaggctgaggcaggagaatcgcttgaacctgggaggctgaggttgcagtgagccaagagcgtaccattgcactccagcctgggtgacaagagctaacatccatctcaaaggaaaaaaaaaaaaaaaaaaagagatgggaactcactctctgccagtgagagttgagagttagtgactacagcctctgcagggcaccccaaatccactcctgacaggagaattgcagaaagaaggcaactctgccttataaaaagggtccggaaaatctgcctccatctatactaaaatcgatgggctaacagttgagatgaatcagaatgtctgcaaagtctcaaagtacatcctccaatgtactaatggcaaaagggaaaaaaagagtaattttatgatggagactgctggccagtaccaccctagccaagcaatcaagattaacattaccagtaataaaacatatcaatatcacatatcccctataaggatgtactgacaagggctcaacaccacgtctgtagtatttttgccaaaaacacgtagcttcagtctaatctggagaaaacatcagacaaacccaatggagagacattctacaaaacaactgactagaactcttcagcgtgtcaaggtcacgtaagacaaggaaagacatcacagattggaagagactattacaattaaatgcaaggtggatcctggcttggtaaccagagccactgggatcatcccaccagacaagctgcctaaacgagaccttgaagcaggctgagggggcatgaaatctagaatgggtagaggaggaaggagatgatgagagtcacaaacaattgcagcagcagggcctagagtttgctctactagcccttctgcatggatccgctcgggctaccatcacaaaacaccatagaccacggggcttaaacaacagaagtttattttctcacagctctggacgctggcagtccaagatcaacgtgcgaacagggttagtttctcctgaggcctctccacttggcccgcagatggccgtcttctggctgagtcctcatgtggttttttctctgtgtgtacatccccaatgtctctttctggatttctaatcttcccttcttgtaaggacaccaatcagattgtattatgccaaccttgattacctccttataggccatctctccaaatacagtcacatgggggttagagctccaacgtatgaatggtagagggtagagaagggacacaattcaggcgattacacctttccttacagagcttcctagaaactgggactaaacagaatcccagagaagctgtaccaggatagagggatgaaccacagtgggtgccactgtgccccacacgaactccttccactgggcctgcacacccatctctcagctgctaggagtgctggctgcaaacttctacagagacctgccccccagaacaagacctgcctctcctgggaggtatatccccaactccagggagcaactggtgccagtggctgagcaatctcttctccaaggctccccttggaaccaggttgaaatctcctactatgagatacatccttgcagagcatcttcccccgcctgccctgtcttgcttccctcactcccctcctcctgggagtgctctcattaaatttacaaggctctgcttctatggaatctgactcaagacacaaagcactacctacaaagcttaggatagtgcctggcacacaaaagggatcacgaggtgttagctatcatcctcacaacataccacgctctgtgctggacgaaccgtacacattattcactgaatcctcaaaaaccctgcaaggcaaataatgtgatgatcactttatggttaagcaagggtctcaaagctagctatggcagacttctaatttggaccccagtctgtctggcccatgctctttctgttaatgccatttctgctttatatatgaattttgttcccacattttcagaaaggttcctaagactctaatcttcctccatgtccatggccttcaacagatatgacttggcccctggccccttgcaagccaggatgttcttcctgtaagccatcaggcctgctagcagtgactgtggccactcagcatatacctgccatcttctgttcccttgcccacaataggcattgctgatgggcccttccaatatgaattctcctaactccactatgatcttaatgacagctaaatttactgtaaataatacatataacagagtacccatttttataaatatttaaatttcctactgagaaaacacaagattttaatcattacctgcaggggatccaggttcttagatagattaatgaagtaaagggtttaaagactgggaccctttgctccaagtattgagtcaggggagagtcagacaggagcaaaatctgtcacccttcactactccctgggggcccactctgcaagaaaatcctctttagcctctgcccaaatcttgcagtccacagagaccacctgagaaggcctagaaagcccagcacctctcacctggagagatgccagcaccgctgcacagggcacaatggaatggctgagaaagagggcgcttgatgaaattaaaaggcaaccaatttaaaagagattaagcagggaaaaggggatttaatgatcagcttttgccactgtgaactaactgaacccactggcatggagactaatagtttaatatgttgttcaacaagggtgagatgtctgtgtgagtaataagggcacctgtagttatggtgacaagggtaaaattgccctcgccacagggcctcggccttgggggctgtactccactcatttcccgagtacggtcagggccagccactcagcacttcccagcctcaggagaaacaattttcacgacaagaaaggggcctgatgatgtgtaagcagaagaaatccttggagagcaagtagcaagaagggtgagacagaggctcgcagatttaacacaaacagggcagcagggccctccaggtacccctggcccaggccgagaaagagccagctccgaaggacttgagaggaatgactaccatatatcattcactcttgctgaagagttgtattagtttgttttcacactgctataaagatgtacctgagactgggtaatttataaagaaaagaggtttaactgactcacgttccacagggctagggaggtctcaagaaacttaacaatcatagcggaaggggaagaggcatgtcttacatggcagcaggtgacagagagtggtaggcaaatgaggaaaagccccttataaaaccatcagatgtcataagaactcactgtcacatgaacaccgcccccgtgatccagtcacgtcccatcaggtctctcccttgacacgtggggattaaaatttgagatgagatttgggtggggacacaaagccaaatcatatcaagaatccagaagggctggggactgctttttttattttattatttttaaggtatttgacaaatgacatctggaaaagtgagggcttctggggatggaaggatggaaatgagttggtgaggaaatttgtgcaggttctttgggatgacaacaacaaaaaagcaaaactaattttactcagcacacggccctcatgacctttcattgtggcctgcaggctcagcagctgtgtggtggggcctgcgacctctacctagctcaggccctgcagagcacagagagcttctcagtgagtggtcattagacaagagaatgaatgagtgaccccaggccccctcacaaatgacagcgtgaagggggccggtgatggggactcagttgtctccaggtactatgctcagtgctttattgggcaccatctcacatcatcctgagaacaactccatgaggcaggagagattaagtatgtccccagggccacagcctggcataaggcagccagacttcaactcagggctcctaaaccaccactcatatgtctcacttctgggacagaagccccagagtaggcaactctcagagaggacagaactgcgatgcctccactcagcccttctgctgacactctatttcaacttgaaataatgtcgtcttaatttaaattccagcttgggttgagaatttgttggtatcagagtttattttgagtgggttttgctttaattttcatttgaaaggaagccttctttccagaactgcagagcctagtacctgacacctaactcacctgccccagccacactgtcattttgaggggacttgggctcattcattctcttatctaatgaccactctctgagaagctatctgtgctctgcagggcctcagctaagcagaagaacacgggtccaccacacagccccacaacccagtcctgcactcaaggagcctacagtcatgaggatgatgacgggatagtcccagggggaaccagggtttctcatggaggttaagtggctatcgctgtctttccagactggaccttcctgggagtggcagcttgaggcagaggaaagaatgaatactggattctagtcccagctctgcactcactcactgtgtgaccccagaagacctacttggaacatcagactgtccctctgtaaagtgggcatcatgattcctggcctgcccaggtcacagggtcattgcgggaattaagtgaaaggatactgtaaaagtgccttaacaactgaacagctttctacaatagaaaggcttactcttgggccagaatttaagtatgaaattgcacttgagtaaggggcgagcggtggctcagtctaccctatgaatatatctctgtgaaagccgattacatgcttattactcctctccaggaataaaacccactttccacatggccagccccttccccagcacaccctggcttatctcagccatgtggccccttctgccagccactgctgtcagaaatgagcaactcagtcagggacttgggaacacacgtcagagaagtgtgttttgcagctatcacacaggaaaacagtgttggatcattatccaggagatgaaaatacactcagtccacagaactgtattttttaattatgttcattaaaaggagattgaaccaaaaatgaagctcaatggaaagctgattttgctagaacttttccattcaaaacacagccatagtttatagtattgtcatgtgggtaaatgacaccccagggaacaaataggtttagaaagaagcaaaatacctcaagcagtccctggtccccctcaggaaagtcagagcaccctctctgggtagcacaaagttgggagtggggcacagcccacctaaggctaaaattcaagatggcctccggaatcacataaggatgggcttatctatacacccaagacacctgacaccccggggaagctatttttaatcttcgactcctcaactttcatgcttggcctgggaatggcctccccaagcccagtccccctttcccctctgggagggaaggtgtgttgctggtaggatcaacccaccttctgtcttgccctgatcagcctcttggctcccacatatcatacggcttacagagatcatttaggacaagtgcatttccacctgctcatgaaggctgcatctagctgatcctctctcttggtgagccagcttcagctgctctgaagggagtatggtgtgtgggagaaataggctttccagcagcctgcacatttctataatgccaattacatgcttattacgcctctccaggaatgaaacccacatcccatgtggccagccccttctccagcacactctggcttatctcagccacgcagccccttctgccagccactgctgtcagaaaagtatgggatcttaatcaattgccaatgggactggagggaaggcaggagcacaaatgcccatctcggagccaagagagactcaaacaagagcttgaacagccagcaggtgctgcacagatgggccattttagaggtgtggaagggatgttcccaagggccatgtggagctgtggtcaccaaaggggagcaaggtagaaggcaactttggaggaagtctagggtcttctccctcagacctgtgggttaagtctggcctgccagctgttttttcttttcttttttttatttttatttttttgcgacagagttttgctcttttcacccaggctggagtgcagtggtgtgatctcggctcactgcaacctccgcctcctgggttcaagcaattctcctgcctcagcctcccgagtagctgggattacaggcgcccaccacgacacctggctaattttttgtatatttagtagagacagggttttgccatgttggtcaggctggtcttgaagttctgatcccaggtgatccacccacctcagcctcccaaagtgctgggattataggcatgagccaccatggccagccagctgcttttataaatagaagttttatggaaacatagccaagcccatttgcttgcatgctctctatgaccactttctcactacaacagcagagctgagtagttgcaatcactctgcagaccatctggcccacaaagcccatagtatttacaatctagccctttatggaaaagtttgttgagtcctggtgcagcagaaagagcactggcatggaaggccggaagtcagaggacttgaagttaaacatgcattctgtcccatcctggccatgtgatgtggataggtcctttcacttctctagaaattagtttttctcatctataaagtgtggatgtaataaccaccctgtagggatgttgtcataatcaataaaaaggaggtaagttgtgtatgcagtgatggcctcaaagacagacacaccagtacataattagatagatagaagaaagattccgtcttccctgtggttctgaaatactgcctcctggtcttctattctttgtgggctagaacagtgtcagagactctgcatgtgttttgcaaaggtgtgtatggatgggaagtgggggtcagaaaggggaggaagggagggaagaaggaagagctggcacagacttgattttctcagaagaaataatgacaggcagatcaaagcctgcctccttttaaaacatatacactgtcacaccccaaatatgggcgtgtacccctcagggggtccccctcagtaggggatggtgggatgctgggccctatctcaataagtggcttgggggtcagccttcccttgggctgagtattatggaccttgacccattatgcaggcctacattctccttctcctcccagttctggaataaggcctttttttcccccaacactctacctttccccaagtcagaatcccatcccacacagggcctccagttgccatgtaacactgctacaaaacaacgtcttcccacttagcacatgtgtatgtggagctaagggggtgcttcagggggcccaagactggtgggatgaaattcctgctcaagaagcatagagcttcctaaggaactggggagggcaaacaaggccaggtaaggatcattgggagccttaagcagaaaagaaattatagtactccctaatatgtaattctaaataaaaacaataggcaatgttaaacacgacatatgagtatgctgaaatgaacagaggttctctgtagattttctaatgccaaaattctggataagttcatgggagcttaattcatttactccccgcctatgggtgccctgccaggctactgctatcagcatgcgctctgtctgcttatccaggagctcagcactgacagtctggagaccccaagcaaagggcccagaagctcaggaggcactgcttccagcaggactattgtgggaatgcagcatggggtgaggaagggcgcatttgagagaggccttgaagaaggggtaacattttgacagattgagatatgggagagttttctaagatagctaatggactggtccaataaagctatagtggggaaaaacaaaaacaaaaacaaaaacaaaaacaaaacaaggtatgtttgaaggctcaaaccaaaattgagaatggtgaatatctcaattttctctggagtaaagtttccagtggatgaaaaataatcctagtaagttaggttaagaccacagcatggatggccttcatcacccattgtgtgatttggatctcacctcctctcacctcttcaaggaactctttcctgtaactgtgcctctttccttacattgtcaaagctcccctctctgctggaccactcccattagcatacatgcggtgaatttcccatctttaaaataccctccctcccctcagccccagaaccctcttcagcagtcatcccctttctcagcttcccttacagaaagggaattctgtttgcactttcttcccttcctttcttgagccccaaccccattaggcttttatcccagtgattctactgaaattgccttcctgagaatcatcatgacttgcacatggttaaatccaatcggcattcctgactctcaccctgcttgatctagcagcatccatggttggcacagtagcctcatccctcccctgtgacacttccctcctctgcctccagatgccactcactcctgctttccctcccacctctctggcagcccctcatcactctcctcctccagctaaacactgaagcgttccagttgtgcatccagcaccctacctgacctcatttagtcccaaggatttagactccgaggtgactcccaaatttatatctttgcctccaaccctctcatatccaacaacttacactgcacttccactttaaggtctaaaatatatcctgagtgtgtggccccaacccggtcttggtttccctctggacctgctcctactgagcttccccatcttagtagaggcaaatccatgcttcccatttccccagccttgaacaaggcatcacccttgactcctctatctcaatccctactgtcagcaaaccctgtggactcctccttgaaatatactccatgccatctcccagcacctgcaccactgtcacctgaccccatctcttacctgaactctgatctccctggctcttcccctttccccttagagattattccccacacagcagccaagaagagtacaagtcagatcacatcacatcttggctcaaaaccttctcctggctgcacaactcactcacggacaagtcttcacggtggcacaaaggccccaccaaggccccacacacggtggcccaaagtcccctcctactgctctcccctcactccctctactccagccacaccaggttcctccccaggccagccgagctgccacctcagggcctttgcacctgctgctccttctacctggaatgcattagattctgcatggctcactccctcctactgaacctcacctcttccaagacttgtctggaccaccttccccttattcagctgttttttcttcatagcatttgtcaccaccagagaggttatatatatctctttgctttctgtctcctcttgctagaatgttggcctcgtgaggacaggaattccagtgggtatccctaacacccagtccagaccctggcatatggttctactccataaatatttgctgaacaaataccaggcccaaagtatgaattttattagagaagtaatggggaaccactgaaaaattctaagtgtgaccccacacggcagggctctaggaccatgagctggcagggatggcaggctagtgggatggcatagagggaggcccagaccaaaagttgaaatacctgatatgtggctccactctaccatggactgctgtgtgcagcaggccaatcgcttcatctctttgggccaacttcctacatagttattaagttattaagacagttaagttattaagttataatagttattaagacaatagttattaagacagttaagactgatctgagtacttgtattgggttaggtgcttcacatgaatcatctcatttcacccttgccataattctaagatgtagttatcactattattcctatttcagaggtggggaaactgaggcataaaggtttacaataatgctaggaagttgataggcctcgatcccattgcaagacacctgaccccagagccagtgtccctcccaccttgttaatccagacccatgagcagggtctggatctcatgacctgcaaggtgcccacccatcaccaacactccatattatggagagagagacgggtagaggcaggcatagggagatggatggggagagagcacaagtgacaagctaaggaggccactggaattgtctagatgtggattaaaagaaactgactggagaatgacaagacagggctggatggaagacagggagcagagaaaacaccggcaggcttgtcaaccaaccagatacaggtggaaggaggtggaagagaccagagaccaagagctctaagctgggtgaggacaaggttgaaagcatctgtaacatgaaagaaaggtggcaatgagagggcaagtgcatgtgagttctccagagaaacagaaccaacagggtatgggtgtacagatacagaaagagagatttaaacaaagtggctcatgctattctggggtctgacaagtccaaaatctgcaaatcaagccaactccaaccagagttgagtgcaaaggctggtaactcaggcaggccttctatgttacagtcttgaggactgcaatttctttctttttcaggaaagttcagtctttattcttaaggccttcggcagattggatgaggcccgtctacattatgaagagtaacctgcttgatgaaaagtctactgatttaaatgttaaacatatctaaaaaaaatcttcatagcacactggtgtttgaccagaccacagcctaactgagctaccacataacattgaccatcacagagagctcgtcctcagacatgccgagtccaccagagacccctgtggaatgttgggcactttcagaaggacatttcttccagtaaggggcggggccactggcttttctacaggagatctgcaaaggtcagagtgtccatcttcatttccttttccttgtattattttgccaagtctctgaggccttgtagaagctttactcttcccacaattatggctgttgttattatccttcttagtcttagcacgaggatgctctggctggattccaagaaggagaattactttctgtctcccttacaccctcctgttgcttttaattggatgcagagtgtcttgtcttctctccccagacggacaaggagcgtggcctgtgatagtttaagtggctgccctgccctggctcagagatgagttagccctcagtcggggtgacgccaagtcaccctggcagccacatgaagatatttgcttctaaagagattcctgaggctcttgtgcttatcacttatagggagggggtctgccccaagaatcacaatggggtctagtcctgcctctgccactaacatgcggggagactgtggaccagtcttttccaatctctggcctttagtttccccactgacctgggtaatctccaaggtttcttccagtctgacgttctcccatgccatcatggcaggtcattgatgtcctgctcatatacaaagaaaagggattctgctccaagtccacagtcctttcttcctcagtcttcccagggctgcccacttttttgagtacaacctaaggtatgaaatgtatactgcagccagtacactacacagcacgcatatctacaagtgcaatggagaccaacattttatgaatgaaactccttttttacctgtaatgctttctccttctgtctcatgcctttaaaaggtaaaattcactgatgcatcataatctatattaaaacaaacaaacgctggtccatctggcactgtatccaggtatgatgagaaactaggaaacacaggcccttgcatgagtgttaaaaacaggccctggccagttgcggtggctcacgcctgtaatcccaacactttgggaggccaaggcgggtggatcacctgaggtcaggagtttgtgactagcctgactaacatggtgaaacctcacatctattaaatacaaaaaaattagccgggcatggtggcacatgccttgggaggctgagacaggagaataacttgtacctgggaggcagaggttgcagtgagctgagatcgcgccattgcactccagcctaggcaacaagagcaaaactccaactcaaaacaaagcaaaaaaaaaaaaaaaaacagtccctgtgctcagtattttcttactctgagaagccaaggcacctcttcagagaccatataccttcaacctcaagggtcttagcatagtgcaaaagatcctcgacaaaagggatcatgtctgagatcagccaaccttggcaactttaggaagaaacctggtacgtggaggccaggggagtgatattagcatgtcccaagaattcctttcaggattagtacatactattagttgctcattattcgtgcttatgtttatcatcacaatttatgtccccaccctgtatggtgaaatgggaatgtaaattaaattcacatccactacagtgtactcatgtagactgtgcaactctataaaaacaatagtttttgcctctggaaagctttaagcaacaagtgctgcctggcggatatgatactctaagagggcccagatgtattctgtgtgtgtgtgtgtgtgtgtgtgtgtgtgtgcacgcatgcatgcgcacatgcttggggtaggggagccttcatcagtggcatcttcatcaggtaagaggctgacttagtccatagctaatgagcatatgtagtgaggtgtataacgcatgcaagtgtgcttgtaaaccttaaccccatctttaatgctaaatatccctgttaatgattcccatcgttctcattgttacagacatacactttttctcctcttctgcctgctcctcagtgcaggaagttgaggtcctcacccacatagttgctcaggtgaggttgcttggctgttgtccaggtgtgagaatgcctggcctctctgaggggctccacaagtctcccagccatttccctcctctgaggtgatgatgagcctctctctcaggacatgacaggcaggagctgctactcaacccagatctccctcctcctcccaccatggcggaaagccagatcagaactctcagtccatccagggccagctctgtgctgaactagaaagagaccctaattcagccctgctgggatgagagcatcaagattcagggtttcagggcaactgccctccaccaggtccggttagcggggctccctccatctcagctagagccgccaccacctgcccttccccatggggtgctcccacacataacggtgtgtcagaaacactgctgctttattatcaatatgcaaagccttcgaggcagcaggaggcggggtagcggtgaaacaccaggggctatttatgagcctccaactcccatgctgggctttatttgcttaatgaatggccggggccagccatcagcccagggatttatttgtcactgggagcagaagacactaggatgtggagatgtaaaaatgacaaattctccaactcagccaaggtggtatttcattggcatgatatctagtggggaagcgaaggtgaggagaagggaaggacggctcccatgctaagcagcaacggctgagagtagcttaaagttgagggattggccatgttcaaaaaccaaaaaagctgctttctagaatgaagaatgagggctagggatgagaacatttattagcagttctcaggtgctcttccctatgctcaattctctgggggttgctccctgagcccccatttctcaaactgccccacccaacaagaactctaacgcgtgcagagggaagaaaattggcccagaagacaagaggcttgagtttgagtttctgttctacaattcattagtggggtgaccgtgagcaagtcattcgcgggatctattttgtcatttgtaaaaggaaaggatggacaagctctatgactcttatttaaagtggaggaatataaggaactaaagtcaggaatagtcagccagcctattaaacagaccctgccacctctacattcactgtcacagaggccacgtcatgacgtctgcaaccaacatcatctcactgcctccaccaccgtcatcttcacacacctcatcatctccaccagcatccgaccatctggtcctccacagagccaatctcacatgaagactgacttattttatttgtaatacaatacaacgtagttatatttctcagcctgccctgtaatcatatagaaccacataactaatggaaggttagtggaagttatatgtacaacgcacaggtcacaacctttaaaatgaaaatgagctgtcctccgcccctctctttccccttccccggtctaggacatggatgtgatgctgatggccagtcgcaatcatgtagactagaacaacactctacatcccagaggagtagcaatccctggctctccacgtgacctcctgttgcagagtgctactcaccctacaccacctttaaactgtttagagagaaaagcggcaacttctatcttgattgactactataatttttttgtatatttgtatattttgtatatttgttacaacagattaacccatatccccactagctataatgccaatgaaatactaccttggctgagttcgagaatttgagttggagaataagctttccattgtccttgggaacgagtgagttcttctctgctctgcgcaggcacagaacatcatttctatgacagcattgtgcatatcatacagaattatttgattattattttcgtgtcttctagactgtgagcagctggagaacagaacttgtgccttcttcatttggataaagctccagtagcctgaccattttgagttttcagaaaagcacaagaggaaaactgtggggcctccctaagtggacaggttagggatgaagcccaagaagatctgtggggactggtgccattcttaactgccagtgtaagaaatgtcagctgtaatagcagtatctgtccactcctctcgtggaaatcacacaagtccagggccgagcaccagggctggatggaaaaaaaaatcaaggcatttgattttgctaaacataccattctaggtatgtttagcaaaaggaacttaatagaggcacttagaggcttataaaattgttgaaaaaactaaggaagcaaaagtcaagaaagttcactgctagtgtttaagaaaaatataggaattgcaggagactgtcacgcatggtctcagctacataaagcaaaaaagtgggtggcacttctatcaccattcacaggaggatacccagaagcactggcaaaacctcaaaccctcatgtctgccatctgctgaagcccgtgagccttcccactgacctgctggagcaacaatgacttctgcttctctcctaccttccaaatctcaggcacaggcttctccctggtggattctttatagtgaggaagtctgagaaatgtttgtaggcttccagcccctggaatatgagagacagccaagaagggcagagacggtactgatcaccaactgtcagcatctctcacagcctagatttagacatggtttaaggctcagacccatcagcaactctttttcttgggatgcctatttatctgtgtattttgcattcactggggggctgaaggattttgatagccccagctgaaggccagaaagccattaatattcaagcatcatgagaaagcgcatgtgtgtagtcacacaccctcctcaaaccagcaagctccaattgtacaattcgaatatgagaatcgggtttcctgtaatggcgatcaccatgtgctcagataatttagtgtcataacctttaaatggccacaagttctttctcaaaatggtagacttatcaagtcctatttggatgccatgtgatcacttaaggggtgaacctctgaaatgtcttaggagtcctgtcaggtcaccccagagaacaggcagccccagaggttggggagaaagtcccaaactctctatcctaacaaaacttcaagcaggtgacaggggaactttataaaagaaagcacatgacttggtcacatttcagctctgagattactggaccattatttccaaacaattactattagatatgattctaacctcatagaactagtcataaggaaatgatatctaggctcactaagatgactaaaatcttactttcggtccagtctatctttgcatggccatgcaaatcctttgataagactccctctcatgcaccaatgccactggtacctctgcttactttgctcaccacttcctctcacctccaactcaccaagttgaagaaatctagtccccaaactgttacaccttgttgacacattcacaacactgatctatctaaacaagatcaatatggagaaaaaaataagagcctttaagtgctctgcctaagccttgaaaatagctaccatccttaggatcctagaaggaaatgtgactttgagtgcaggatcttggctacacattccaacttccatggaggggcagaggctcccacttcccctccaccctccacagaggggcaagagcatggctggacacaaaatgctgggatacagtgttctctctctagcaagagtcttcctgttttgaagctctgtctctggaattactgagctgtgcctgctccctctcctctcggaacttctcgcggctgccacagtcagctgcagaggacctgcctccacttggaaggaggcatatttgttcttatggaaggccatgatgaaaccatggtggggttttgagaggaatacctaggcagcagactctcatggatacaaaatgggtccttgaggcctacggtaatgaggccagctccctgatgtaggggaccagccaggggcctggggcaaagccctaacctacaaaacactgatttttctccagtggtcctttgtgcccatgatccctggggaactggtggggatggctggttgaggatccactcgctcaagataccgcccagccactgacatcccagaactttcatcctcgcctaagcccagggttgggaatgagaaagatggaagagttgttgggagggagaacaagagtggccacgagggctgcagcgcagagctcctgaatgtcactgaactgcagtgaaaggcagggtatttttcatttccaggctgcaagaaacagatgaagtaggcagagtagctgggcttaattgttgctgttttactttactggtgttttctgaggtcaagcatgttaagaagcatcctaaggctgtgaaatgactgagcagcccagaggtccatgtgaccaagtgcacaacttgattctgcaatcttcctgccagggaagctgttgagattatttcccaatccccacataccccctctttcccagcacaggaagtccctcctctgcacaactccatagcattgctgagcgatcaaggtcaactgcgcagtactgctgagtgatcacgggtctactgtgaagagtagaagatgtgatgtgcacacagatgccaggaagctcttgctctgcctcaggctttattttgctcaatgctggagaaacagctggactctgtagaagaagaagctgggaaggttgcatgccatgtcctaagggggcccactggaacagtcagctcccagagcagccctgagttggaatcacaccccagcctaagtttagcaccatactgtcatcagtgaacatcctagggtcctgaaactgggcacactctggctggcaccacaggggagagggcagatgctggagaagaatcaagcctccaaaatgagctctgctggcttgagtgggctgcttctcccaatactcaggctcaagtcattgaaaagtgactgacagacaccccagggtttctctgatttgctaggtatctctctcctgcttctatggacaagggctcccacctatctgtcacgtgtggtatagctccccctttgcaaaactcagagcaccagaggcaggcataagatgaggtccttgtcttcctagtggctttcctcatggccctggcacttctactaacagcagaaccacacaaataaagagctctgaaatctcaacacaagactctgaaattgtcccaattctctcttcttcaagccaattgtttaacatgtggagtctaccctgttggctacctttccttcctcgtgatcctccagctaaattctgataatgctatttttgcttccttcatttcctaaggaaactcctgtgtgtagttaacacatacctccccatcccaagactggctgtcttctctctttcatgtctcaggtactggcgacttgcaacactgtgaagcctgccctgaccctttggctccttccctccctggcctgcctgcatccctaaccgttttgacttctccagcgagtgagtctttgtccatcctatccccagcccattccagcttcctctcctttccccgagatatgcaggtgatgcccacgtgttagttctgacactaatttctctccagaacgccctcccatgttttcagctgcccattcaacatttccacttggatgttctcactattgaaaaagcatgtcagaaactgaactcatgatgacaacagcaaacaaaccctcacatttatcgagcatttgagagttcacaactggccattatgcctagtttatacaccagatttcatttaaaccatacaaaatcctctgctgtaggccaggcaagcattgctattctcatttcatagttgaggggacacaaggctcagagaaattgcctaagaacaaatggcagaaaattatggagccaggacttaactcagtttctctcctttgtgacttctcagaccaaaggtccaaatagccatcaaatcctgtgacatctctcttccttcttaatctcccttgcaccaaccctgaccctctacgccactattccactctagggttgtgtccctagctgcctggattattacatggcctcttgcttcaccttactaattttattctttagctacttatagtgcatctggaacactgccaccaaaataatcctttataatacttattttattttgtttctctttcaggagaaagtttcaatgtctccttccagctcacacttcaaaatagaatgcagcctagcaccacagcccttcacaaaacagcctcactcactgtcctttgcagctttacctgactagaccctctggttcctagtggctattccagtcactgacttttgatctttttctagttgttttgtttttttttgattatctgtttgatttctgtctgctctaatctttattaattttcttccttcagttgttttagatttagtttagtttgctcttctttttctaatttcttaaggtagaaatttaggttattgatttcagatctttcttctttttaaagcaaggcatgtatagccttaagtttccctttaagcagtgctttactttagctgcatctcataaatttgtatatgttgtgtttttgtttttgtttgtctcagactgttttctaatttctcctgtgatttcttctttaacctattagttatttaggagtgtgtcacttactttccacatatttgtgaatttcccaaatatcctttcatcattgatttccaagttcactccattgtggttggaaaatctactttgtatgatttcaatccttttaaacgtattcaggttgtgttacggtctaacatatggcctatcctagagaatgttccacgtacactttagaagatatagtctgctcttactgggtggactgttctataagtatctattaggccaagttagtttgcggtgttgttcaagtagtttgtagtattactatttccttgttcttctgtctagccattctacctattatcaaaagtgaggtattgaagtttctacctataattattgaatggtctattttttccttaaattcaatttttgcttcagtattttgggctctgccattagatgcatatatgttcacatttgttatgtcttcttgatagattgacccttttataattataaaatgttcttgtttctagtaaaaattttgtcttaaagtctattctgtgcaatattcatatggttctcttttgtttactgtgtggatgttacatcttcaacatttatccatttatcccaagctatttgtgtttttgaatctcaagtgtgtctcccaatagcaaagacatggaatcaatcaattcccatcaatggtagactggataaagaaaatgtgtgtgtgtgtgtatgtgtgtgtgtgtgtgtatacatatacatatacacacacacacacacctacacacacacacacacacacacacacacacacacacacactatggaatactatgcaaccataaaaaagaatcagatcatgtcctttgcaggaacatgggtggagccagaggccattatccttagcaaactaacacaggaacagaaaaccaaatactttatgttctctcttataagcgggagctaaatgatgagaacacatggacagctagagggtaacaatagacactggggactactgtagggtggatggtgggaggggggacaggataaggaaaaataactaatgggtactaggcttaatacctgagtgacaaaataatgtgttcaataaactcctatgacacaactttacctacataacaaatctgcacatgtaaccctgaacttagaagttaaattaaaaaacataataaagtgtgtgtcttatagagagcaaatagttagatcttatttttcaatccattttgccacgctctgttttttgattgaagtgtttattccatttatattcaatgtaattagtaataaggtaggatttatctctgtcattttgctttaggtttctgtatgccttatgtctttgttcctctatttctccattactgccttcttttatgttaaatggatatcttctagcataccatttttgttcccttgttgctattttttttacttattttcttagtagttccctggagattacaattaacaccttaatttaaaacagtatagtttgaattaatgccaacttaatgtcaacagtatacaaaaactttcctcatacctcttttccctcctccccactttgtgtagagaactgtcatacaaattatgtcttcatgcattataagcctatcaacacagttttataattattgctttatgtggctgtcttttaagttagataggaaaagcgttacagacaaaaatacatttaattaccttttttgtttacttctgtagttacctttactactgttcttatttcttcatgtggatttgagttactgcctactgttctttcactgcaacctgaaaatctctctttagtagttcttgtggggcagttctaaaacaatttctctcagtttttgtttatttgagaatgttttaatttctccttcatttctgaggaatagtctctactgaatatgaaattcttggttgacagtctttttctttcagcatttttaatgtaaataacactgctttctggcctccaaggtttccaatgagaagtcagctgttaatcttactgagaatcccttacaaatctcttttctcttcctgctttcaagattctgtcttcatctttgacatttttactatgacgtgtctaggtgaaaatttccctgagtttatcctgtctggagtctgttgaacttcttctatatgtagataaatgtttttcataaatttgaggagtgtttggctattatttcttcaagcatgttctccctcccctttccttctggcatgcttattatgcatatgttggcatgctttatggtgttccataggtctctgatgttttgtccatttatattcattcttttttcatcctgttcctcagactggataatctcagttaacctatttgcaagtttattgactctttcttctgtcaatttaaatctgctgttgagtccctctagtgaacttttcatttcagttattatacttttcaactccagaatgtctatttagttcctttaaatcaataattttacctacttactggtattctttaattaatcagacaatgttctcatactcacttttggttttctagacactacttcctttagttatttgaacatattttaagcagcagattttaaagtctgtgtttagtaagttgaaagtgtaagcttccatatggacagtttctattgactgctttgttcccctctttgtagaagtcatgctttcccatacttttgcatatctcttaatctttgctgttgtttaaaattaaacatttcaattcatataatgtggaaactatggaaatctttccccagggtgtgtttttgctaatatttgtggttgctgctgatgctactcctgcttgtggtttagtgactctcctgaactaatcagtgtagtcactgaagccttgattgaacagggatttccttaaatgttttgaatcaatacgtctcccagacttcgctgagaggctctgtgtgtgtgttggagcacactttctacactagctgtttataactctgcctcattcttcacttcctatttgcatagcctcaaaatcagccaaaggtgaaagattagatccttcttagggctttcctgagtatgtgcacagtcctacttgtgtgcatggcattctaaattcttagaaatttttcaaagcttttaaaagcccctgtggcatctcattctccaggtttttcttttaattattttggttagtcccttatttgccatatatatatatatatatatttttttttttttttttttttttttttttagatggagtcttgctctgtcacccaggctggagtgcagtggcacgatctcagcttactgcaacccccgcctcccaggttcaagtgattctcctgcctcagcctcccaaggagctgagattacaggcacatgcaccacgcccagctaatttttgtatttttagtagagacagggtttcgcaatgttggccaggctggtctcaaatgcctgacctccagtaatccacctgcctcagcctcccaaactgctaggcttacaggtgtgagccaccgcacccagcattaccattgatatttttgacaaatgccatagagatatgactgtatgaactcggtaagcctggagcctggttaaataaagagaagccctaagaatggtgcatctccagggagttgccagacaggccatatagtaataactctctggagatggagtttggcgttggccgggggagggggagggtaggtgttccaactccattctgccccctctagtggctgctaggctgctgattttcacagctattgttgtgaggctgttggtttttaagactactgcagagctgaggagaggtgaatgggaatagggcaagttaaaatcccacgaagctctttattcttagtgagattcagcaattttttttttttttttgagacagagtctcactgtgtcgcccaggctggagtgcagtggggcaatctcggctcacagcaacctctgcctactgggttcaagagattctcatgcctcggcctcccaagtgactgggactacagatgtgtgccactatgccccgctaattttttgtatttttgtagagatggggtttcgccatgttggccaggctagtcttgaactcctagcctcaagcaatccacccacctcagccttccagtgctgggattgcaggcgtgagccaccgtgcccagccaattcagccatctttcttaaacaaatgctccccggattgtttcaagtctttggttaatttctagagttaaaaaaaatgattttgacaatttttgccagtgttcttgttgcttttatggagatgtggtttttttggaggtacctactctgccattctggaagtgttacaatcactgacttttgaatacattttgttctttgccaagattcctttcatgctgttttcctgcctggaatgtttaatttttacaactacaaccagtaacaacaatgataatgagcagcatttccttagcacttctcagtttgcagagaacctttttagtgcacagaaaaaccattgaggtagataatactatcctaattttacagatgaggaaactaaatgacttgtccaagttctcacagtcagtaaagactcactctaagacttgaatcgggccggcttaccaatctcacacatattcgtctatttcccacaatctcatattttccatccagtggccaatcagttctcactgtccttactgagggtccaatatgctcttcctcatatgttccctcaaccactgatagaacctcaggcctatttgcctagtcctgtcatttatgaagggagaagaatccatattagaagatctctttttttttctttagttctacattattcataaacataggagggtaacttaaaagaacgtgcaggcccgcaggcacacttaccctcctaaggtgttattaggagacacaagccataagaagcagagatgttcatgcaatagtctaaggattttgtagaagactttatgcttctaatctacttcataaacttcacatgagaaatgtattcagagccaagtaataagaaaaccatgcttattttgagaaatggattgtttctccctttctaataagagagtcatgaaaccacatctcccttttcactttggctaccaggaaacttagagacaaatataaagcttaactataacaaatatagttaatggaattttgggttcttttccaaacccaaaactatccacactttttcttggaacaaactgtttatttctattgtatactgtcacaaatttatgacaaatgtactcagtataaatcaccttattgagatacatgacagaaaaataatgtagatagtaagagtaatgttttggggtttttttgttcttgggttttttgttttacattactgaaagaggctaaaaggaacaagaggtattttccttcccttgtctggagaactgtatatgtcctagcctcagaggttattatcaacttgtctggctaaaggcagaagctgctggatgctaaaagacagcctcatccagccttgaagtgggaggaaaccaactcaaggagggagtaggtcttgagaagggtccctgaggctgagaagggcctggtttctggaggtactgtgagtggtggaggctggggctcttctcacagtgctctggaactctgagggatctcagaagggactagatgctcccagcctgagttctcaagctctcttaacatggaaacagaggaaacactggcttgcagaccacatgggctaggagatgacaagtgtgatcctcaacccaaggagctcttcctcaactcttcagaactgataagaatccctgaggcttttgtacaatcctaggtgaatgggaggactctcaaaagacaggctgaatttcctgccagccctgcaggtggaagcttggcactgactaatttgatttagagaaataaagaaatgtgacatttcttgcaccctacggttgtggcctgaaattcatgcccaccacatgggctataaataaatgaatgaaagaataaacaaacccgacgccagaatgcctgggatgaattcccaatctgctgtgtatgcaacatcagggtcctgtaaacttgaacacacaagggctaatggagaattcagctagcacaatagacaccatctgtggggactgtatgggaagggatggaggtaagaaagccaaagagacagctccagacctcacaaagcttacaattcagtgcagcacgtgtcaataataaaacatcaataagaacagggaccttcatacagccattggcacatttttatgaagcactcactgcagatgctagaaggcaaaaagataaaggagaggattaagataggacccaggggcaggaagagtacaggtgggtgaggaagatatgagaaggggaataataatatgccagaaaagagatatgtgttataaaaatgatttgcctaaagtactatagaaggagagtttatttctgcctgaagacagagaaggctctaaagaagatgaggtgcttgggctgttcttggaaagatggacaggatttgagcagaatggggtggtctgaggggcactgcaggccaggggagatgaagatacagggtcctacctgtcacactcagggctgcaggggtagagtaaaagtttcatcatggctgtccctcatggtacatgaggatgtacgaatgagtagtgatgatgaggtcagagaggtacatgcattggtcgtgggcagggcttgggatcccatgctacggcattcatattgtgaactataggcaagatgatgggaagaaggtgagcagggaggggaaggataagaaccacgctcttgggggtttccttgaattgctgaatgtgggaatatgcatttgaaaagatggaaaagtagtcacgggaaaaaagttaagaagcccattgcaatgtcttgggcacctgaactataatagaggcagaggatctcagagcgaatactggagatgtgagaacattcacagatgtgaagcagagccatgctgaggggacaatgaagaggggagatatcaagagagaaacttgatgtttcaggcctgggtaaaacaggaagcacaggaagaagaggatttagggaaaaatgatgagctcaggataaaatgtcctgaacctaaggtcccagtggaccactctgatgagatgcttagcaggtatcgtatgcagagagacgtgttatataagtgtgcactcagttttatacattctaacctgatctttcaaaactgataaattagtggagatccatagtcatccagcaaaaggattcttcacctgaaaaaaagcattaataacagggtactttaaatagttagctcccctggtgaatataaaataggctttactatttttttaaaggtgacttacacctctcttttcaaaaactcatctattgtgttaagtaaagcatatctatgtatgaatatggaatgaactgggagacctgagccaggtaaagttaatcgaggtgggtgctatgaaagaaatgatgaatcataaagggaatactgacaagatgacatctgaattggtgaagaaaaaagaaggagggctcagacatagtgtggggtctgcagtcaccctgggatgggaagcctcccatagtctcccagctcctctttcatccctgggatgaaactacacctggatgggtggtggggaatccagctccacccacagcctggtccatctccattgatggcaactccatccattcatctgttgagatgaaaaccttggggtagccttcactcccttcctcttccttactctccacatccaatccatcaggaaatcgcactggttcttgcttcaaagcatatccagtatctgactcttctcgccacctccgctgctgctaccaccttggttccagcctccaccgtctcaggcctggcttatttaatagcctcctaataagtctccctccttcctcctgtgctctcccaaagtctatttgcaatacaacagttagaatggtcctttctaaaacaagtcagatcatgtcattcctttcctcaaaacccttgaatggctccccatttccttctgaacctaagccaaagtcccttttacagcttacaaagccatgctggatatggccacggtcacctgtctcacctcacctcctacttctcccctttctcctcatcccagcacactccactttggctatacctgacccttgctgttcgtcagatgctccaagcactcttaacttggagcctctgctttagttttctctgcctggaacatatgtctcccagatatctgcaagactaagtccctcacctccttaagtaagtgctcaaatctcactttctcactcacccccctgtaatgctgtagcctgctcctgcctcagtattcccccagtccatgctctttttctttcttacttagcatttacctttttctgatttaccttgttaactacgcttattatttattggctatcctcccttgctaaaataaaaatgagtggggttttaaaatttgttttactttgtcttgtccatagtagctcctcaataaataaggtaggaatcagttaatgaatgagtgaagaagaaacagtgtagacaaacaagaggggaaaatccacagctcaaggactccagccaaaaacactgtgcttgaagatgggaagcaatggatctggtccctgcaggggccatggtctggctgtggggctccagacaagatattaaaactctctaggatcctccatattacaaggaagggatggatcaggtgatttttttttttagtgcttttccataaattatttaattcattcaacaagtatatattgagggcctgttacctactaggtcctgtgcatataaagatgattaagataccacaccacactggtccttcccacagtccagagagaacgatctataaataaagaatgaaaatacaatatgacagcagatatccatacaaggtacagtggaaccatagatacaacagtgatgaaatcagtggtggggtggacaagaataaaggatgaccagggaatggccctgcagttacagcgtgctccctgcatcccagggaccagcactggaaggccccgccctctgtgctgttgtcaagtttgcaggctgccaacttcatgtactgtactctgtcaaggcacagtgaaggactagcgacatatttttagaagaccctttaatcatccaaagatcaactttttcatgtaattgtttcttcatgttcccattagtaagccttttaaagccacaggttgttatagaaagacaggccttttgtcctgacacatcagagttcccagaaatatttggaaggacacagcaataaaataatacaccactcatctcacccgggccatctcattgtgttcacaaactcaacacactgccctcttaaaataaacacactggatagagctttctttccctgaaaactgaggttcacattcaaagcaagtaatgttttcctcttgggattctcgattattatcatttactgacaccaccaccatcttcacggggacattgatttattaagtgtcctctgtgcctaggatgtaattcagagcaagataaacagatgtgaagtctctccactctaggaacttgtacttcaatactccctattaacagagcacaaactacaaaagattcttctagaaattacatactggctacacttgatcccaagtgcttttggatagacagaagtatagggtagcagctatactacgggtgaggtgactcatgcctataatcccagcgctttgggaggtcgaggtgggtggtttgcttgagtctaggagttcagaaccagcctgggcaacatggcgaaattccatctctacaaaaatacaaaaatacaaaaattagtggtgcacacctgtagtcccaactactcaggaggctgaggtgggatgatcacttgagcatgggaggtggaggttgcagcaagccaagactgcaccactgcactccagcctgggcaacagagtaagactccatctcaacagaaaaaaaaaaactatagggtagcagatccgtcaggcatggggaattcaaaccagctacgttcacaggaaagcactgtctgggaaaacttcagaaaagacttcaagaggggaggtggaggcagaggtcagatgtcaggatccatgtgtataaggggtacagaagaatgaccaggctgctcagggagagggttaggtataaggtgcaggcagggatgagactactgaaggatatgagcagcatccatgatctggggcgttcaggaagatgagaaaactggcccaaaccttgaacttcagaggccttgccatttctacatgtctcagaatcaagagaccagctgaggtttaacaactgtggtgccaagctgagctcagatgtgccaaatgaggaaacactggtctctaacatccacacactgaggtgtccaggtacactcacagcccattaatcaaggatcaaagtcttttcaacttctttttttggacaaaagataaggatggacccaggaggaacttccatgacccctcccccattttcatatgctgattttattttattttttgagaaattcttgctttgtcgcccatgctggagttcagtggcgcaacctcggctcactgcaacctccgcctcccgggttcaagcaattctcctgcttcagcctcccaggtagctaggattacaggcacccacaaccacgcctggctaatttttgcattttttgtagagacagggtttcaccatgttggccaggctggtctcgaactcctgacctcaagtgatctgcccgcctcagcctcccaaagtgctgggattacaggaacaagccaccatgcctggccttgataagccgattttaactggccatttctccctgtttcctgaggttatcaggaagcttaaagtaaaatgtaaaattttacaacaggaaccatatgaaacctctgtggtcatctctgtctgctcttaagttcctactctttttcacctgtatctcttattctatactatcatcctgttaccactgctgcacaggccactccaatcctttgtggaataaagtagagaagagtaacaacaacaataataatattaaacttctattgaacaagttatgagcagccattgtgctaatcacttttcatggattatcacactcagtcctcacaggattccaatgaggtaggtgctgttaccatccacattttacatataaaaaagaaaaaaatgagaatagaagtttaaatgtgctgaagtatcagatatggggtttgaacctaagttggctgactctggaacccatattctttttttttttttttttgagatggagtctcgctctgtcgcccaggctggagtgcagcggcacaatctctgctcactgcaacctccacctcctgggttcaagcgattctcctgcctcagcctcccaagtagctgggattacaggtgcgtgccaccacgcccagctaattttttttgtatttttagtagagacggggtttcactatgttagccaggatggtctcgatctcctgacgtcatgatccacccgcctcggcatccctaagtgctgggattacgggcgtgagccaccgcgcgtggcctggaacccatattcttaaagtactacacatatatacatccaggcccaaaatactctgtagggcattggtgggaacattgctacattatgtagttggaaacttatgaatgtagtatggaaacttatgataactacctggcttttgaacaatagtttgcagtagaggtcaatggcctacagaccaaatttggcccatagatatgaattatcaggaacctacagtattttttttaatcaaatctaatttcgttttccaggtctccccagtgcccaccattcttcactgcctggctcactcatttatatcactcgtttcaagttcatggaccttgctttagaattttcaagatattctcacatctatcagctcattcagtctttgaaatgttcctacaagcgaggcaacacagaaatcaaaatctccttttacaggtggagaaactaaagttccgggcagttgaactcctcatgtgggctcaaatgccaagaagtggcttggctggaagtagaacctcctgtgtggggtgtaatctcacagcatagatcaccttccccacagaaccctgaagaacacaggttgcctaacagcagtgattagcaggggagtgcatgctcctctaggagaacatagaccagggcttgacagcaggtggttgagaacaggggctccaggaagcctcacctgtagccctgcccccattcccaatcagacccagcaagccatggtgggaagggaagtaggaaacccctgacatgatatctgcgagtggactgtttgccaggcttttctgtggtgtggcatcattccctggggaagtgggttatcctgctgggagaatcctaattcatcccaagcctcagatgctctcaccatcctcaggtggctccctaccttacaactttaccaaaagacagggcatcccagggccacagattcccatttggagctactctctgggcctgaagagcttcagaattggtcctttctgaggaccctgtactctgggagatgatggacactacaagcaacatttcttaggccccaaggcattccctagtctcccttccagacccaaagtcatgagactctgagctagtgaccttgaggggttcctttctagaagaggaggtgcactcgagcaagggttctcaaatgtagctgcacattgggatggcccaggagagcattttcaagacatggattcctgagccatacccaggatgtactgaatcataaactctgcaagcaggtcctggaatctgcattttcactagctctgcaaatgagttgtatgcctaaagggacaggctgggatggagtcttcttcccagccacaaccacaaagggaatgacacacaccaggagctgtggggtgggcaccgaagctggcccaccttccttcaactccaggttgtttcaatgccggtacccagcctgtcctcaacagcatcggctcgcagccaagcaccagttccctgggactccagcttagggtccataagatttaaaacattttaatccaaagctgctgagcaggtgagacgcttccaaatgcccaacagccagctcctaccactctgagtgaaaagggccagacccgaaggccatgaaaccatttgccctgagcccagaaggggatgtgcagagtcagggataaccccatcacctgcaaggaccaccaggtatatgtttttcccacaccaggattggtggtataggggtaggaagcccatagtggcctttttgcttactttctgttaggaactgaagatttggggccctgctggctctgtggcttttgaataggggacacagaaatgcctaaatgtgcaccagccacttctccccatgaggagcctgatcaggtagttcagcaaaaggaagacagggctctacttctttattagcagacagtcctaatggtggtggggttgcaagactcagccaagaagcctaaggctggaaagacctctccctggaagctaaagtgctgaatggatagattcttgggagcaaaaataagacagtgctggagataaccaggccctgggactgcctccccacccccactcctgcctcccctgcctcccctgcctccccgcagcagcaatttcagcatcctcctatggagttctgccatcacgcctctgggctgagctgcccatcagaaccacgtctcacttctctcccctgcccacatgatgtgccaggagctctatgtgacccccttgctctgtgttgctgtcattgccctcttcattgtaggccaggtcaactccctatcccaaaccccagagaagtgccccacgtccttgagatcaggaactgaacttgacttccctaccactcatcaggattcaagccagtgccctgtgcctgaccggctcattcccacaggtgcccgtcactggccaaatgccccctccaaccttcagttccacctctgttcctttccccttgtcctgtccagccagctttcccttgtgaatgagaagggagagagcatgttgccttcagaaacctccctttcttgccttgcaagtccctcgaggtcccgtaacgtatatttcatctagcgattctctacagcctaacaccttgacccacttgcatgctttctttgcagtcctcatctgctctactacagatgtggcctctgtctgtcttttttggtgtcatctgtcttggactctccttctcaggggtgggctctgtgtcttcagctcattctatggtatcccatgcaagctcacacttactaaatgcccaaagcaggaatgatttttgctcaagactacccagaaagaagacccgaggctcctcagccatctccaaagtccagtccagtgttcagggctcctgaacgctcccagccagagctgagctggctcagctgttcagctccctggtcaccaggggacactagctacctcagaggagaagcaagtggccactgtgcctgctgggccgggacatggaaccatcctggaagctcaactgctggccctcaggtcatggagaatcccaagactcatcatgtgtgtggcaggggtgagggtggaggtcagaggttgggggagatgtcagactgggagatagaagcagccacagggaaaagcaggaagggccaaggtaggcagctcttctcagagcagcaggccagcagcctggctggaaggaggggacccaaccacaaacttgtggcctatgaaatccattcccccttcactggggattctgctcagcccttcctcactgattcccttctgactgcacattaaactttactacaacgcacagcttgtaaatggcattaaaacaatttacagcagcctttatgtgccttggtttaaataataaacatttttatttcactcttctgtgaaatgaaattcttggggggcaaagtatggaaaagtatgggaccaggaggtaggggtgggagggccaaatgaacagaaaataaatacaatgggcagcgatggggacgtgtgggttcccagattctctgaccacaaagagcttgtataccatgtcctggccactcggggctttggtggccagagtcctgcgccaagaaaaagcagaagtgaaccacatttgggatgttctagctgtgggccagcatgactactccttaagtggaaatcattcaagctcccaggcctctcgctaaacctgaagcatcagcaacagccagcttgttactttccttaactaatgcctttctgtttcctgcagagtaaacaacttgatcccattagttgttgtaaaatatttaccaagcggccgaggcggctcccttcttcccagcacgtaagaaggtagagagccctgggttaggcctctgaacacagatggacaggcatgaccagcagcttccggtcagtgtcacgtagatgggggaggagtggagggaggactaaaaaggggcggagtgagaaggagcaagtgcagacagacaaagcctgcctcgaaagggaaggagcactaaatgcaacgtgggggcctggatcagctcctgggacagaaaggggcatcaggaggaaaactagtaaaatctgaataaagtctggagttcagttaacagtgaagcatctgtgctggtgttttacttgtgaccatgtgctgcagtaacctaagatgacaacgtcagggggaactgggtgaggggtatatggaaactccctagtctctttataacgtctctataactctaaaattattataaagcaaaaagttttttgtttttttttttttttcaaatagcaaatgtgctatttggaggtgagggattctccatgacagctgttggcatttggggatagcaaaatacccacaggggacttctctgtgtgggacctcactggagagacagcctgtgagtcacggccaaattataactaaagtggaaagggcaggaaacagagaggggcgttcttcccacagagatgaagtcaaggaatcaggccaagagatgctgcgccacctcggagaaaccaccttcagggcaagaaagttcgctggatggaggcaatgaaatgaacagggtggaaaacctgacttgctgcatcgcccccagatttctgactctgggcacatgtggttacacccttccttggccctctcctcatgcaggcaacagtcagggactaacaggcccagcggatcaagatggtgcagagggaaggcatgacggtgaatgttatgcatccaccgggctaggctgcagtgcgcagttgcttggtgaagcaccagtctagatgttgctgtgaaggcattcttagttgtgattaacatttgcaattagtagactttgagccaagcagattaccctccataatatgggtgggcctcacccaatcagttaaagacttaagagcaaagtcaggtttcccaaagaaggaaaattgcctcaaggctgcaacacagaacccctgtctgagattccagcttgccaggcctgccctacagatctcaagctcaagactacaccaactcttacctgcccttccagcctgctagccggacctttggatttcagagttgccagtccccacaattgcatgagctaatgccttaaaatcagtccagctctctctctcatactggctctgtttctttgaagaaccttgactaataccaggcaagccgagggcctggagatcatgggcagggatcagaggccccttctctgctgccctgctgtgactgcctctgtgggttcagggactgggacaccatttactggggcttccaccgcttccttgctcaatcaccaaaataaagccttcacattgactgtcttagaggatgtctttccttgtactcaaaagtgacagcaaatgacaaagatttcggaaatagcttggtggacatttccccctcccctccgcccacccaactctcattttcaacttaaaaacatgttgctcaacttcctgcccagttgtgtgagccctgggctgacagcatttcctcagtggtgaccaaaatgtgccacctgccaaggagataccccactgagtgctgagctacccgatggcgctccacgggaccatcctgctggaagaggctgataatcctgaggcatcccttcacctgaatgtccttggcagcaaagtcagaagtagcacccaggacactgccccctaccccctcccgtggactctaagctgacctaggggtccagagatctaagctgcagcctcagcactccacatggcaccaagtccttgtctccctgtacttctgtgagccttggtgtccccgctctacaaagcacagaaccttcacctggcagaaacatatgtgacccttacagctgggtggatgacagcagagaggtcacatcctaggggtcactagggcataccctagaggtcaaacaacagagtgagaagctgggcattttccagggctgataccacccgcactcaggacactttttcaaagagcagcggcctgctccccacggaagcctggcctcctgcgggacaccagagcatccttcctctgctcagccaagacaccccttcccactgcagcagcctggcactctagctcctgccctcagctcaccactgacccaggagggacatatcctcagggaggtgggagagcaactccagcctcaatcagcctccactgcacaggacagcaccggcggcaggcgctttagaaatccagggcctctttgggagcttcttttgccttcaagtgaggactgccagatttaacaaacaaaaatacaggacacccaattaatttgaatttcagatcaactacaaaacatctcatgcattatttgagatgtgtaataaaaattatttgttttttctctgaaaccgaaatagaactgggtgtccaatatctcatctggtgtccctcctccttcaaaaggaggagagccgtgagggctacagcatcagtccttgcttgtcaccagcctctgagtgcctagtcccagttcctcacagctggagccactcactcagcccggcctaaccctaagctgcggcagaaggggtttaaccagttctggccccacacgaaagcagagccccaggctcccaaacagctcacttgcccccaagccctagtcttgggtggcattttttggacctatatgcctgtgctggtgttccactgggcacttcttcaaggcccgggacctgcctgataatgccaggttctttgcctgtcctcatatccactgtctgtaccccaacataataggtagagaaccctgactccggggggcagtcagtcacttcatctggtagatctgagactaaagacagttataacgcctgaaccctgcacttacaggtgccaactcacccgctagcacctgcagctgggtgaacacctcacccaagtaagtgggactcttctcaaaccccagtttttccccacccgccctgtcatgccctcccgtcctacacagctccaaccccgatagccatggttcagatcttagctaagtctggtttttgatcaagaccactcttcaaaataaggccgacaaaaatgcaaccagggaccatgccacgccagaaatcccaccacttcccctgaggcatctgctccattttttagcctgaatcccaggatggtcctgccgccactaaaaagcagttgcctgcttccattactagattctcctattgctgcttcccaggagctcaaagcccacaaatacttagcttctgattagacaggtttcttcaccacctcggcatccatgctttctaacgagagacatagcagggcatccatattttactgaggactaaatcttttcttctcatgctggtttttagatcatagcatttaagtctgatcaaggctggtaagacccttctgggcttctcttaccagatcttacacacccttgagcccctgccatcgtttggtaagaatcccacaatagtgtagttaggcaaaacccaaggaaagcaaaaatccacacagttcattcattcagtcattcactcaggcatgcctcctctgtgccaggcactgaattaggctctgtggctatcagggagagcaagtcagcatccctgcctgcaaggagatcacacgttacttagggagacagtaaaagtaaacaggccacttcgaggaagtccagtgcatgctttgatcccctgggatgagctgtctgcttaatggctgtactgatttttttcaaaagtagtttgcaataagactgaaatcacacttacatatgtgtgagcttactctggccattgtgccaatgccatcaaagatgatcttagcgtggctgactgctacctgtcattccagtctcatcataaatgtcccttcctctgagactctttccccagctgcctgatctaaagtggcctgtccctccgtcctcatatcctgttttattgttactatggcatttgtccatgtctgggcttttcttgtttgttcatctgtcctccactgagagcagattcttgtccatcatattcaaccccagaacccagcatagcgcctaccccattcaactttgctgcacaaatgaataaacaagtgaatgaacagaaagaacactaaccctgtagttcccaacctctaggggcccttgaatgtcataacaggtcactgcaagctattttcaatatattccaaagcctaacaggcttcatttgtttgcttatccttgataaagtcccacaggagaaacaaaatgtcacatttctttgcctttgactggaatgatatcaactcagcattaccggtccccatgctaatcagaaactgtaattagaaaatatattttgattattaaaagtggaaaaacaaaagcatcataacatcagagccatttatttagtgggtaacatctttcaacacaggaaaccacggagcaaaatatataaagaactaaagggttctcatgggagagaagagactgggaatagcttcctatttcctgggtggctaggctgaggcttgaggtcatacagaggaaacccgggccagagttcagtgcattaaaccatctgaacaaaggaggatgtgactaggccataaaaatattgctcataaaagaaatcatgctctagagaaagagcaatttaaacgaaagctggaattattattcgcagcacagatactgtgtatctgcaggctcgctgctctcaaatggatcatccatttaatgctggcaatcttcagaagcactaatgaagatctggaaagtgtaaacccatcagtggggcgccagcatactgcttttcatttatcctaatattttaaagaacataaatggcatgggcacttatccctttggaagttctgacctttgaatagcactttaaacgcttcaattaaaggcactatataaaaccacagccttgtcatttcacttgatcaaatgactggccttggaatgcaaaacttcaggggaaaaatagaacagtccaggtcaactgggactccagttactggaggccaaaggggctgttatgctgttatctaatctctgagctctggtgtgcccctgctaccgagtgtctgtgccactgatccaactagggcactgggtcctggaaggagccccctgttataaggagagggctttgagcaggctcactgaaaggagagaggatccccactggccagtccttggcaacggatccctagagtaaccacttgaaaaggactgaacagtggaaacgttacttctcctgccttccagggcagtgggagaaagaccctgctagtacggtgactggctgctttatttctcttatgaaaagtagcccaaccagagaggacagcagccacagctcagcctaacaataggacctctagttatgctgaacaggagcaagaagagacctagacagcgctaatagcaatgattctccccacttgcattctttcaatccaaccagcgtgcaacttggtttagaaaattaggtatgttgtttaaaattcaattaaaacttcaaacttcgagtcaaattaaaagtcccaggggcacagggaatctacagcagtggttctggttctcaaacatccgtgtgccccaaatcacccaagaggctcatgaaatgcagatccccaggccctgctcccaaaatgctgactcagcaggactgagggggacactgtgggagcctacattctaagaagcttcccaagtgattccaaagtaggcaggtgatgatgagtgggtcccactttgagaaaatgccaagttgaaggtgatcatcttctggtttaccattgtccgtttggtaggttcgggctcatctgtccccactctcctttctcgggacacttgcctcagaagtgtggtcatgagaaaggatcaatatttagatcagtaaatccagatgcagaaagagccaaaaaccatctcaggcgtactcctggaggttggtccaagatcctcagcctcagggcatgggaagccactggccagacattatgacccagatcactgagccatcactcaccacaatctagtacctatgattcagatcaatgtaccagggtctaaaatcatccagcccaggggttctgggtctttcgtgtgcacctgccatggggaggcctttacatcccttctcagaatagcacttataaatgcaaaaaacaagatgcatagtattataaaggacacaaattatattgaaatcgggtatttcaaaatattttttaaactcgtgatatagtgatacaagtgtttcttcactgatgcattaaacaagatctagcagcaggtctaactgctgcagtttcaaggtagtgacatgataaaaacagcatttcaaaatacttgcaacactacacacgatcgcaaacacatggaatcaacttaggtgcccatcaacaatggattgaacaaagaaaatgtggtacatatacactacggaatactacacagccataaaaagaatgaaatcatgtcctttgcagccacatgggtgcagctggaggccattaacctcagcgaattaacacgggaacagaaaatcaaatctgcatgttctcactgataagtgggagctaaacactgggtactcatggatacaaagacagcaacaatagacactggggactactactagacaggagaaggagggaggggacaagggttgaaaaactaactattcggtactatgctcattacctgggtgatggaatcatttgtatcccaaacctcaccatcacacaatatactccatgcagcaaacctgcacatgtgccctatgaatctaaaaagttgaaattatatatatatatatatatatataaaattatatattatatatacacgtatatatatgtgtgtgtgtgtgtgtgtgtgtgtgtatatatatatatatatatacacagctgttgcaggtatatatatatatatatacacacacacacggctgttgcaggtatatatatatatataccttgtgtaaatgtaaagctgggccaagcctgggagactcaacttggcagctacggcaccaggcctggctctaggaccacatgaaaggcaacagcccttctcacagtcacccggaggaacaatgatcaggtgctttactgtttttattcatccagcctgaaatcaccatgtggcaactacactctatctgaaagtggataacactaactcagcttagtgagatggcaatgggcccaatgttgtctgctgtcaggcttaggtctgcatgatggctatgctcccttggccccttcccccatacattctctctgaccttttccaccccgccctgagcctgggaagctgagcactactaacccatcccctggcctctcagccctctggcttagggttgggttgagcctcagctggttggaggcacctgcaggagaccttcaggagggaggaaagaaagactaggcatttactcctcacctcctgctcaacaccgcaccctggtagttacagctcctgtcggggacctctgccagggctccagggtagctccctccaccagtaacactattccctgccctgcccctcagccctaggtggtaactgcttcctgctggtgttagtccctgagcatattcccttacctttgccaagagagctttcaaaaaagtcctttccatgaaagtcccctcagtcacacccactgcctgcaacagctgtttcctacaggtatcccactggcacaactcttcactagctatataacattgagcaagtcatttcacctctctgagcctcagcccctgacccgtgggaagggaaccacggcacccacctcccagcgggctgggctgggcgaattaggtgggacagtgtgcgtcaagcggagagcagggtgcctggtaagggcgttctcggtgagtctgctttcattgcaggcaggtgctgggctctgagaacaggctgctctgcagtttattcttagtaaacacacctaggacatcctttgatcatcagggtcagaatcatctagggaaggtctttgggtggactaaggactccaagacctctgcccacagaagcactcagcagtcagtgggccactccccagaagaagaaaggaagacgtcaggttgacctcaggagagagagagaagccatgtgggctcagggcactagatggtactgctagatttactcatttacctccttttccactctggccaagaatccccacatctggcacatgcacagacctttcatacacaacgtcccatgacatctccacaacattataatgtgggccttattacactacttattttttttggatgagacaaagttcggagacattaagagaattgtccaaagtcaattatctgccaaatacgagaaccaggctgagttctcaagttttctaagcaatatctcaaattctttttcaatagaagatgtaagatagcagatacaaatggctcaaccaaaaccctgcccttcagtagttttaggctagagaggcccttccactgagaaacagaaaaggcattgaagagatacggtcatctgcctaccagccattgagtgtctgtggtttcaatgtgtaatttagtgaaaataatttcagtaaaaagcacacagataaaagaaacatctgtttaagcacaagttggagggttgaaaagctgaaccccctgatttcccaagggacaatatttcttaagccttggttttatagggaaaagtaagccagtcttgtggctctaccctccttgcccatttgtcattaatgaaaaaacagtattagttctccttgaattaagaacagaaatcacagcccatttctatttctaatagaaatagtcaatgctttatgtatccatcctaaactgttacttatcctgaataaatactctcaggaattcaatttgatatcaaatatatggctaatgaacactatgatctgaacatctgtgtccccctaaaattcatatatagaaatcctaacccccaaagagatggtacgaggaggtggggccttaggtcatgggggaggaaccttatgaatgagattagtgcccttataagagaggcccaagagagctgggcatggtggcacatgccttgagtcccagctacttgagaggctgagcaggaggattgcttgagcccaggagtttgaggctacagtgagccatgattgtgccactgcactccagcctaggcaacagagcaagacactgtatttaaaaaaattaaaaataaaaatgataaagaggcccaagagaggcccctcaccccttctgccatgtgaagacacagcaagaaggctctgtgtatgagccagaaagcaggtcctcaccggacactgactgcttgatcttggacttcccagccttcataactgtgagcagtacttctgctgtttagaacccacctagtttacacattttgttatagcagtccaagcagactaaaacaatgccaaattatatttcccctactctttcaatgggaattcccaactctccttgaatgtttagtatttacaccatctcaatccctttccgctccctgcactagatacatttcacagtcattaattcctataatcagctgagaggaagaaagatgttattagctgtactcgacaggtgaagagaccaaaggcaggaaggttgcatagcctgcccagggtgaggaggaaaccagtaccccagccaggaccggaaccaaggaggtcccaggtcatggttttctctgccaggctgagcagaatctattgtgaccattcagttttccagactatctccacccaaaaggaacaagtcactgtggtctccactttgccaaaaatccacataagatccctggacacacacaagcctaccaccaaggactttcttcagaacaagccctatttaacttaaacagggccaatgtcccactcctgccacagggaaaatccttcagcggagggaaagaactgattatacactcctaagcttaataggggaaggcaattccattctgaatagactgaatcagccttcacagaccatggggaacctgttcataaaacatttgctaaccattaactacagtcctgctaataaatgctgtaatagcagctcctcagaactgtgccccgccagtctagctgcacctttaatcggctagcggctgtcaacatgacaccaggggcccagccatggtgcagctggggtgatgtgtttaaattaaacagctctatcagttccggtgcttggggcccagcaggtcacctctctccaagggaagccagtgaggggcccgaagacagccaattctgcagaaccacctggctctcttttgcattgtccttcatcttgccagtgctccacccagccaggacttttctagggaagccccaggacacagcagtgtgatgggcttctatggccacaggactgacggaggctgctttctgattggcacactttcttcctaggaggctttgaacagaaggcaggacttcctctagttcttccttctgcattcctgatcttcccttctctttcctttttcattgttggtgtttctcttctgccattcaagtgatccctggatcatccagccacagccaggcagtcagctaccacccatgaacctggccttcttcctgagctcaaccccttaccagacatcccatttggatgacctatagatgcctcaaactcaactcatctacaacctcatctccacctcccataaccaaggtgctcattctccacccaactccaatttcaacagcaagcaagttcctgtctccatccagcttctcaaaccagaaatatggcctcttccttaatttctctttctcgaccatcaaatctgttataggtttattaattttacttccaaaatctctggcattcaccccctcttcctctctctcatttaaaataaaatcatgccaccacagtctggcttcccacgatcactcccaaagacaactgagccccctttttcctcactccaacatgcagtctcaaaaatactatcagagtgatcttcctaaaaccaaacaatgaccataaatttcctaaaactgaacaatgaccataaattttgtggaaacaaactcatcatcctgtagctcatatgccctttcccacttggtctccaaactctctgaccactatcacctccaggtactttccctaagaaacctgatactccaagtacccccagaccactgtgcaacctcaagaaaaaaggtaggctcagcaatgcctgcaagtgttggctcatgctatttcccctgccgagtatgttctttccattattcctcatcctttaaacttagttccttgcccttttcagaataaagtccttgcagtctatcctccacctgctgagaactcattaccacatcttataaccctcccatcctcccccaggtgcctactgctaccatgagcactgaataacccttgaagacaggatcacagtttacatgtattcataccccggcatttaatatagtgcctaaaacagtttcaataaattctttttgttgtggttgttgtttttggaatcaagtcatactaattttttttattttactttaagttctgggatacatgtgcagagcgtgcaagtttgttacataggtatacatgtgccatggtggtttgctgcacctattaacccatcatctaagttttaagcaccgcatgcattaggtatttgtcctaatgctctccctccctttgacccccacctcccgacagaccccagtgtgtgatgttcccctccctgtgtccacgtgttctcatttttcaactcccacttatgactgagaacatgtggtgtttggttttctgttcctgttagtttactgagaatgatggtttccagcttcatcaatgttcttacaaagaacatgagcttattcttttttatggcttcatagtattccatggcgtatatgtgccacattttctttatccagtctatcattgatgggcatttgggttggttccaagtctttgctattgcaaatagtgctgcagtaaacatacatgtgcatgtgtctttatagtagaatgatttataatcttttgggtatatacccagtaaagggattgctgggtcaaatggtatttctatttctagatccttgaggaatcgtcacactgtcttccacaatggttgaactaatttccactcccatcaacagtgtaaaagtgttcctatttctccacatcctctccagtatctgttgtttcatgactttttaatgattgccattctaactggaatgagatggtatctcatggtggttttgatttgcatttctttaatgaccagtgatgatgagctttttttcatttgtttgttggccacataaatgtcttttgctgagaagtgtctgttcatattcttcacccactttttgatagggttgtttggttttactcttgtaaatttgcttacgttccttgtagattctggatattagacctttgtcagatggatagattgaaaaaattttctcccattctgtaggttgtctgttcactctgatgatagtttcttttgctgtgcagaagctctttaggattagatccatttgttaattttggcttttgttgcaattgcttttggtgttttagtcatgaagtctttgcccatgcctatgtcctgaatggtattgcctagattttcttctagggtttttatggttttaggtttcatgtttaagtctttaatccaccttgagttaatttttgtataaggtgtaaggaaggggtccagtttctgttttctgcatatggctaaccagttttcccagcaccatttatcaaatagggaatcctttcccctttgcttgtttttgtcaggtttgtcaaacatcagatggttgtggatgtgtggtgttatttacgtggcctctattctgttccattggtctatatatttgttttggtgccggtaccatgctgatttggttactgtaatcttgtagtatagtttgaagtcaggtagtgtgacgcctccagctttgtactttttgcttaggattgatttggctatatgggctcctttttggttccatatgaaatgtaaagtagttttttctaattctgtgaagaaaatcaatagtagcttgatgggaattgcattgaatctattaattactttgggcagtatggccactttcacgatattgattcttcctatctatgagcatggaatgtttttccgtttgtttgtttcctcttatttccttgagcagtggtttgtagttctccttgaagaggtccttaatgtcccttgtaagttgtattccgaggtattctattctctttgtagcaattctgaatgggagttcactcatgatttggctctctgcttgtctattattcgtgtaagtttcaataaattcttgaaaatgaattgcatttctccctggtagtacctaggtatataattttgcctggatggaaaagatttgagaaggcagccctacagaggggacttccaaataaggatttgattctcatttcatcctgttgggcagagagtttgcttttgcagatggcaaagaaggagagacagcaaggctcatgtttggctccaagagcatgcagagtagacatcacatctagactggtggctattggctctctctcccagacaagctgctgcaaatgcttgatttgagtagggatagagactgaaattcaactgggtataaatctgctattgtgttcctactgtgtgcaggcacacaacttaaatgtaaaagaatgtctctgcccacgcagctgtcactggctcccaggaaagtccagtcacagacacaaaactgaggagaataatataagatggtaaatttttaaaatattagatctagaaactgccttccagtcaactatcccagtgctttccagacctccctcagaggcctggagtctgtggttgtgttgtcccaaaccctgtccccgaaaaccaaaggaactccacttttacccagttcatatctggggactaaatttaactaaagggactccactggaggaaacatttgaaaatgaacatctattctaattcccttagattattccatttatagaatacccaagagtggatgttcacaggccaaaatatacaacacaaatatatcgctgatttcggctgggctggcagaagtgagatcatcctattggatctcgccagacacaagtgcacctgagatagacaacagtcatagctcaccatccaaacaccactacctgacattgcttctcggaaatggctctgctctcaataaatccaataggggaaggtgaaggggactggggaagaaggagtaagtatattttaaaactacatagccaggtcttctcctgggaataactttcccattgtctgtattgatctccagaataaacaaagatgagaagggaaagagtggtaaaaaaaactcttcgcacgtttaaagtgatttgtctcctccctccttgctggcagatgaagcgctcacactttcaggctggctgagcttctccttgggtgatgaaaagtgggggagatggaggagtggccagaagcaggccccaaactggtctcttctctccagatcagcccagaagacctcccagctctgttcacccacagaatatacagcccagatatccatcttggtcctttattgtctactcattggttttattattttaaatattatgtggatgcttgaggtctccagagccctgagggcaaaggtgatgtctgatgtttcacactcttgcctcaagcctcccgcttcctcactcctgctctactgagggctgagatgatggtggaaaaagcactcctgtgggtctgtcccagtccctccactgatggaacagtgatgtgaacttggacaagtcagtagcgctctcagagatccattttctgcatcagaaaaacggggagaatacctttcaggaaagtggtaagaattaaggcaaattaaatgctacaggtacagcacgcagcttagtgcctggcaaagatgagcagacaagatcatgagcagatggcatcatgctggggaggggagtcagggccagcaagaggccaggaggagggccttggaatgggcagatgctgctgctgcacaccttcctgcctggtcaacttgatgatggtccggcagggcctcagatttgcagactgtattgaaaaagttatgtgtgacttgaagcactatggaaggcatcacattcaaatcgtgctggggagcctctgaccttgagatagaccataactaaccctcctacaaatccctcctgccgggtgtctgaggagaatgaagagcccagcagaagtcaagaggcagacctgggtttgagttccagctcagaatatattcatgccttgtgacttacctaagtatcccccagagaccatccaaaaacttaacccatgggaagacagtagggcacagtaacaagagtacaggccttcgagtcaggattccaatccccgccccaccctcttcctacctgtgtgacctagagcaagtggctcaacttctctgattcttaccttacctcgcctacagggctgatatgtgagagagatgagatcatagctgtaggtgcccagaggaggaggcatacatgacagggccctttttcatggccctgttgcccctttccatcccatggaggttacattctgagtgtgcttgctgttccatgctttgcatcggctcctcagctgagctggttgtaggcccccccagaggccagggcattaccattaagggagaccgatgaagaattcctagcagcctcccagctgtagagcacccaggtgcctgtcagaagccagaggagtgaggctgggcctcgacagggccattactcacccacaccaccggagactccagcagctgcgaaagggtgcgggggcggggggcgggggggtggtgtccagccatctttaagggtctgggtttgctcgtgaaaaagaaacaaggggcttatttatgtcactcaggcccagtgagcagggaggggccgtgcagggaagcctttaatgagcactcttccctcagaaatgctgacaggagttggacacgaagtacatctcggccaaaacatcatcatccccaggatcccagtggaaagataaacctgactgcaaatattggtttctgtgaagagccggagcacagagcaggcagcccccagggctcagctgcaggtgcacagagatgcccgcccaggccaacactgccaccactgagagcaccccccaccccccaccaaggccagcctgctcccacggtgccacacaatgccagcctcctgagctgggctgccctccagaaacagaaaggagaaatctagtcacatagaaagctgcccaggctgtggaaaatgcaatttccagacccagccaagctgggaaaggggcaggctgctgcacacccacctacctcaccccgacattgcccaggggcctggacatcagcctttccctaccctctgtaacaccagtgacacagtgggaccaggacagccttcctcagccaaaagtctccttttccttcccccagcagtcttggcatcatcatccctcagtgaccatagtatctgccctgccattacctcccgccagcccagggtcctctctccccatcacccagcctccctggccttggtccccttatttgtcacataggcaagggcagggggccaaacaggagattcccatagtcagtctcagtgctctgtgctgcagagaggaatggcagcaggaacctctgaacttccagccatgcagtgagcccaggagcaaggggtccatgtccccacgggggccaaagagaagatgagtgcccctcgttaccctagagaagccctgagagtctgggaatgccgtgctgagtgcagaggcacaggggtcaccgagagactcaggctgtcttcacgacatccccggactttgcagactttgagcatcctcttctgagccggttttgtgccggcagagggtgcactcactcaggaaagcagggtctgctcaggacattaggtctgctgtaaaatagggtccctggctctgcccatggtagctccatgactgaggtggctttccatgcctcagtttacccagtttcaaagacaggagagcctacccctctagcagagggaggacttaagagttggagccaacttgcacagcaaaaataaacctctgtcacttccatacagcgctctgcttctaccactatcagctcacttaattttcattaaaatgttataaaatgggcatgtctcaccccattttccagacaaggattaaggctcagaagggctcagggacttaagtcactcagtggctaaggcgagtcaggtagtctgggcatgcacaccgttactcctcctgtgacctacagtcttggggaggagcaggcaggaaggctggggacttgggcccctcattctggaacctgctcttccttcgtgtgggccttgactctctttctctgtacctgaaacaaagctcaggagccaccccttcctcctgcctcaagacagactcttatcctttccccaagccctgcccagaaagggattccaagtccactcccaaaactggaaactctggtcagaaccctggagcccagaccagcagacccctatgttccagttgcttctgagagaaggcagctgtagacttaaaaaggtccataattggctgggtgcaatggttcacatctgtaatcccagcactttgggaggccaaggcaggtggatcacttggggccaggagtttgagaccagcgtggccaacatggcgaaaccccgtctctactaaaaatacaaaaattagccacgtggggtggtacacgcctgtaatcccagctattcaggaggctgaggcaccagaatagcttgaacccagcaggcgaaggttgcagtgagcccagattgcgccactgcactccagagatcacgccactctactccagctgggtgacaaagcaagaccccgtctcaaaaaaaaaaaaaaaaaagaaaagaaaagaaaggtccataactaatagcaaatgcattttgaatagtgcagagctactcctgttctacctccccctgcaaagaagccacactagagacagttctgggataacctttctgaacagagcagctcaccactgccccgtgcagacagggcaacaatggggcccctaggtgtttaagatgaggctggaggactaataataaagcagaaacaaaacaaatgtccctcagctgatgaatgggtaaacaaagccagcatatccatacaatggaataatatttgctaataaaaaggaagaaagtactggcacgtgctacagcacagatgaaccttgagaacatcatggtaaatgaaagaggccagccgcaagaggccacgtattgtatgattctatttatatgaaatgtccagaataggcaaatgtgtggagacagaaagcagattagtggattagtggtcacctggagcggggtggggcatgggaattgaatgctaatggtgcagggtttcttttggaggtcaaagatgttctaaaattagattatgtgcttgttgtataaccctgagaatacactaaaaccattgatctttacttgtcatatgggtagactgtatggtatgtagattatatctcaaaaaagctattttaaaaaataaaaagatgggatcgccacctttatctttcttctatagagagggacagggaggaagctaagatctcaggaacagcattaaacattctagttatttaccacaaggccacttaaggaaggtgacattctgtgtttgtgagagtgtacttgtgtacacacaggttagacagtctgaatctgccctctaatcgctgtatttatcatttattgcatccctgttacgtagtaagcactttgcttgtatttccccagttattcttcacaatagccctaggaaggaaacactgttataatccccattttacaaatgaagaaatggagtctctgagaggttgaatgaatgtgatactttacccagggatgggcagaccctgagtgccggcaccctgggatttaaacacatgcagtctgtctccagccttcccttttaaccctgaccccaggagccttcatttatggcaactcaggatcacaacctccccggagcagcagggcctgagcttcctggaggcttgacacccaaaagtaaaagctgaactcgcaatagaaagatgtctttttcttcccaagaggccttgggcaacaacgagatggatttccttttaaatgactgtccactgttgtgtgtgatagctctttggttttatctaatcctgctcagttcacgttactgctgtcatttgtctcctccatctcgatggggtgatgaactgtcttgctcagtgagaagcaggcactgagacagaaaggaaagaaatgcatcaaagctggcctggaccgagagaagaggaggaggatggcttaatcaaccgggggcaaagtcacaatccttcctgtgtccgcttacccccaccctccgagtcccatggagcatcctccaagtacctctgggagaaaagagaagaagccagaagccaccactggagtgatgtcccaggaagctcactacctcatggcagggcatacagtgggatccctcgaccaaggacttcttcccaggttgaccacgggctattccaccatctactcattcacaaagtgccttcctaagttcagtcaggacctggcactcacccagcttccagaaaggagcccataaacataagagatcagttttggtgttagaaaggggaccacgtaggtcccattgttcctctggaagaaacctagacatggccacaccatctgggtcttgcctaggctgtcctgtcctcaggaacagagatgctgagagacctctgggtgtgtccctcacctgaacaccacctccttctgaaacctgcccattttacactgaactcaaacaagcttgcacttaggctccccaaaccctgtgactcatccattttctcccagcctgaaaaatgctcggcagcaatttatcggcgtgcccaaggggaggcagctgacagccaggagccagcacagccgaaacaaacaagggcaatgctgtgaactgcacttccaattttaatgcaaaatcttgcctcctaaagtctgaatttttcttcaggttcatccaaattccagcgtgtagccacatgcccaaatcattgcattggtgggatgatccaaaatcctttgtccaattgcaaactggaaaatttggaagtttgagtaatttgacgtttaaaggatgcagagaggctggccctacccagggacaggcactgtgcttgcaggagcaataagcactgtctggtctctgttagcaaacagggaccagggcctcctcaggcttggaaaaaatgaaagtagaaccagggtcatgggattgtagattacacgggatcattctaagtgaagtaactcagaaatggaaaaccaaatatcatatgttctcactcataagtgggagctaagctgtgaggatacaaaggcagaaaaatgacagaatggactttggggactcggggaaaggctgggaagagggtaagggataaaagactacaaactgggttcagtgtgtactgcttgggtgatgggttcaccaacatctcacaaatcaccactaaagaacttactcatggaaccagataccaccagttcccccaaaacctgtggaaataaaaattttttttaaaagagaaagtagaaccagggtcaaccaaacatgtgcctagtaagagtctgagttcctcctggacttgaccttttccagctcttttttgaacaaagtccggaggacatcagagcatccagaggataatggagagccagtgactttgaggagagcaattaggagctgaaatcaagggtggatggaaaaacctcattcagaaactggtgtcaagtaacatgagctccaactgtcccagcccctttccctgcccacctagacagacaggcagggctccacacagccagacccaaagtggtggaggcactgtgagttctgtcactgtgtgtcccgggcctacctctcctgccctgcctgatgacctggctcacctggtcccaggaatctgccccccggtttctaaggtgctctgcagctcttccttctcgtctgagcctcccttcctctggcccctgcctgcctctggattctgacagctctctgttccttcagacccaacagtgggtttctgggctctggggcaggacggactgcagagtttataaggctaagtgcaaaatgaaaatgcaggattcttgctcagaagtcattaagaatttcaagacagcaacaacagagcatgaaaccaagagcaggcccccatgcaactgcgcagccacacacccagaaagcggcctggagatgctgacttagcaaccaccagtggagacggtgcccaggagacagtgaggctgcagggtgggggccacccacgtgtgggagaaaagagaagagggcatggggaggagtcagaaagggagatgtgctagagacacgtggaagaacatggagaacccagagcaaaaaggagcatttcaagatggaagggtggaaggcaccatcttccctctgctgtggggtgcagaggtggagggcgagggcagaaggagcttggttgtcttcctggcatccagtcaacttcctccactgtgtgtatgtctcctctcttttctctctctctcacacacacacacacacatacacacacacacacacacacatacacacacacacacacacgcatgcggacgtgcagagatacacaggtcaaaatttttgtctctcttgctctctttttttttcttttgttccctcattgctttcttcctctctttcattttcaccttcgcctgacctctcctctctttcatcctctttctgccctatatctttccttctctcatttcctttctgtttcacagccccttactgtggtttgcttggaaaattctgccttcctttgcctcttccttactagacttactgccttacaacctggaactcctgcaggtgaaggagacctagaggacaactaagtccaattccaaatgtgacacaggcatctctcctataggatccctcatctcagtggacagggacaaagtgacttccctcgaagccttctagacaggaggtaagagatgagaactatgcagactagggcaccaagcagagatgtgccagacagggtggctcagtccgtaagactgccaccccagtgctccttccatgacatgtgacttctctgccttgctctgggcttgctgattgtctacttgtgccttctttgagccctgcattttttacacataatgataaattggtttttgctcttaaacagttgagtgttagatgcacagaagatgtcaacaggcaaagaatcaaagttcaggggaaatactaggaactttagggcacaggcaatctttacagggagaactcctccctgcactgcttgagtgatggcagcaagtggtcacctgggatagtacgtaagggcttccaatctggactcaaacacccccagctccaacgctaaccagctgcgtgatcttgagcgagatatgtaggatcagtgctccagggtcctcgtctgcaaaatgggaatatgaaaagggactcactctgtgggatttttgtgaggtttagataatagaaataactttgccctatgcctggcatatgatatgcactcaaaacatgttagttatagacatgagacttaaatataaatatttgttgcatgttgactatatgcagatattgttctagacatgggaaatagaatagtcaaaaaaacaaagattttgcccttgtggaccttgcattctagtggaagagatggacatatcagtcgataaataatctctactatgacaaaaattaaatttggggaataaagagggggggggaacagcatttggggaacgatgcaagagaagcctcctctaaatagggtaatcatgcagcttcctggagggaaaacaactgcaaaggcctgagacatgctgtgggtttaaggaccagctaggggccggcgggactggggcaggaaagtgaaagaaagaagaaaagagatgaggtcagggtggcagggaaggagatgtcagctcatatatggctttggagtccttgatgaggactatacattttattgtaagtgtggcaaacagccactggagggttgtgacttggagtttgacttggattcacattttaaaatatcattagcctctgtgggcaaaagactaaaaggacaccgttacagaccgctggatggtccaagtgagagaagatggtggcagctgtgctaaggggaggaacagaacgctctccttccattgccacacagggcctctgccttagaccaggctggctacctgtctacctgtatatttatttgggccctgagttctctgtgcatagtaataattaaatggggttttacactgccaacagctgcctgtgagttgaggagttagaagaggtaaatgtggatgagaaatggccccatggtgcagaggaagtaggaaatagaggactacagctcactgcccaggagaagacacagactgaagggagacggtgccagggagacggtgccaagcacacagcaccaagcaaagcacacggcctgcagagtcagccctgatgggtcccactctgagctgcctgaccttggagaagtcacttgacatcccaagctttggcttcctcatctgtgaaatggagctaacaaagggcagctgctgtgagtgccagtgacagtccatatgcagcgctaggcacacaggggttcaacagcccccgtgcatctttgggggatttttttttttgcttaaaaccaccactgttttttatttctcacatctctgggtaagcttgggattctgctgacctgggctgggcgggttgatctgggctgggctcactcatgctgtctgtgggcagcttacaggtctgcctggggctaactggttcaggatggtctcagctgggaagtctaggccctgctacacacaatctttcatcctgcagtagtggctactatacttgttcttaggcagtggtagagttctaagagggagacatagagaaaaaagagagagagggagagagagaacactcatgcgagccctcttggaacccagactcagaattgtcatattatcacttctacaatattctattggccaaagcaaatcacagtcagcccagacttaagaggtagagacactgactctcttgactcagactgtaaaggccatggatactgagaagaataggaaaactggggccatgctgtcctcaacccatggcaacaggatctaggatgtgactgtggttttgcccatggatcttaatatggttgggatatttgtcccctccaaatctcatgttgaaatgtaatccccagtgttggaggtggggcctggtgggaggtgttcaggtcctgggagcggatccctcacgaatgacttggtgctgtccttgtgatgagagtgagctctcgctctgagttcacacaagatctggttgtttaaaagagtgtggcacaccctctgttctctttgctcctgctctgtgaacagagcacgtgagatgcctgcttcccctttgccttctgccatgattggaagtttcctgaggtcctcgcctgaagtagatgccagcaccacatttcctgtataccctgcagaaccttgagccaattaaacctctttcctttataaagtgcccagtctcaggtattcctttagagaaaagcaaaagcaaactagcacacatctttcatatgcaaatgtgtctcctgcatctttgagcctccacccacctagaagctgctcctaaaaggtttgttgattgatctggaagcaatcagaaacaatctctgcgtcctggagatcggcttgaaaagtgtttcttgaatgatgcagaatgtgtgtcacagctggacatggcagcatttctgagaaatagagaggcacagcaggaagaggctcagctggcctacgcccagctctgagagtgacagcgtgtttacaagagctattagggaccactgctcctccgtgctcacgggatgatttactccaccaggactgccaggctgctgcttttcctttcactgctgaattgatgattgaatcacacatattccatctcaataacatgatttcactttgaggcaggcaggaagttcaaagcccactgtaagaagacccttcccccatgctgggctttgcgactctgggaagttctacagacacattcgtgagttagggaaagaaatctctctaaagcacactacaaacaactccgacagtcccaagtcccacaagagcagaggctgcatctggttgtttggcagagaattccctgagcacagtgcctgacacctacttcaatgaacacttctagactgaatgaatcaacctatccgtctacctggtcagaagctgtcttaactcgagcagacacagatgaccagcagtcttggaaaccactgtgtatagataacagctggaagaactggagaaaagagttgagtaggaaggaggccaggacatgatgctgcccacaaatatttagtgagttgtcctactcaagtctcctcccatttattgagtacccaccatgcaccacacaatacaatccttctaacaagtcttcaaggtctattctatgactcatattctctgtacgaagaaactaaggctcagagaagttcagtgactggcccaagaggacgtagctcctaagtgccaggcaaggatgccacccaatgtctcatccacagctccacacttcagaaccaactctgctcctgtctccacccccgctctgagaccaccatcctctggagatcccttttctgtgagaagcctgtatcaatcagcaaacagtggcaaggaacaggtcctacagaaatggccactggaggatgaggtcaccaacatttccatggggtaagtcctatttaattcctattgcaaacgcaaaaggagcactagataggggtgtgtatacatatatatatatatatattttttttttttttacatgtacatatacatttagtggcctcaagaaactcaatccatttgaaaaaattggaaactatgaataatgcaataatactgtcttactgatttagacagtaaatatcaaaggtagggaatgatatgatttgtcacccaaactggaacacttttaagaataaagaaaggcactgctcttggacaacaggtgtaaactcatactagccaagatgaaccaggacttaagatcaccatagctagatgatcataagccccaaagttagggacgctcagctttccagtgccttgtacaagtgctgaattttgcacaatgccactccatccctcatgacaacagcactgattgtagatgtggtagagaaagtaatgattactgttgctatttatattagtatagtaacaatccttataataattgcagcttctgtttattggattctgcagaaaatgtgctacgctattacaaacatcaccccatttgtttctcacagtgctaagcagtgggcatttttagacccactttacagataagtaaaacaggtacaaagaggttaggataaacgacaagcccaaggtcacagaagtgagtattccaatgaaggagagtcctattttaaaggatcttgtcttaattacaagctacaaatcttcccattatttctttttacctacattcctcaaggaacttatgaaatctaatatacacacccatcttttaccattcacaactcaactcctaccatctccagcagtttctttctctccattttaacatctgtctccctctttaaattctgtccttttcccttcaattaccccaggaaatattttatcctctctctaaatatttctttccccatcttcactgctgctacaaacctccaaagatactagtctcatctgataagtctatgagcccctttatcagggcaaatgaaagcttaggttgcaaaatgaaattttaaatgataaacagttttatcattcaataatgacattgaaagtacccagaagtcccctttcggaatccccagaaatcttcatttacctccttatctgtctctaattaaaccaacttttccctgagcaccaggaaaatacacatatttctcactcaattctatcacctttgggcgtcattccttaattagcaaggtagccacatcacttcccagtttccattgcgtgtgcatagcttttcagtcacagtctaggttaaaaggctattatgggttggctgaggcacctgatcaagatttatcatgttgtgtccacagaggaatgtatagtaggttacaaaatagagttgtggagcctaacttaatgacagagtgagaccaggccaggccaagaggctagagcaagtcggaagaaaacagcttaagtcagaagctgaggacattgctatgtgccagaggtgaaaatgcaggacaaaatggaaagaggcaaaggtgatcttgagaagagactggctccagtggagacagtgcaggttctgaaaggagcaggctggaaaatagcccgggaccaattatgttcattagtcaatagggacaacagctgaaaagtatcaggcataagctatggcagggaaaattcaggctcattaggaggagaaaacttgaatggtaatgatcctactggacaactttcaagttttagcaaggctgtgaaaatgttaatgaggttggacaacattagacgatcataagttcacctggtcaggcccccgaccccctcttaatgggccttccccttattaaaggaacacagattgataagaaaaccctattattgttttaaaggctaccagaaaattgtcctcagagttaaagccaactaagtggcttatagaataaaggatctaagtctgaatttttcatcaaagcaatcctaggtagatttggccttctaaaggtttctcttcccactccttggagccagatcaaatcaatcccattcaccttgtgctgtgcctggctgatgtgagctgtcttgaggctagccctacagaagtaccagaatcagggagctctcaggccccggggccacaccgcatgctcaggacagggcaaggcaaacattcagaagctagattgcatggtgagactgcaggctgaaaagcaggcaagcaggcagcatccgagaacagcacaggcacacaagatgaaggcaaggggcgagatataggcctgggagaacccaggcacaggagagcaggggaaagtagggcaaagcagggtttggggaccaggagagcaaaggactacaaattcagttctgactcactggacacgactcatcttgggccatggctgttccatgcctgggagggagagcaggggagctacagtgggctgctgaaattgcattcagaacgaaatgggtaggctcaggtgtcagctgcaaactgttttcaattctagaaaacataaatacatgaaaatgcatatgatgatatttggcataggtgaccacacctttgggacaccagcttgtttgaacccagtgctattgcccaggctccacatcagtgtggaagttggctggacaagaaggattctcctcctattaggaagccatgcttctagggatgatggcttctgggtgaggcttccattcactcgctgtatggcagatgcacctgacagcgtcaggacgtaccctgagaatgaccctgtttggaagatgcacctgaatgtgtgttcagagttctgagctaagaaatctgggggtggccaacccggagattcactccttacctctgaggaagagctgagccctcggactgtcctgagaaactcaggctgtacgggagatcaaggccctgtgtttggggttaaatgaaggctgccaggtggaggttgttaagggaagggtgctaagtcaaaacggtagttgaacagcatgctttttgcaagtggttatgattctcctgcccagcctgctgccaccagacctccctgtaagttgccctcctgctaataaaaccctacgtctcatgtgttggctctgggtctcctcttcagcctcttgaacatggtgtcatccctgttgaggttaaaaggggtctggcacaacacaaagtggtggtatcagataagagcaccccacgggcttccttagtcatgtacggtcctacaacccaacacgggtcccccattctgggcagagtgtggctcacgtagctcagcccctactgtggctactccctctggtggtcacttcccaggcaccggaccctcctgctgctcccagggaaggcaagggctggacactcagggaactgctctggcttccagcagtcctgcatttagccagtcccctgcaacctggtgcccaaatagtttggcttaggcaggcatgagccctgcaaacatgaggatgcccactcaaagggatgcagtgatacacatcaatgaaaacagtgcatggggcaaaatcagagctttgaccaaaaagagtttaaatgaaacaggacaaagaaaagcagaatatgcagtgaaaacagtaactcaagtgggtctggccacctgaaaattggactgatactcagcaccttaggtcagcaagaaaaaccaaaccaaacacattaccctgaataatggggagaataaggttatcagataaaatacaggacactgattaaatttccattttagatatgtaatgaataattttttagtgtgtcccaaatatcacaagtcatactaaaattatttgttgttttgttgaaattccagttcaactgggtgtactctatttttatttgttaaatctaacatccctgctagaactaagtggtgtccattccattcttagactctaagtgcagccctgtacaagtccaacaaaggtcagctgtaaatgagtaatagttagatgtttgtatatggagaacagttttctttaaaaacaaatcactactttgcagagaggaagatgaagagaagaaatctaaattcaggatgacttattaaagaaaaccccctgttctgggagtctcagatgacgtggtttctcatcccaggctttgtgacctgtgcaagtcacttcatttttacatgaaagggttagtttgaggatggaacttggaaatcactgggttctattaaaccctaatgtcatgattctattcaattagaactatgtgaataggggaaatgcacttacgttctagatcctaggaatacaaaactggaagacacttgtttcagcttgaaagatgcagatactaaattttctggcagatacagaatatatgtggccacgttctaagaaatgatgtcatagggctgagccagaaacatgctcagaaaggatggaggtaaaatcataaactcaagatttttatttggcctcaagatgtaaggggttcctcccaaacattctgaggctgataagatggaagagaagcatgcccctccctaacacatccttatctaagacaatatctcatttcaaatgcattgttgctgtgagaatactttccgaaaataaaacccagtggatcccagtgaagagaatctgtttcagaaatggtaaagctcagttaatcatgaaagataaggataaggcctcgtgaaggtcataccaatagccggcagaagtcaagtatatggattcatggcaataatgaagataaatatcaagtttgtcattacagctatttcttctctacacatagcaagaatgttttccaaaggagactgattcagtctaaacttggaaatcatttcggaactacaaaagttgaaaagcttacctttcttttctaacataaaaataagcaggaaggaaagggtaaagactgagttaactccaaaatataatattacaagtgttttgggttggacctgtctcaaacagttcaatttatctcagcaaaaacacatttttacacttacagcaaaaaatagttaaacattccaaagtgcacatgtttattttgttgggaaaattatacacatttgtttgattagctttggtaaataaaataacctagtcaccactcaagactcagacgtggctgcaaaattgattcaatgaaatgtcaaaataaatcatagcttaaaaatgcatggtatgtaacttctaaaaatgaaaaccacatctatctctgtcagagttgtgaagactgtgcattaaaattatatcaaaaatgaatgcagttttgaaggaaaactattgatttaatcgactcttcctgactagtgattcaaatcatgatttgaatcaatttgattttaatcgagcccaccctatccaaaagtcatttatacatgcctttggagtgcaagatgttattttcagcagtctatttatcttcctagttataggacactcagactgatataaaaagagttgtgttgcctatgtcacatcaacagggcagggagcagaggctcctacaaacttacctagttgcaaataatcccagtaaggccaaccacgcaccaactataagtaataagggactgaccaacagtctcaaggatgccaggacctgaaatcgggcagagtcctgggacagtcagtggactgcagacagtcctagcaacagggaagaggaatgcttcctgacctacagataacacacaacaagcagggcacttggcctcaggcaggggccaaggcagcctcaggatccagaaagcagacagaaaggccaagtctccacaaacagttcaagtgcaactcttgtctcttgcagaattctgagatgtggaggtcaggaacaaggctggcctcaatcaccagggctgtaatagtcagcaggtctcagtcacagatggagctgaaagccagagatcaggacaaggcagatgcttggagaaagccagtttctagaaccaaaggactaggaggctgacctgaagctgaaaacatgaattaggtattcaaggcaattatgcaagggttgatcaggtgaactaactataacctctgcctctgctgcctgaagggtattatctacctcgtaaaaaattgtaagtgtgtggcataagtcttggcatatggaaagtgctcaatgttagttactgatgataatgatgatgataaaaaggaagaaataatgataaaaaagaaattggctgggcacggtggctcacacctataatcccagcactttgggaggccgaggtgggtggatcatgaggtcaaaagaccgagaccatcctggccaacatggtgaaaccctgtctctactaaatatacaaaaattagctgggcgtgatggcacacgcctgtagttccagctagtagggaggctgaggcagaagaatcacttgaacttgggaggcggaggttgcagtgagctgagattgcaccactgcactccagcctggtgacagagtatgactccatctcaaaaaaaagaaaaagaaaaaaacaaagaaatctactactattaataataataataatgtagcctgctagggtattcagtggtccagtttgcccaggattggagggcttcccaggatatggggcatccagtgctatcactagaaagagccaggcaaactggaatggttgacaagtctgtccctgccatgtgcccagcctgactgacatggcatgggttgggtcagaacctgcagatggccttaagtgcctttagctgtggggatcagaggggggtggaagcagggagccaagcaccacacgttcttggatatagaactgagtttttgttgtatgaggatcatggtctggcttttcccttcaaggcacttggtgaaaggaatgtagtgaatcgataatcattaacgagctgtctggtctaatcatttcctcccattcgttccagttaataagaaaacagaacaaggagggaagaggaggagggtgaggaagcaggatctggccgtgtctgggttcactgagtttcagctgagctcaaaggtcccatccttcacccagttttaacctccaccctatgccccactgcgtgagtctggcacaaggcaagcactcaatctatatgcacagtatctgagaaagttgatcagtgggattgggatcagatctgctgcctccttggacgtgtctttgtggaaaggtgtaggtgcctggctaggaatgactgtgacgaagccatggttcagtgggcaggcactgctgccctgtgctaggcagcccaaggtccaagtccttccctatgtgtgatctgaggacagggcagttacacaaccttgcacctactcccgctcatgctgctgctgctgagtctcaaaacagccaaagcaaggagaagccggagaagtcctggtgaaaggctgtgtggttggtgagctgccggggatctcgcggttttctcagggatttatgggtggatttaggaacatgatatctagaggttgcttgtatatagcccagtaggggagaaagagcgctggattcaaagtcagaacctggatgtttatctcagctcagccactccacaaatgcagctcagctaacacatactgaacaagcatcgggactggccactgtgtgggatacttcctccaattttatccttttatcctcaacacaaccgattattatgccccattttattgataaggaaacggtctcagagaggtggaaactgaggctaagagaggtaagcctggtcaagacaacatactacatacgtggtttagcgtgttggctgaagctcaaagaggtaatgctggaatcttgaagacatgggtcaggacaggtactgggaacatgtactgaactgatgatggctgattcaaggaacaaagaatctcagggccagaggaagagccttctttggaccaggcagccagcatggcatgtaaagcacggcagttgatgtgtctagctccagatgtttataaaagactttagtgccctgaggtgatgctcagcttgcctgggccatggagtggggtatattcttggaaacactgctaagggaagcatgggtgcaaacatgtcaaacaagactggaataatgggtctctctgctccttggtagctgagcagcctaatgcaagtcatttaacctccctgaacctcagtcgcttcatctaacctggctcacccacagctggtgtgaagattaaaggtaaagtgtgtggccgagtgcagtggcttcacgcctgtaatcccagcactttgggaggccaaggcaggtggattgcctgaggtcaggagttcgagaccagcctagccaacatggtgaaaccccatctctactaaaaatacaaaaattaaccaggcatggtggcatgcacctgtaatcccagctactcaggaggctgaggcaggagaattacttgaacctgggaggcagaggctgcagtgagtgccaagatcgcaccattgtactccagccagggtgacagaacgagactccatctaaaaaaaaaaaaaagtaacatgtgtgacacgctttgcactgcatgggacacagtgtagtactccgtgcaggggaacatcattcaagcacatttgctaagctgccaggtaaagccaaatgaaagctatctgactcccccattagtggcatttaaccatgccagactaatttgcctaactagaaatctgactcgaaatctccatgccccactccctcatcttccaggcattcggaaaggcaggcttggatctccttggcacatttactaccagggacatcggggtaccccagagctatcaggacaatgagaagggcctccagagagagggaggggctcgtgctaaagcatgaccttcagggcctccaaaagatgctcccaagaatggctgcagaagagttcaactccaagtcgatgacaacaagggaaggttaatcacagggaggcacagggccacagggcaggaggcacatggagtaggcagggaagtcagcttctgctgcaacctggcctgggcactgatgtgctccatgccacggcacctgggaaaactcagtcccagactgacttccaccacctctatcacccagtccccttctcctccggtatctccctccaccctcaggggctcatgagaagtctcttcatttccttttgctgcactgcggggacccctcagctcctctgtgctttcttgaactgatgatcagttattttccacatgtgacacgtgctctgccactatcacctcctgtattagtccattttcatactgctatgaagaaataccagacactggtaatttataaagagaaaggtttgctggactcacagttccacatggctggggaggcctcacaatcatgcagaaggcaaaggaggagcaaggacaggacttacatggcgacaggcaagggagcgtttgcaggggaactaactgccccttatcataccatcagatctcatgagacttactcgctatcacaagaacagcaccggaaaacctgaccccaagattcaattacctcccaccaggtccctcctatgacatgtggggattatgggagctacaatttaagatgagatttgggtggggacaaagccaagccatatcatttccccaccctggccattaggccttcactacatcctaggacctctggacttgggccacacactactctggactaaaccttggtcttcaggcacatagagttgctagcactcaacttgcggctaccctctaagaagtcactgcctttaattacacaagtcagcacaggcccccagccttgggactgccctactgagcaggtccctgcagtgcctggtctcagccatgctcctcatcaccaggctgtatagcttatagctccctgggcccctaaccttttcctttccctcccgtgccaggcatttttactgcagaagaatgtgaccttgagcaagtaacttcatccctctggatctcggttttcacaaacataaagatagaagtcatatgaatgatgttagcagtttttcagcctttcagtgtgaaaaaaaaaaaccataaaagggtatacttttacatacattaactaagaaaacgcatgaagatgaagaggccctgtgaacttagtaatatcttcaaataaatctatattttatttattacaaccccatcatttgaaaagtagaacacatatgagtgagatttattatttagtcctcccgtacctaaggaatggttggtgcactacggactcttggacccagggtaataattccaccactccctcatgggttcacagcctgcagattggcgaacagcagactagacaacctccaagggtctttcaaggtcataaattctacaaagacttaccaagcacctgctaggatggatacattctaattagggagacagataaactccaagagaacaaattttaaagcaagcacttaattatggtaactggtaaaaacccaagaccaaactaaaaaatgaggcagcatgggggaatgtggccttttagatagaatggtagaaggcttctctgggatagtaacatttgaccatgtgacccagaagatgataaggcaccagccataagaaagggatgggtggggagaagaaggcaaagagcattccaggcagaagacacaacttgacaaaggctctcagaaggatgccagtgtgggctgttgaatgacctttgtggctgaggatgaagacatagggggcaaattatagaggggaaaaacagcaattctgtctggaagtattaagtttaggagtatgcatgacatccaagtggaaatgttgacacagctgaatataagaggaggctaaaattcagagataactgtgagagaaatgcacatttaggagtcaacagagagaagatattccaaattctgaaaagttaggggatctactgaggggagggcaggggacaggaggagacaggaaaggagaggagaagagaggagaggagaggagaagagaggagaggagaggcgaggagaggaagacctctagaccaagtccttagaaacaacaccactgacttggggagagaaggaaagaggctgggagaagccagagaagaaagaggaaaaccaggacctggtgaagtaatcaaatccaaaagagaaaggaattcaagaaggagggagcagccaaccgtgtggaatgctattgagagacagagagggtaagattcagatgaaagcacatccattggatttggcaatacagatgatgctatagactgaaggtttgtgtcccctccaaatccgtattttgaaacctaaaccccaatgtgatggcatttgaaggtacagcctctgggaggtgataaggtcattatgatgtaccccttatggatggattagtgcctgtataaaaagagactccagagagctccctcgccccttttctgcaatgtgaggacacagcacaatgatagcggtctatgaaccagagagtggacctttgaccagatacagaatccactggcgctttgatctaggacttcccagcctctagaactgtgagaaatacatttctgttgttgataatccacccagtctatggtattctgttatagcagcccaaacaaactcagagaaaaaagaggggcacaggtatagcgattgcggcagaggccactggagtgggatgaagagagattgaagggtaaggaacatgatggggacatgatgtgttggcaaccgcttctagaagtctggctatcaagagaaacagaaaaaatgggacacaagatggaagaacagggtagattattattcagcaagtactctgtctccctcagtctccatgggaggagtgtatgtcccatctcactgatgttaagtttggccaatgggatgtgcagatatgccctgagtaggactttgaaatgtgcttgcctgattgggcttggcgtctcgtggtccttcctttctttgtgagaacatgtcttgggtagcctctggatgaaggagaatgagcgatgtgtggcacaggcttgggacacaacccacaacttggagcccagcttagatctgtggaactctaacgaacccacaaacctgtaagcaaaaacatatgctagttgtatgccactaagatgctgtggttattggttgtgcagaattattgtggataaaggtgactaatacaagggaaaatatgcagtcgggtggggttatgtttaggatgggtgatgctagattatgtgtatatactaatgggaatgatgtactgagatgaaagaggatttggctgcctgaaagggatgagacagctttggcagggcgatgcccatgagaataacaagaggggataagatcctgaagattagcggaggggctggctttagataagaggagggctgcatcctccattctagcaagaggggaaacagcagatgcagatacaagaaggtttaaaggtttggtcaggaaagatgagcagcttagatgggatgactaatttctcaatgaatgatgaagcacgaccatcagtggagaatgtctttagcctggggaggaggtgtcttgttgcctgctgtttgcctttccttaaatgtctttctaattttctctgtagatctaaactctaagcccctccttctccttgaaatcctagcctaccatgacccttctccttcctatagcatttgcaatctcaactcgagtgggacatctgattagctcgtctcattgtttgaagtaggatttaggcatgctttcccttctgctgaacttgagcttgatgagacattcggatcacgtttgcttcttttgagtcccccacagtaccaatgacatagtgatggtcatgctgaggaggcttaataattacttgttaactggctcaagaagaaaaagtatgtgattgttactgtttcctcttatagactagctgacttgggccacagaaaatcagggaagaccagctgctaaggggttagccagcagaactattgtttctggagacggacacgttttctggtttggatttatttttttttctcacttcttatgccaacttccctgaagcttggtccgttttcttcactgcttcaagaattctttcatcaatcctgccgtggacatactgacatctttcctgagaaagcagagggttattttctagatgttctttaatgccattgcttagagggctttctgttttatttttaatgaaacaaaaagcaccagatctgacaggtaatgctagggagcccatatttcgtgcaagggatcccagaaataccaagcagctggcgtgctagttccaaagctaccatgcagaccttgtttatacctgaaagacagcagagggagcttgttctcaaaggcctccccagcctcagtcaaactggctgaatggaccttagagtctcagtctgacagtttcacaaggttctgtgtgccaccttcaacactcatccaagttacatgcagaggaaacagagctgatccagagaactccattgcctggcaactgggacaccatggactaacttgtaaggcaagggtgggtgtccactcctccatcccctcaagggctccgatccaccctcccaagttcccatcatttccagacaccaaaagtatcaggccaacccacccctcctccactgatggagcaaagtgtccctcaagaaggcccccagttcacagccaggctgggtgagggccccctcttctgagatccccagaccaccctactctcaccttctagccaagctctgacgataacactaggtacttcccccactgcactcagagctccctgggactggagctgcatctgattcacctgtatttccttctctagccaggcacacgtggatggccaatgaatggcttcttagacgttaacagcacaggtaggcagcgcatctgacgcacctggagaaagctccagctctgcttgcactgcctaaggcagtcccttcatctttttttttttttttttttttttttttgacagagtttcactcttgttgcccaggctggagtgcaatgatgtggtctcgactcactatagcctccgccttctgggttcaagtcattctcctgcctcagccttccaaggagctgggattacaggctcatacctggctaatttttgtatttttagtagagacggggtttcgccatgttggccaggctggtctcgaactcctgacctcaggtgatccacccgcttcggcctcccaaagtgctgggattacaggcatgagccaccacatccctaaagatgaagggaaggcagtcccttcatctttaagggactttttcctcatctgtgaagagaacattaaaaatatctacttcactggcactgtgagaagtaagtaatgcacattttataaactggcgagtgttttacaaagtgagtactaattcacacttaagttttagaggctgtattacctccctcaaaaatattttcacttttaaaccgaccctctgatgtgtccttttcctcttttatgaaggacaatgccttcctccttcagcagtgaaggtatttcaggcatgagtgaaagaaactgggtttgctttgactgggggaggtaatcaggaccctaaacgacagaatatggaccagaaatcagtaaactatggcctgaggcccaaatcctacccaccccccatttctgcaggacaggggagctagaagggcttttgcatttttaaatggttgaaaaaaagtcaaaaggagaatattttgtgatacataaaaattatatgaaattcaatttacagtatctataaataaagttttattggaacacaccatgctcatttgtttacatatcatctgtggatgcttttgtgccacaccaggagagctgagtggttgtgacagagaccataaggcctgtaaagctacaaatatttactaattagttttttaacagaaaagtttgccaactcctgatagagatcatctctgtacttgccccaaggccactcctgtgaaaggatctagaatgagtcaagattttattctgggaattctattttagtccatccaggctgctataacaaaatactataaactaggtggcttacaaataacaaatttatttatcacagttctggaacctgaaaagtcctagatcaaagcaccagcagattcagtgtgtggtgagggtttgctctctgattcacagacagccatcttctcgctgttgcctaacagggtggaagggataagggagccctctggggtcttgtgatggttaatacttagtgtcagtcaacctgattggattgaaggatccaaagtattgttcctgggtgtgtctgtgagggtgttgccaaggagatgaacatttgagtcaatgcactgggtgaggcagacccaccctcaatgtgggtgggcaccatccaatcagctgccagtgcggctagaataaaccaggcagaagaaggtggaaggagccaacttcatgagtcttccacccttcatctttctgccgtgctggatgcttcctgccctcaaacatcagactctaagttcttcagcttttgaactcttggacttacaccagtggttcgcctggagctctcaggactttggccatagactgaagcttgcaccgttggcttccctacttttgaggttttgagacttagactggcttctttgctcctcagcttgcagacagtctattgtgggacctcaccttgtgatcatgtgagccaattttccttaataaactccccttcatatatatatatatatatatctcctattagttctgtccctttagagaaccctgactaatacagatctcttttataaaggcactaatctattcatgagggtcccaccctcatgactcatcacctaccagaggccttacctcctaaatcatcacagttggggttaagttcattataataattttgtggagacacaaatattcaatctacagcagagggatatagacaaaacagatcatattctgaagaacaaccaggaacatgctgagactcagacatgtgtcacgggaagaatggtcaataatttcagggtgtcttcaattatccaaacacctgtcatgaagaaaggagataaggctccctctccatggcttcaaaaagtcaacctgggactggagacccatttcagtcaatataaaaaatcatcttcagctgtctgagctgtttcaggggatgagttccctgtcattacatgtattcacagaaaaacaaatgtacagtgtagtgaatatacaatgtagtgatcaatgcaagatgaccattgggtcactaacatgggtaccctttcattaggttggtgcaaaagtaattgtggtttgggccattacttttaatggcaaaaattgcaattacttttgcatcaacctaatagattgcccattttgcaaagacctccttaactacaccatgaaaatccacaagggtaggctcctggatgctatgtttgtacaatatgattctaacacagtttactgaaccagaagtggctcctgtctgaggttcgttccatcagggtcctttacctaagaacttgagagcagatcagggtgagaatgagagagaggacagggtgctatgtgtacggctgaaagtgtaatatctctgcccaccatgtgggatcaggagcagggaaagctggcttactaggaaagaagcataaagcagatttatggagagaaggagagagatgggatggagaaagagttagtcctgggctcccaacagccttgcagtccctggctccaaactcttcatgaggtctggtttccatgatcaaacttctgggttactacagattagtctcattttgcagaagctagcttgagatggattctcttacagcttaaagaacttgaagtaatgtcattatggtggaacaagactcagatcttgacaacctggccagtgtcctcagtctcttccagccttgggaatctaaggttctattagccatctagaggagaggccatgtccccttgagaggcagtgtctggggagcctgggactaaacatccacagcacagaccacaggcatggcatgtcaacttgcacacatcgcacttgcttctctcctctttaggaagataacttgaatctatcacgccactctgttgtgaaaaataatgaatagcaccgttaacaaatgacaagtgctacatttcttattattatctatcatgtatacatcactttatttctgtagcatccagcaggtgttgaatgcaaatggactgaaagcacttttgcagacttgcaatctcctattaagaaaaacatttgtgagcatggaacagtggagccgtcaggctcttccaagtcctacactgaagtaccccaagcaggacctgagaggtccttctcaatcatgctgattcactggaaagccattaaatccaagtgattcacatttactttagtgcaataagatctaccctagctccaagctttgaccctgtcaggcctctgaccccaagctaagccatcacatgccctgcgacctgcacgtatacatccagatggcctgaagcaactgaagatccacaaaagaagtgaaaatagccttaactgatgacattccaccattgtgatttgtttctgccccaccctaacagatcaatgtactttgtaatctccccaacccttaagaaggttctttgtaatctcccccatccttaagaaggttctttgtaattctccccacccttgagaatgtactttgtgagatccatcccctgcccacaaaacattgttcctaactccactgcctatcccaaaacctataagaactaatgataatcccaccctttgctgactctctttttggacttagtccaccagcacccaggtgattaaaaagctttattgctcacgcaaagcctgtttggtggtctcttcacttggacatgcatgacagacccgatgccatttggaggccataactgtttgtgtgatcagagaaccacaggaaacagacatgggcaatatgtggccagaggctcttgatcactctttttgctccagcaataggatagccttgggcctcctttgatccagtttattccacatgccagacttcaccactagccaagtgttgctcagcttcttctctcctctccccattttgcacatagagaatggaaatacactattaagtaatttcccaaagaacatgaggctggtcttgagattggaaggcataggctgtttctggcccatacagacactcactgtaaggtgaataccagatgaggggcagggaatagagtaggagaaactgagctctggacccattgctgccccaatgatattgggatccaggcaagtcatctcccttccctggccacagtaactcctctatccaatgaacagattggaccaggagccaggtcacagccacaagataggaatatcaagatcaaaatcaggaagaggctaggagttgacacccaagaataaccacaaaaatgtcaagtctggagtgaagtcaatgaacatattctagctgagcactaagagtaccagtgatgagctgagttaaagaggtaccagaagcagagtcaagtcatggaaacaacagtgggagtggaaaaagtaaaacagggggcaacaacccagagaagacaacacagaggtgaattaatcttgatagagatttgttgttggatatcttaatgtcactaacacaaagacaacatggggtgaccagcaggatcccacccagccctcatagtctacaaatttcaaccttgctccagttgtgctaccaaatgtgcatcagccctgacaaaggagcaattgcaagctaagtatctgacatagcgtgggttctgtattaagccacttttttcccactcagtaataactggacacacaagaaatcatcccccaaagggtcatatgccagtctccatctccatttaataagagcaatccctgtcttgactttctactttttacttgcccctaagatgttcttgggtcctaaaaaaaagtcacttcctactcatcaggacactagatcactgaaaaagaaattttgaagcttttgaccctccatgagggtagtgcaggctggctacagagagaagaaaatttatttccaaggccagctatttgatgtcctaatctttcccaggctattcccatagaatggttattgaatatattatattcaacaaatcaactactttccctataaaaagttctcgtagtagctgtaagacatatgacaagaaaagtctctctgtgtgcctagttttctcatttgtaaaatctgagaaatggtacctatattagttttccatcactactatagcaaatcacctcaaacttggtagcttaaagcaagacatatttattatcctgcctagattaggcccatatccaatatgggcctccctgagctaaaatcaaggtgtcagcaagggtgcgttccttctagaggctcttaggagagattctgtttccttctcttttccaccttctaggttcacccatattccttggctcatggcctcttttcttcatctccatcttcaaagccagcaacaatggatcgagtcactctaacatggaatcactctgacttcctcttctgcctcctccttccacttttaaggactcttgtgattacatcagactcacctgggtagtccaagatactctccttattttaagatcagctaactagcaacttaatttcacctgcaaccttaacttcctcttgtcatgtaacctaccatattcagtttctgagaattaggatgtgcacaactttgggggcacattattctgcctattacagtatatgtcttctcacagtggctaggaaaaattttcccctactagctaagcatatggccctggctaagtctcttgtcacttcagtttcctcctatgaagttgagggctttaatctaagacagtctttaagatgtataagtttatgaggataaaacagagtcattaaaagatgagcctctgtcttgtgcattacagtcttcaaagcacttgtccatgccttgtctcatttgatccctgcaccaatcctgagaaatatatagggaagatgctaccattatctttgctttgtagaagtgtaacctgacaataagaaggtaaatcatgtgtccacgaccacacaattaaaacatcacagtcctggtttaatattggagtcttctgataatacatgccctaaatgaaaaccttttctgaataccttggaaatgtatatatgaggaagatggtaaccaccaacacactaccaccagcaccaccaccaccatccaaccacatcacaactcatctaagtgaagaggcacagcaatggcagatgatccctgaagataactcaggaatccaggtccccactttactttggattcccatcctctaatcgcgtcccattaaaagtgccttcctacaaccatattcttccttccttgctttgagaccacacatgattagcatagtgctggttctaaatcaaagaaaaacagtcatgagcctctagctggggaagagggagagggtctctgtatagtagccagtggtctcaaggcaatcctgcttatgtgagataggataactagatacagtgatggaatcttcttcccatcctcctgagttcagttcagtataaaggaaaatacaaaaatggtgaagacattttctaggaaacaaggaaggagaaaagagctaaaggagattacttgaaagtctttgaggcacagtggacatttgttatcttttggttcctagcatccattgctacatttcattgccttttggggaataatccctctccccactctcagaccatgtgcttgctccatcctgcactctccactccaagggcagagaattaactctttccacaagtatttattgagcacctaagatgtgctctaggcatgtgagatatgaaggcaaggcagacaaggcccctgcagtcatcgagcacccaaataaacaaacaagcaaaaaaaaaaaaaattgaatgaaatacttttgagagtgttatggcctataagaaaataaaatagggtttttgttacagagaaggaccagggtattattatctggacttttcagttatgttcactaattcttatttcgtttaagcctatttgggtcacacttcctgttgttcacacccagcaggcttcctgtattggattcctaacacaggtggccctcactcccctgatgctgaagatccctgtcctgtttgtagagcaagactgtactgactggccaagacttttgtgtcatgggaaatgaacagatgggaaagaacccagaactggcactcagaacctcagcttctagttcaagctcagcactaactagctgagtaccttctacccaggctggagtatttactaactgctgaaatggggatgtttgcctagttaatttccatgatctgttccacctccaccattttgtgccctatgctctacttgatcagaacttctcaaatttacattataattgggaactgagtaatctcaagctggcctcaatcacattctacgtctctattaaaaagctgcaaaacaagcatttaacacttgatccagatccatacatattatcaggggagatccaaactgcatactcagcaaatgtactgcattctgcaaacaaacactccagtgcctaataaaggttagtgattcaagataatgctgattttacctgcaaaactcactgtgggctctaaggagttctgcctctatccttcatggcttattagcgggggaaagcctttgggcaatttcactgggttggcatagaagcatttatatacttttctgtatgtggaggacaagaggatgtgcatcatcttctgacatgaatacctcagtgactatgtcagaatcctattaatataataatccctttaaaaaatacatttatgtggttcaaaattaaaaaggcatgcaatgaaacatttcccttctacccttgcccatccccagttcatgtcacaacccttaagggaaaccattgttagtctgttgtattatctttccagaatttcttatacaaatagatgtaagtataaatgcggttgacccttgagcagtgtgggggttaggggaatcaatctcctgctcagttgaaaatctgcacataacttttgacaaaacttaactaccgatagcctattgttcaccagaagacttaccaataacataaacagcccattagcacatattttgtaatcatgtgtatgtgttatatgtattatatactgtagtcttacaactagtaagctagagaagagaaaatgctactaagaaaatcacaaggaagataaaatatatttactattcagtaagcggaagaggatcatcatcaagatcttcatcctcatcgtcacatacagtaggctgaggaggaggaggaagaggaggggttggtcttgctgtgtcaggggtggcagaggcacaagaaaatctgtatataagtgaatctgcatagttcaaacccatgttgttctgaatttattctaattctacaatgcctccactttttatatataagttagtatagaatacacactattgtgcagcttgcccttttttcttcattttgcaatctgatagataaaatatgctattcctatatagctttgagttttgatgaggtaatgttaagtacatcttttaacaaatttaggtctattcatatttctttttctgtgcattgcccgtttatatcctttgcctattattttctattggattgaaattcatttttattgaccctttggaactctttatttaagttgattaggcctttgtcatgtgtcttttcagtttacttatgtagattctttttgctacttagaagatttttttccttcaatttttatttactcagttatatcagatttttattttatggtttcaagatttaagtcttggttagaaaggcaccctgtgtgtttccttctggtactttcatagtcttgcttttacctttacatttcgttttcatttggaatcttatcttggtgtatacatggtgtgaggtatggatacaattttattttcacccacagggctaccagatatcccagtggaacatatttaatcttttccttcaatgatttaagatgctacctttgtcaaatactaaatgatcatatgcatttggatctatttctggactaaccacttggttccttttaactatgtgtgcatgtctctgtagcacacagtttcaataaatgacacactataataaattcaatatctagtagcgccagtcacctcatatgggttttttcagaatttttctatttttatttacctttttatttgaactttaaaacaaacttaactagttttagaaaattatctattgatacttttatttagattgtgtttgatttataaattaacttaaatagaatgatgtctattgtttttccatccatgagcaatctttccatttgcttcaggatccttttatatactttagtagtgtttttaaatcttcatatagaccctggatattttttgtttaaatttattattagttcttttacatttcttgttgttattgtaagtgatggctcttcctctaaaaatatacggtaagtcctcacttaacatcattgataggtggttggaaactgtgactttaagcacaatgatgtacaataagtccttgaataccatttccttcaacatctttttgttataactttgatgagaaaaaaaccagttttgttacatgtcattttgcttaaagttgcagtttccaagaacctatcctcaatgttgaggacttactgtattctgtttggtgtttgtatatgtgaaaagtattaatttatgtttactaattattgcacattgttagtttatggaattcttttattgtttgaaacagtttttcagttaattatcttttgttttctagccatgcaatcacagcatcttcatacagcaacaactgcctcttccctctcttttttactgtttttgcttgtctaattgcattggtaagtatcacctgtgcaatgaggagtaacagtactaatagcatagatccttgttctttagtgataattcctttagtgtttcctcaataagcataatgctggcttatagcctgagatggatgtgttttagcctgttaaaaaaaaaaaaatacctgaactatacagatgctcctagacttatggtagagttacgtcctgataaacccataagttgaaaatatcataagccaaaaatgcatttaatccacctcacctactgaacatcataacttagccaagactaccttaagtgagctcaggacacttacattagcgtatgattaggcaaaatcatctaacacaaaccctattttataatggagtgttaaatatctccgataatttattcactactgtactgaaagtgaaaaacagagtggttgcatgggtactcaaagtatggtttctattgaaggcatattctttttttaccataataaaatcaaaagattgtatcaaagcatcatgagtcagggaccaccagaataaccttagccagtcaagctttcttgagtgtattttttaattttaaaatgatcattgaagtttctcaaagctcttttcagtatctatgaagataatatcttttttctcttaatgttcactaatataaaaccatatatgcattccaagaataaaaccctcttgattatgatggattagtcttcaaatatactgctgaaattattttgctactttttaaatgatctttgaattgatattcataagtgggattagtctttggatttccatgtgtgcctactttgtcaggttttggtaaaagttatgcttgtttctcttctttttctatgctctagaacagagttctatgctctggactagtgcatttttctttgaagaatgtatacctatttaaattttttaaaaaaatttctgccttagaaattttggattcctttctgggcccatttgggtaatttttattttcttgaaaaaaatccacttttcaaacctatttgcatagagctgaacaaagtagtctcctgattcctttagtttcctgtttatgccactgttctccacatatcattccttattgtatgcatctgcacttgctcccacattttcttgattagattaactagtagtttattttattgttgtttttttccccatgatatggtttggctgtgttcccacccaaatttcatcttgaattttagttcccataatccccacacattgtgggagggaccaagtggagataattgagtcatagtggtggtttcccccatgctgctgttcttgtgacagtgaattagttctcatgagagccgatggttttataaggggcttccccattcgctgggcactcatacttctccttgctgcttcatgtgaagaaggacatgtttgcttccccttcccccaagattgtaagtttcctgaggccttcccagccatgctgaactgtgagtcaattaaacctctttcctttataaattagtcttgagtatgtctttactagcagcatgaaaatggactaatacacccccaaaccagctttgaaatttattttaactgctttgttttctaactcattaatctcttttatttatttttttctgctttccttctgcaatatttcattttattctgatatagcttcttgacttagatgattaattcatgtttgatcattcttttgtgtatatatttaagccatcagttttcctctgagtactgctttagctatataacatttgttctgctattgagtgatttcattaattgttttccagaaaatctgcaatttcagtttttcttttcctctttcagccatgcattgagtattttttgttttgtttggattttactttcagttaaatgggcttttggttttatgatttagtattaatttccagtttaattgcactgtaatcagagaatattgtattttttctaccttttgggatttattgaggttatctatgttccctaatagatggtcaatatttgtgaatgtttcatagacccttgaaagatatattttcttcatttaatctacagggtttgctatttatcaaccagatctactttattacctatgttaattagagcttccatattgatttttattctttgtctaggtatctggagactgagacatgtaaattaaagtgatccgttaccagcgtgttttcgtctattttctccttgcatctcctaaaatttctgtgttttcaatactgctgtttttttcattgtgatatgtaccttttatacatagttcctttatcttatttaatgcattttaatctgaattccactttgtctaatgcaagttcataactactactttttatatctctattttaaattaacattttaaagcattcggctggtgttccttcactcatccttttattttcaaccttcctgtatcactttcctttaggggcatctctataaacaacttagaattgggttgtggtgtgcgatcctttctgaaactcttcttaaaaagtaagttaaattcatttatatttagatatgacaaataggcttattcctagatctcattttatattatgtcttctgggtttcttggcattattttcgtctttctgtgattgttcttccagtgtgattcttctgggaaggtttgtgtttttattctagtggtaacattcgtaattacaacatgatataataatcttaacctatgtctctagacaagacttattaactctacattacaagcaaagataaagttggtgtattccctttcactgttctttccacagaagcatagaaaaggcatgattggggtggagagagaaagagacgtacatcctgacagccagttgtgaaagtgcacagagatgttaacacaatggcagctgcgtatagagaagaaggaaacacacacacacacacacattacatagcccctaggcacaatttactctggcaatgctactgtctcacttccaccaactgattttagtcaataacatcctctttctaagtgtctaccatttattaagtataattatgcttatattacttcatttgtcagctctcaattatacctttttactccctgctattatagaatgaggcattcagagaacttcctttttccccctttgcctttcaatatttgttggctgtgtcatttctacatcaccagggcacagaacacttacattctcctctgttcttctaatcctcatacttgtcttacttttagttttagtttagttttacagttaaaaatattcaatgctcaccctccatcttcactttgttgactgaagttcaccctctactaatttgttcaggaagggctcatgggaacaatattccctgagttattgcatgtccaaaaattgtcttacaattgtctttgtacttaaaagatggctagaatggatataaatcgttggctcacactttctttctttgcttatcttgtagatgttgtttcgctgtcttctgggtatttggaagttgctgcagaaaaaactgtggccaacctggtatttttctcctcataagtgacttgatctctttgcctggattcccaatggagtctttctttctgtctctctttttatttattgtttacttcaccattctttattaattttgaagtcatttcaaacctaaagaaaagttgtaagaacagtacaaattcttacacctcctccacacaaatcctctagatggtgacattttatattttgctatattttccccatttttgtagagacagaagatagaaacagatatacatttttgttcacatgttcccatcatctctaaatactccagtgcatgcctcccaaagacaaggacccttctcctatatagtcaccatacagcactccttgtcaaaaaatcaacaatgatacagcacagacccagtccacagatcctatgcgaatttctgaaatatcccaacaatgtctctttttcacttccaggtccaggatcctatctaccaacacatgttgcatttagttgtcatctctcatcagtctcatccagtctggaggaattcctcagtctttctctgtttctcaaatctttgaaagtctgaaacagtacagacctttccttctgtagagcctgtgtccatctgatgtttcctcacaaccagatacaagccatgcattcttggcacaacagaaatgatgctgtgttcttctcagcccatcacatccaggggcacactagctcaacctgtccaccactagtgatgttaaccttcatcatctggtcaagttggtgtctgccaaattttgccactgaaattttaccatgtttccatgttatttggttacacttttgtgggaagctttactaatattgtgccaatatgctatttcttatgaaacctccacccacaggacagcacccatcagcaactaccaatctctaccaattaccacagttacggtgaccaagtggtgaatatgtatctccatcattctctctacatttatcagttgtcatttttcggtaaggaagagtctcttctcttgcacttacttatttacttgtctatgtatctattcattcacttatttataacagtatggatttacagattcctattttattcaataggttgtaatctaatactctgattatttgatatttactttgatgctcatattgttctcaattggtcagtggaaagtccttcaagccagctcctgtgtccttttgacacatccccatcttttcttgagcatttcctgactttctggcaagacaaggtctttcaggttcattttatactttttctgccctatcccttaagttagccacttctctgaggccccctggtaacttgcagtgtagggcactatttagaaaccaagatctctgtaatcccagcactttgggaggccaaggcagccagaccacttgaggtcaggagttcgagaccagcctggccaacatggtaaaaccccatctctactaaaaatacaaaaattagccaggtgtggtggcccatgcctgtaatcccacctatttgggaggctgaggcaaaagaatcgcttgaacctggaggcagaggttacagtgagccaagatcataccactgtactccagtctgagtgacagaacaagaccctgtctcaaaaaaaaaagaaaaagaaaaaaagaaaccaaggtctgagtactcaccatgcactcattgctactggagttccactgctttcggacgaaggagttaagaaaaaaatgtatgtatatatgtacatactgacacttctaattccaatccagcatgctaggacttttctagccttccttctttccatgtttagaaatcccctttcaaacagtaaaaaacacggttcctattatcctctttatatttatttacttgctcaataaattatcctttctcttaaccaatcttccaaccattctagccatgtcccctgcccaccacctccacacccacttttctaccctgctttcatagaaggaaaaggaggcaaggggaggggaggggttattccctatctttcgtgtctaaaacttcccaaggctataatcttggtatgagctgttctggataattttgcccaacacccaaattcgtgctctttcaacatttagatttaagtcttcttttagatcatgaaagccttcctaatattttaaatatgttccattgtgtgtgttttctgtgtgtctattttttatgtctgttattttttgttttctttcaagaactaaaattatgcttctgctggctctccactgcctgtcttctatgtcaatcattttctctctaatctttattaatgcttcccttatttatgtttcatttattcacctttcatctatgttccacactgcattttccacagtgtctattttcccttgagattcttccaacttcatcttcatttctgagaccaatttgcctttttttcttttatttcctccttgagttctgccagctcacatttcaccacctcttgccattttgtcatcctttcccaagcatttacctctgcaagttgggtctttcttcacagaaatgattgctttgttgagttctttaaattcactgtgaaatacttgattagacttttcatctgctccctgaaattattttcctgggaatgttccttatttgggggtaattttcgtggctcttgctgacattcttccccctaatatcattgcttctaatctaccaatgatcctactttcttttttattacttattgttgtatgagatgggctttcttggatcatttctttgcaggaagttctgaggatggaaggagggcccagggtagactttcattactgaagtaagctttctttgtggaggagagctaatgactagaaagaggcacatggagatttctgggctgctgaaaagattctgtaccttgatctgaatagtggttacacaaaagtttatcaaactgaaaaatatttgtgtgctttcctgtatgttatatctcaacaaacatgttaaggaaggaaagaaggaagcctcttttatttgctgccaaaaacattgtttcttgcagttaggtgtcttctggatgatcctttgtataaatgcacctcctctgcttctctgaatcaaagcaggcccaggaggtacgtttcttcagttttgctcaccctagtccttatttgcgttgattacaaataagagatgttgctttgcctcttcaggatgccccttatatccaggatgtgtattttttctggcactctttgccacctgctattcctgagcccaccaggtactctcctaaacctctacttccccctcatggcctctcccaaaccctcctgctcaggacagcccttgcacacattacacattccacagattgtatctatcctctaattccactgaaaatggcatttcggagttttctattgttctctttgctgttgtgtccagcaacaaggagactgtaatggtatccaggaggaagagcagaagaggttgtcttgtacagcagccacattatacaggaagtcctatttgcctattccactgattcaccactacatctcaaacgagtcacctcttgagactcagtctctctattagcagaatgggaaggaaaaaaatgctgtccttctcattagcttcttcttatcaaagaacagtagggaaggcacagacatgaggccaagtctgtttgccattatgaagggtttcctaaacgtcaagcaacatggtgctttccatggtgctgatgatttcacctcggtcctgtttctcctttaactttcccctaaagcttgagggctgctctcccatagaccatcagccaaaaaaacagctgattctttaggactaggatcttaccccacacctcagactctcaccacctccccagcaacccacacactcacgctgaaacacacagcagattcttcaaaataccaattagctagctgtcctgtctcatatctctggctggctgcaaaagtagcagtaagaacacgccactacttggcaccatctgcctggctgtgagcaaacataggctccccagccaggcagtgtaattcaggaaataccaaggccagactcctgcctctgaccccacatgaaccctgaagtttcaggctacagatggacaacatcaaatcaccagggccccaggactccaccatcactacatcagtcacaaatattgcccttactaatagaagtggcagatggaaacataaattcttcaaaagcaatttgcttgccaaggactaaggaacgtatgaatgaagtgtgaacagtaagttttttccgagttagggaggctggacacgtcacccgctcaattacacaggcgggctctagaagacctaacccagtttaattttccatcaggctgaaaacatctctagctgacttaaaggcaaacacaagggtttgttctctcttccctatgctactccttcaaggaaggcccagatcttcaagagcaaaatgcaagaaaggtaacactggttggagcattgggcattcggtttttccaaaagaatgaggataaaaacaatcctttgataaaataatcctttgaaatcatatgccctttttcagaagactctgtagcacacaaacagtgtccttggggaatgaggactatataagcattaatcatatgcatgctctgtgatggctgtcatggctggagggtctagcaggcacccagcattcctgtcggcagctccctgctccctactgagctttggattttacaaaggcaagcacagcacaggttggaacaggcagactgaaaagagcttggactatgggcatagaagtcaggttctaagtaagttctgccattaaccagctgatactcttgagaaagtaacttcctctccctagtctcaacatcaaccacggagagggcaagtagacctgatcaactcaaaggcttctaacctcaacaagtgaggattctggttaacctcttgctcagcacagctgttatctcattcccagattccaacccctaacaccataaagggaggccttgtgcttggtgaatcagctgccacttcacccaggcctggaatgcagctgttagttactgtggccaaatgcagccattacttcaaaaccaacagcagtggcaaatggcagagaaaataaaattcagcaaactctcactgcaaaaccaagacagcagatgaaagagtggaggaagtgactgcctatgtaacatttctctgaattgcccaccttttacttctccacgagaaacagataacagaaggaagccacccattgagttggaaaatgcctcatcccttgttctcagatgaattcaggctgctaatagcactgatacttttagaaaactaaagacaaggaatgtctggcttaaaaggagtctgtcagaatgtgaaatgatgctccctttccttccttgagagtataaactggcttggctcgaattatgtctaattaggatgcagtgaaaatgaaatacacataaacacacagacatagagacactcacacaggaactggccccaccgtcctgcggcagtgcggacagattgtaatggacgcgatgtggtacaatcattaaacatctctctagcttatttgcgtgcagtgtgtctcaataatgtgttatgaggtgtgtttgtaattggctactgctgatagtggtccttgaaagggaaatggagtgtgtctaaatgcagacaaagctacttagcgcgccaggacaagatgagatgctcctcacaaggtccaaatgggatactcagggcttcttccacccatagcttgggagagagaaaaaggaataatctgtctcaattttctcagctccagaaacaatatttataaaatagaaggtgatttcagagctcatttattttcctggttcacagtccccactctctgctgacatcattttctaaccaattttatttccaacaatcacaggaacagcctcaattctacttgaaatcgttaaaaacaaatccattctttccttgtctttgagcctcatctttcaaaaactggtttaatttctatactgcctttctttgaaaaaatattccaggcctccgaatagccacaccagatccttccttctccctttcttacctcctaaatccgtgtattataaatgcagagagcacacagcttcctccggacccttgtttctacgcactctattcactattctctggctaagcacatcaatggttgtcccacctgtagacaatgagtgattccaaaggctatgacttccaaacactaggcaccttagaaactgaataagccgaagatttaaaaagtcacagaaagaaagaatcacctttcttacccagaaggcaacctccaatgagcaaaatcagagcctaccaagaaataccaagcatggtgctggcttgcatgaagactgtggccatatcctggcacagcagccacttagagcactagggaagagaatggcagcaaatgggcgagatgtcagccttcctatgtccttccctgacctcccagggaaacaaccacaggaaagaagaaccaaggttcacacggcatgcttggttcttgggcaagccatgcctgccctgtagcaatcaccacaatttttttttctaagtgctcagaaaaccatctgttctaaaactggggggaattaatgtaaagctgattggtctttttctctgagtgggagaaactgactctgtgacacgtattatcaactctcacacaggcactagattcacgtgaaaccattcttaaaagtcagattttttaaagctataactcatcctgactcagatgggttgagaaaaatggtgggaacttgaactctaactccaaatctctgaatgatttgggagtcaagtattctggtcttccctcaatcaggtaccccacttgtaagacagagttagacacactgtctcctacccctatggttgttcagcagagctagaggatttaaaacaacaggcactctggcctctcaaagacagcagctggaatgaggcagagaacacaatcctccctgctgcagctgtgaagccccagcagactacccaggatgcagatgggggctgctacctgttgagctacccagcctgcagggcacaagcctgcagggatcaaggacaaagacccagggattcttcatcagcaagcttcaatgacaccaggacagggaccttccggggtggctagcctgcaggacttcgcaagtctccaggcaaaagggccagggcttaggcttcgttgccataatgctgagcacagcactggacacacagcagatgtttgctaaacatttgtgaaatctaatttgttcactgaatcaacaacaggaaagccaaaaggcagaggcagggaggactaactgcttatttaccaggctggtttaactagggatactttcctataagccccctgtgtggcttttacccatggctttaaactacaacccattaagcagaaaataaactataacaaaccaccacaaattgcaaaaaaagctcagccctgaacccacccttatagggagtcctggcgtcatcgctatgacagtctgacatgcatcatcccttttcagccttttaaagctttttaccttttaaaataaagtgagatgctgcaggtaaacagacatttgcttaaaacattttttttttcacacaaaggtccttatccgatgttagtcatatttttctatgcaagatgaatttcaatttgatcctttcctccttttactacatcttgtttgcttctttttcatattttatttattttttgatgttttaaataggccatcagaagtacggtcaccaacaggacagtcctacagacagctgttgcctctagtgatggggctggatgccttctcccactaaaactgtgtacttgcttttttttttttttttctttgtatccctccttgttccattgaggaccctccaaagtctgggaactgagctcccatttcaattgccaatgccataaaaaactgtcccctgggaaaggctggtggtcacagctgtctttctgctcctgcccatgcagcagaagtgtcttccaaaatgcccctcccagagagcaatgagcccagctccaggcacaggagagcaaacagccagtggctgctttcttagcctaagcaccgtgtgaaccagtcctggacaaaaacctgtgcttgccaacaacactggtacatcggagccaacctcctgatcagcttgtgagacgtcccatagcatttactgacctcgtattcatagacccttagcttctcagaatctcattcctcatggtaaactgtgaaaatgctgcctaacaaaaagtcttggctaagattacaggagatgtatgggacagcaccaggcacactgtttggtatgaaacacatgctaaaaaatgaggatctctcaaatccctcctcatgacccaattattgttagatgtcacgatcgtcaaagaaaaaggccaacatccatgacctaggtcatattccagtccttctcattggaaaggatatttgatgataacatcttggccaactgatttcccagtgaatcaggatccactttgtcccccatcccctgtatgacaaagatccactatcattgtcatgggcccacagtcccctgcagcctgccctgacgtcacttcaaaccttctccttgctatctccagattctcactttgatcctcatgcttcaccaagtcctcctttctcatgttatggaatcttatccccatgtgcttctggaactcttactttgtgatggattaaacctagaagtccccaagtgatcccagtaaggaagtaattccagtctagatgaattaggcctctgcagcagtggtgttatatgcagctactaataaaattctagaaacacttcccaatgaataaaatcctttcaaactaacactgaaacccctctcttagactgtggcaggatagagaagtaaatgcaagatagaaaccttctcattttccttagatttcaaagaaatctaaattttaaaagaatatttgcttggaagtttctatcattcactgttgaaatttcagaaattgatgaagcaattctggataatggtggtttgaatgtgcccctgctgatagctagtggtgtctctctcagcaccaattcaactgcagggagccactgagagcagcacacaggtgtggagtctaagcgagacctcaggatctgccgggctgggtggagaaggtcattgcagggttgagagagagcctggagaatggcatctaagaacagacacaggagcaagatcagttgtccctgaatcctggggaaagcttggcccagagtaggagaggcccctgggaggaaggcaactccagtcgtcaagaatgttctgaggggatctcctgtctctgtggcccagaggaagggatgggaagctgaacaggcctactgagtcctctgtagcctggagctagggtagctcagggtattccttctggtgctgcaaggaaccaacagcctggctggtggtactgctcctacaaggtataggagctgagactgcaacacactgacagagcaggagaatcatcatcttggacaaacaccaccactttaagttcagttccctttctagcctcatgcattttcaaggaaatcacttctaactacaagcagccaaaaagagcagacagtaaaacacaagtaagacaactcaggcacagagggaggtggggggaaagtctcttgggtaactgccaaatttcaccctcatacaatgggccccagtacaacagtgggccttaataagcacattcctttcccttcaggtgcactaagatagggaagctaaaagcagtggggatatgcctgcagctgcagaacaatgtatgggaacagacacacaactctccctcccagataagcacaacaaagagacacaaaagcagcctaagcctctaataaactcccccaccctgaatccttaaaaactcttagtctgtaaaagaatgtgcctctgacctaactgcaccagaagctcttctcaggtttgttttctctaaaataaacctgtcttaactgacgagccacctttcgtgtttctttcctctttctttacttcttacacacatcaccattctctgctgactttgcctgaaggcagctggtcctaagctgcaacaagtgggaaaaaaaaaaaaagccacccacaaagaggaccagaagctggagacatgagcaaacaaaacacttagaaggagaagctgttgatgaaacagagctgctaaaggagacaaagggcaactcaaacaaaaaataataatagcacttaacggtattcaattacagcacatgaacaagaaagactttctgggaataaaaatcatgatttttcaaactaaaaagctcagcagagtagttgatgaaaaggatggttgctgtagagacctaaattagcggcttagaagatcaagtagaaaaatacacacacgcacacacaagagcaaaaatacaaagaaataaaaatcaggggcaaaaagaaatttcgagaacagactctaaaaacccagcttgtgaataacaataatcccagaaggggaaaaaggaacaaatacaaaagagacaagaatttaacaaatggaagtaaagaatttacctgacttgaagaaagacctgagtctgcaaatggaactgagcttcttgcaagagacatgggaaatgacatacagcaaggtgtcctcctaagtcccaaagataaggagaaaatgtcatgagctccaaacagagagaacaggtaactaacaaagaaaaagtattatgacttcagtcatacaccatctgcaaaactggaatccagaagacaatggaaaaccatccaggccaggcacagtggctcatgcctgtaatcccaacactttaggaggccgaggcaggaggaccacttgagcccaggagttcaagaccagcctgggcaacctagcaagaccccatctctactaaataaataaataaaattagccaggcagagtgccacatgtctgtagtcctaactacttgggaggttgaggcaggaaagatcacttgagcccaggaggttgaggttgcaacgagctatcaccatgccattatactccagactgggtgacagagcaagaccctgtttcaaaaaaattacaaaaaaaaaaataatcccaaacgaaccacaaaaccatccatacattgccaagtgtccgaggcagatgttatccacctgtctaatttgtagaatatttgcggatacaagagttcatagaaaacataacccacataccctgtctcaagaagatattctgatcaaaaaataaatgaactcaaacaaaaatctcaagatgggtgagatgaaaagaagagaaaacagaggtgtgatgaaccttgcaatctgcacagttaaatctaattaggtaatattaaagtgactggaaacaggtaatggaagtgacaaataagaatacctgaaaaagaggagggattctgcaaagaaaatctgaacatttagttctagaagtgttaaattatctcagcaaagcccagtaattaggggtagtggaaggtagggtgaataaaagtcttctaaaggcccatctgcccacagggtatgcaagtgtaaggaagaaaaagtactcataaaaggctcaatttactaggctgctgccaggcacagtggctcacgcctgtgaggcaggaggatcactctaggtgagcctgggcaacatagcaagaccctatttttaaaataaaaaaaattaattagctgagcatggtggtgcacaacttagtcctagctacttgagaaactgaagcaggaggatcttttgggcccaggagtttgaagctacagtgagctatgactgcaccactgcactctaccctgggtgacagagagacagatcctgtctccaaaatatatttattaggatgataatgaatgggtgagtaaaacatcctggcagaaggaggggcatgtaaaatcatcattgatatcttgattgcatagaaatatgccttcgaatgtcctggaaagaaagataacagtcagcatagatggtatagtaagatgtccaaattaaaaagggaaagagaaattgaagtagtaattggccaaaccagcaaaagtaataaaatggagaaagataaaaataaaataaatagtatatattcaattatatctactatttcactaatttttataagctgaacattcttattaaaatacaaacattatcagattgtattgaaaaataaaaatatgtattcaggtcaacagagagttatacgtaatttataagaaacattttatgccataaagaaaaattaaaaatagatggtcaaatgcaaatgaaaacaaagcaggacagacgatattaacaccagataaggtgaatgttaaggcacaatttattaaaatataaatcactaagaacaaaacaaaatagcactaaaatattataaagccaaaactcttgatagtaggagattttgattaaaataaaattatagtgtatgatttcaggattgaacagatccagtagctcaaaaaatgacataaaccaagaaagacaaggataagttgaatcaagaatatttatctaatacatatatatagagagaactatataaccatcaaataaagaatatttggccaggcgtggtagctcacacctataattccagcactttgggaggccgaggcaggcagatcacctgaggtcaggtgaccagcctcaccaacatggagaaacctcatctctactaaaaatacaaaattagccaggtgtggggcgcatgcctgtaatcccagctacctgggaggctgaggcagaagaatcacttgaacccaagaggcagaggttacagagagctgagatcacgccattgcactccagcctgggcaacaagagcgaaactctatctcagaaaaaaaaaattaaaaaaaagaatattcaggggctttctttcatatgtccaaaagacactttaaatattgattatgtaattggccattaataaaaacttaaaaattttgaaaagtagagatttgataggccacattctcatctcataattcaatacaatccaaaattaaaagtatcaaaaatcctaaggattttgaaattgagaaacatgctcctacctgagtagctcttcagacaaatagaaaatcaaaattaaaaatataaatagtctagtaagaactgaagaggaagccagtcaaaatgtatgggacacagcaaaggctggctgcatgcaaaagaaatgtacaaccctatatgccctaattatttctaaaacaggaatattcaaaaatagagagcattactagcaagaaaagttaaaattaatgactacaaatgaaatgtaataggaaggtacataaatgcaaaaactggctctttgaaaacatctataagatggagtaggtttaagaaaggataaaatatgtatgattggaaacgtgaatggagatatgaccataggtgtagaacacagaattagaagacactactatgtgcaactttggtaaaattttaaaacctaaaagacatgggttaatttactaacaaaatggatactacccaaactgaccaaagaagtagtagaaaacgtgaaaagacctgttaccatatgcaatagtggaagataggctatgctaacaagcagaagttcctgcttacacagtagtcttgggtaggtgttctggacaatagggaagctttcttccattcagttatttagagaccaaaacatcttacatcatgtggccctgccatccctagagtcttgtcacccacattatctggcagaaggagaagaatatggcagatcgtgcatgggaggttttatagtgtggcctataaatagaacccatcatttctactccattttattggacccaagttagttacatgctacttaaagcaagggagaatgtgaaatgcaatcttgctgtgtgcccaaacaacgagacatcagaatttggtgagtaattagacgtatcatggcagagatagagaaggtgactaaagggctaccattgaagaagtcaatagaactagataatttcacagctgagttttatatgatcattaaagaataaatcggcgaaagttatttaaactattctcatctgctaaaaaacttccctaattcattttatcaaagcaatacacacctaaatctaaaaccaaagtaccaaaaaaaactataaacaaatccaacttatgaaaatagatgttaaaattccaaataaatgtcaacaaatacaagccagtagcataaataaaaataaactgtaactaaatagagttcattccaggaatgcaaggatgattcaaaacaagaaaatcaaaataaatcactgcatcaataaaagagaaatatgattcaatcaaaagataaaaatccaaaaaaactaataaaaactcaaagtaaatcaagaataaaacaaaagttaaaatgtgatatagaatatctaataaaggtgagcagtaaataatgaacactaaagccatttgcatcaaaatcaagagagtccttatactgccacggcatttaattttgaaagttctcatgaatgcaacaaaataagacaataaaatagtcaagataaatctcaaaaaggagagacaaattttacttattttgataatgatgtgatttttatacttaggaaattcaatagactaattgagaagtagctactggatttaataagaaaattctggtaaaaagtatgacattgccatagtaaaagacaaagaggtccatggaaaatggagttcccagaactagaacccaatatttatgggaaattatatgacaaagtggtcttttaattagtgggggaagtgatggcttatttaattaatgatgttgacacaaatgactattcattttggaagaaaatacagttgaatccctacctcaaacctgacataaaaataaatcccagatggacctaagatttaaaagtttaagaaaaaaaaatcatataaaagtggaaatttgggatattctatgtacaatctaggacttacgatgatctttttaatcaagacagggcattcatgagctattttttgaaaagacatattcgactgtatttttcaaagccaaaaagttatatggcaatatataccataaagtcaacagtattaacaaattaatcagaaaaaaatctgcaacatatatgactaataaagaactatcaataacatgcaaagagctcttttacttggcaacaaaaagataaaccgtacagtagaaaaatagggagaggatatgaatagacccctcatagaagggcaagatccttacatgcaataaacatatgagaacatactcaacctctctggtaatcagaggaatataaaattacaattggatcccgtttcatactctttaggttggcaaaacgaaaatgacgacatttataccaaagaggatgctggggaaagagtactctcgtactttgctaacgaaaatgtagattgttttacaaagcaatcttaaaatatacataatataaaaattacagactccttttgactcagaattcccactcctcaaaagttatacttcagaagcaaaagctctaacatgtaagaatatgtgtacatagattatttcagctctgtctgtagcaacaagagatgagagataaagtgtatacccatcaaatggaaatagctgaataaaataagttacatccacactgcagaatattatgcagtcattaaaaataatgagctaggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaataatgagctagctgaccagtaggatttctagaatatatacttaagtaaagagaagatgcaaagtatatataatgtgatcaatctctcactctcctttttaataacaaccaaaacagatctgtaaatgtttatacatgtttacaaactggttacacaatgcagagagaaagctattgaagttcacatatccagattcttatgttgcttatctcaaagggggtgaagcagagggtggtgagtgaaaagatagataaataagttgcagtgagaaatatcacacagacaatagcccatttacgtaaatcatccattttgattttctctctacaacttttttcaacgtatatatcttgttttaaacaaattagtatcctaccatgaacacattttttttttagacagagtctcactctgtcgcccaggctggagtgcagtgccacgatcttggctcactgcaacctctgcctcctgggctcaagtgattctcctgcctcagcctcctgagtagctaggactacagatgtgtgtgaccacgcccagctaattttcgtatttttagtagagacagggtttcactatgttggccaggctggtctcaaactcctgacctctggtgacccactggcctcggcccccaaagtgctgggattacaggcgtgagccaccacgcccagccatggacacaattttgaatcctctttgttttaaacttggtgcataatgagtatatttccatgtccactgtgttaggaccattcctggtttagtttcctaagacagcaatttggaaagaggtgcagtggatcagcacacatctcaaataacatctgcaaatctgccagcctctgtgcttggtgtacacaagaaagaattcttccaggccctggtcacatcagcagggatgtcttcacagttcactttctccaaccaatgtgcatggactcagaccttctgaactcgggagcccagcatgcctgtccaagggcattctaagtgactttggccatggccctgccaaggcttcatctgtaaggaatctagacaggcaagatgacttccccacaggtaatttctctaagagcagctacacaaattaaaattgaaaacaggtggtcgagaaaagccagaatcaagcctggtgaggaatacagaacatacacagcaacgctcatttaggccagaagggtaagagaaagggaatgccaagttcaaatttcactgaattgcccctttaagagcaatggacatactatagacaataaaacccttaaacccaaaacatttactgaacaaagtccccagtgagtggagtataatattcccaactggggaaatctgacacactctggttttagaacaaaaataagcaaacggctttattttttaacttttccgcagtctggcccactcctggtttctattcatctctagtcactcatgctgagtcctgccaccttaggaagacctcgctgcccactgccgcccaataatctccctttctctaagctcccacagaacctgcctcctgttctacaggaagatctcctagattcagtactgtcctagatggtgttagtcatgtcccctcaactgcatcataacatggcgtagaggtgctaggataatgggatatttgtttgcatttgttctcacttccatctacctcccactcccacctctgccctgccccaacccctgacctcagcagataaccaagatccaaatgcttcctggcttccaggaagatggtattcctaagcctaaagcagagataccaggaaataggccatcttctatcatttacaaaagccagtgttatttgaaggaataaatagcccagagggtgaaaaaaagggcaatgcctttgaggactagagagagagggaattcctccagcttggaaggagaatgggatacagccagtcctgagagtggtgggtgtcccagaaggtagcagagcccaattaaaatggctgtgtgatgcccctaggaaggccggccactggacacagggggctccgggtaccacagggaagccactagcccgggataagcagaacgtgaagggcacagtcaatgatgaaacagccgtgatggtgatacctggaagactacaagctcttcccacattacctggcatggaggaagcctccagaatcgctgtgaagccgtgagtagaggaatccccatccccacatgggggaatgggagcttggaatcgcatttaactccaagaaaataaagacaagtggcactgaatgtagagctggtcttgtggagtatgattcacacaggcttttcgtgagcaagcacatcatctaatgcagggcttctcaaactttgattgcacacagatcacctggggatcttactaaatgcagactttgaatcagtaggtctgaaatggtctgagattctgcatttctaatgaattataagagacactaacccttctggcccatgagccacactgagaaacaaaacatcaggggtgttttctataaattttttctatacattttctataaatgtttctataaacattttctataaatttttgttttctataaaaatatacaaattattttctatttttattgtaaagatctaagttttgtgggtcacacagtctccatcacaactattcaacttggccattgtagcctaaaagcaaccatagacaattcgtaaaggaattcggctccaataaaactttattgggccgggtgctgtggcttacgcctgtaatcccagcactttgggaggccgaggcgggcggatcacgaggtcaggagatcaagaccatcctggctaacacagtgaaaccctgtctctactaaaaaatacaaaaaattagccgggcggggtgacgggcacctgtagtcccagctactcgggaggctgaggtaggaggacggcatgaactcaggaggcggagcttgcagtgagccgaggtggcaccactgcactccagcctgggcaacagagcgagactccatctcaaaaaaaaaaaaaaaaaaaactttattgatggaccatggagtctgaatttcatgtattaataattttcatgtgtcatgaaatattatttttccttggagtttttctctgatcatttaaaactataaaaaccattcttagctcacaggccatacaaaaacagtggagaaagtaggggttgcagttgatccataggctacctggtccatggtgcccaaaacgtatagaacccacgacaggtgtcctcaactgactaaataaaagtgggttgctcagcctattccctatcctgatgctggctttcccttcctgttatgcttccactagtgttatgctttgaaacagcagatgctttggggacaagtggattgcggcaaatgcttctttcaaaaaaatcactaaaatgactttaaaagacctccctaaatccttcttcttctaataagcagccctgtggaataacagtttcctattttagtgaaacagctttaaggatgagattaaacttcaaccacagttttctgagctaacggaagagtgacatgatcaggacaggaaattcaaccatgcagaacaacgcctggtaaatttaaaagcaattgtctcaaacttgtatccccatgtaccccggcaaagattctcttcttccccttggcctcacattccactttgactcaaaagagaaaagacagctatccattttgcagttccttccaccattaaacagcatccccagagacacagttgtatctttccagtaatacagcaatacatctaagaggaacacagtgttcgggaatcagaagtggtgagggaggggccagcagagagccactgctacacactccacactccctcagaattcacccccgcttcctacacagggcttcccacacagcagcaccccatatgggtttgccggatgttcggacaaacttgatccagtgacctggggcaggtgattttgcccgctctgtctccccatgcttgacaggcactcaaagggggaaacctccaaggagttcacccatctttcctgcttgccaactgccccagtggcactcctgccagggctctagcatcctacgtccggtcttagttccaccaattattcatggtgggaggaaatgcaaaatggatagctgtcttttctcttttgagtcaaagtggaaagtgaggctgaggggaagaagagaatctttacagggatacatggggataaacgtttgacaattgcatttaaatttaccaggcgttgttctgtaaggttggatttcctcccctgatcatgtcacccttgttgtgttgggcaagatattggacctttaggaacctcaactccctcactggtaaaaataaaggtaatcgatacaccctccagagataatattgcaaagagaaaatgttaacaattagcatggttcaggcactgtttttttgtttttgtttgtttgtttttgaaacagggtctccctctattgcccaggatggagtgcagtggtgcaatctcggctcactgcaacctcccaggcactgtttaaagagaaaggcaccaaccttaaataaccagtatgactgtactggtagcagtcgctgaatctcagcctgcccaccttgtggggtggttgtgaggaatgaataactgatacagataaagcacccagcatttctcctaaaaggcactcacattcacctctcccctggaagcctcttctttctacgtggactcctggccaataacggaggccacaaaccaggtcttctactagcactgaatgcaggacacttgacagtcacttgcgccacttattcagagcatggccagagcctcctgctggatgcaacttctctctccagacatcctggggtgcgcccaggagctctggcagatcatcctacccacagtacccagggcctgcttgggcagaaaagcagctggcacctcacactcctggggacacacagtcaacctacctgtaggaagatgccctctttggtagggaggagtgggtgatacaggcacctgaggcgcccaagggctcatcccagccaccttgaaaaacaaggaccaaacctgaaaatgccacaagaaagaagagcaacatggtcatttctttggcaattaatagcagcattgatttcacagagatcttacccctcacaaagactctgtgcccataggaaagatctggatccagccttgaaagagcccttatttcttccctgagaaaacagactacacttcaccaaggaccttacacgtggcgctcaatgcatatcagctttctcaccccccattcttcaggagaatggaaggaaaaaagaacactttaattgtggctcaatgtttattgacccacaaatatgctcagtatgactggggaaaatgggaagtcttggcacagaaagaaaagaaatgcacattataaaaaggactaagtgtaaaacgtagaaaatatcataagtgcagcttatttatggttaatagcaggtatttgtttttgcagctaataatctaattagcagtcaatccaatacatcctttattatcagctgatccataattactgctccatgctgagtattttcctggcacatgatagctttcaactcctcagcacaaacaaccaaataatgtggtgttatgctaaatacaggacgattcctctctgaggggtgatgctgcagtttttagccattcatgatggcctttgtattttcagcatctgttggttaattcctcagtgtcctctctttaatcagtcttcaggtattcctaaagcaccttaacactctcaaaaatgtgatactttggagacttccttttttaaagtttaaccctaggaccagacacattcccagtcatctgtggcaggacagcattcataaggggatgtcagatagcggtgaaagcacaaaatatttctctgaaaatattgtaaagttttctctttaaacattgttttaaaatgactcatcctgaaagagatagcttctgatgtaagactatttcatccaacaatttctgatctaaactgttcactctgggaagcacagtgaacccaggttctaaaggcaagttgcaaagggaaaaatacattcaagtcctccctttcacagactcaacgtggctgtgaggggagggaaggaagcttggggtgagcatatggaagttgaaagagggtgggtgctctggaggcagacagacctggtttggaatctagatccctggcttacttataaacagcatgatcttggatatgtcaccaagcttccttaagccttggtgttcgtcacatgaaaaaccaacctaagaatgccggccgtgcagtgttgttaaaaagaatagatgactaactcagaaagcacccaacacttactacaggctcagattgttagttctctgcctgttcttctggatgcagaaacaagaagcgagtgttctacaagccagtagctcactcacatcacataattctattctctgcaatcacactttcacctcttacctataactctaggtagacttcatcccagatgtaccatggggctactataccagccaaagtcctactcgcagttcccattgtcctgcatgcccctccactctacgacccatcatcttcctatgatccagcacatactttggttagctggtgcttgtgccatagcagttgctaaatgtctctctgtctataaaagggagtaagacgtgggtaactttcaaaccaagaccttttccaaagacttatttgggaaacagaaaccagtggctatataaagaatggaaactgctaggctctgaccctaaatgaggtgctaaaacttggagtcaggagccacacactcagttcagatctttctttttcaactttttattgaagtagaatgcacaaagagaaaagaacatgtactcaaggaatttcacaaggtgaacgcacctgtgtaaccagccccccaatcaagaaactgaacagtgccagtgccccaaaatgtcctgtccccatccagtcagttaccccaacccaggtaaccatgaactgacttacaatgccagagatgaatttcgcctgttcttgtactttatataaatgcaatcacacagcctgcgggtcaaatctggcctgccacctgtcctagtacatcctacaaactaagaaaggattttatatttataaatctttcaaaataataccaaaagaagaatacttcatgcgatgtgaaaaatatatgaaattcaaatatctgcttccataaataaagttttattggaacacagtgacactaattcatttacatattgtatttcaaactacaactgcagagttgaatagtcacatcagagaccatataacctaaaaacaaaacaaaacaaaaatacttactggcccttgacagaaaaagtttgcctgctctaattcaagtgcatgacattccctaaaatacatagcatttctgttgggtttatatgtaggagttgaattgcagggtcatagatgtacacatatgtttagctttagtagacactgccaagaagtttaccaaaatatacactcaattttaggagaaaagctaaaatctggagcagaaatcataatttcagttttaagacaggcagggagaattatagagagttgatctgagcaaacgattagaaaaccatcagggcttccaagtggagagggaaaatatcagggtcatctaggtttacatttcttttcattcttattccacacatagtttttaaaaatgcagtgtcctttaacattgccatgctcgggggaaaaggacaagagtaaaaaagtcatgtttctgcttgggatcttagagcagagtaccaactttattgtttaggccatgtcacaaaaacaccaccatgggcccaggagcttactggaactgcagacaaaatatccaggaagacatcagcagcctcctgatcttacgctttcctaagtttaaccacatatgtgggcagagcctacataactcaaacccaacctccaaatcctccacaaagagtctggtccctgtactgggtagaaccagcaggccaccaacgagacagaactgaggagttgtccatcagttttcaaggctaaccagcaagacatggcagggtgcccccacattagaggcatggccaggacaccccggcattagagatgcaggcagggcaccctctacattaaggtgacgttggatatcttctaaagtcacttcctggagtcatttccccaggcacttgcttgcatttcaaataggatgtgttaggttctttcaaatgacatttttcctcttggaaggaaattgcttcctatagtttaaggaccacattcatcaagaaagggactcaaacagtttgtgtcttaactccacaaccctgctgatttctaacttggagcagcctaggaatgaacagcacagcctcctgtcctgccagcaaaccctgcaggcccaggagggaggtagtagcagggcagcgtgggctcctggctaggccagagtcagaacctgatgtggggtacttgtggggagggggaagggcggagagcctctctccacttcttgcaccaccgagtctgccgttacagtcccagctctttccactccagaaagcagtggtcccgtggactggccctgactggcccaagcatgggttaaacttggcctttcctagaagaaaacccaaagtcctccagaccctctggtggccttccagagacaagctctgtatttcccttaatcccttttccagttcccttctgtaagttaaaaaataaaattgaaaaaaaaaaaaaacacacaaagcaatgctggtgtttcagcagagggagggcatcttttctcagcaagtgcactagctttttgtccatatgaaaacaaacatataacatacacatatatatttcatcttccctggcaaaggaatctcacctgaagttgagcgtggctctaacagaaacagcatatgcgtgacagtcaaaagagcgagttgaagcccacttgctgattaggctagcttgcccaagtccctaccctgctatcacctcagattcatcacagttcagaaaacgagaataataataacactcacctcacaaagtcgcagtaaggatcaaatgaggcaactgtggatataaatgctttgtaaactgtaaaacatcacaccaagtggtggggaaaaaagctacctcttatcttcttttcctgattcaccctttaattagtaaagtctttcagctagctcctcttctgataaagaccacctgcccaccataaggacattagtcaattcagcacccagctggcagccatcaattggccatctattaatagccaattatctgggtgccttaattaatccacagaccacgtggcctgatctccctgagatcctaggaaacaataagcctgaaatacaggcaccagctaatttttcagtggccatcaaggaatct

SEQ ID NO: 2574 - DNA, 228263 bp, Homo sapiens; identical to SEQ ID NO: 2571

SEQ ID NO: 2575 - DNA, 1114033 bp, Homo sapiens; identical to SEQ ID NO: 2408

SEQ ID NO: 2576 - DNA, 1114033 bp, Homo sapiens; identical to SEQ ID NO: 2408

SEQ ID NO: 2577 - DNA, 890001 bp, Homo sapiens; identical to SEQ ID NO: 1865

SEQ ID NO: 2578 - DNA, 896661 bp, Homo sapiens
gtgcaaatgtgatataacttttattcagaaaggaaacaaaaagattttttaaagtctgaaagacaaggacattttacataattttcatttaagataaaataaaacaaattgcacaaattaaccaaataacactgatcatacaatactctttaaagaaacaattatgtgctaaagtagccatatagatcctaaaaatatttctattgggcctagtttacaagctcctgtacataagtaattataaatagttcacatctagaaaaaatacacataacctttaaaatagaatttatccttacatataaacagtctttgtagaaaaaaaaggatattaaaaagaattcttcgtagcaccattaattttatttttaaaagtgaacattgcaaatagaaatttgttttcatttttagagtgcccagattttaataaaaagagcaagaagataaaaatcaaataatattcaggatcatagagaagcactaagtaaaagacaatctaaagaaatgtctggaaggaaaaactggtattgggaatagaattcggtcatttctgatacaatgtcacactcccaatcagtgtccacacttcaggacccttttcatttttcagcagaagcagaatgacacttattactatcacctgaatctctggcaacgaatctgaaattacactaaaatgaacatttccatcaaattgagatttgtgagatggagatgaggaggaaccctccgattttttggcaggccctgttgtaggtttacagagtgtacccacaaacaatttgaggaccaggacaacgaacttcacaaaaacttcagttgggattttaaaaaatatatattatcatcaacttctaagacttagtacattatttcaagagcatggcactgattccatttattgctgtctttttttgctacaaatataatttctcttccaaaaaatttacaacttctgtacaaatattcaaaaaaagtgcaaaattaaggattctgtatcatagatgtgtttacgcttaatcctcttgaaacacaataaatggagtctatctttattgccctgtcagagaaataagctctggtgggttgcctgctgtgaatttgacaaggaaggctctggtactgcaatagtttattgttatctctatcaagcggtgcaccccccaccccccacccatcatttcttaagcgctccagtcccagctcactaagggaagagatgtcctttatacatcatttgaaccttgactggcacaggaagagaagctatcatataaagaatcactcaaagattccaagttgtctaccccaggcctatctgaactactcaaagatgtctcttcatttttttctttttcttccttctgtccttcaaccttgttcagagagttcttctctttttctaataaaatcacagtattgctgttaaatttattgaatgactctagggaaattttcgataatctattctcgggatcgtcttttgtttcttcaagttgtctcaatttctgcaataaaaagaagaaaatattagaaacatatttctttggaaaatcaagttatcctatctaatattcaattattgtctgtataaagtacagtttaaagggacagagaaaacctacaagtctttaataatcttctagtataattagatgtaataataaagccaattttagggataaatcaggactttaatcattttactgagataaataggtcccaatttgcaaattaagtgccacttaatttcattttaaatggatccatttgaaatttgttcaggtaaagtgccttatttttcttcatcaaagtttcaaactcctctctttccttgctaagtattagctgtactttttctaaatatgagtaggtattgaatttcagccagaagttatggtaatatgtttttttctaataaaaaaaagacataaaaatcccctaacttgccatttttgaatacatgttaagcttgttagaagcattgccattttagtattttgtccctttataggacttaagatatttgaaagagatctccaggtttttgggtgtagatcccagaaggcccaagggcttaaaaattaaagcggcaggtgaacagctgagtaacccctctgctccagaaggtctagtaataccagtttatactgggatattactgttattaataccctgtatgatgtataaagcactgcaccaaattcaataattatcataggtaaaccctgtaaacatgaatatattcggttgctcagttggctcctaagggctaaggtgaggacagagggaggcacacttgcgaaaaacaatgagaaaaacagacatgtaaaagtgtctacaatatttctcatcttcttttcctctttccagcagaaattccatccaaacacaggaaagaagcaggcccgggggcttggagatgatagtaagtgttaccatttattaagcatccactaggtaaaagacacttaacagattctatcagctttttcacaaacctacaaggtaaacgaccccattttaaagagaaggtatgcaaggctcagagtgacagagatatttgcccaaggttgcccagcaagtggcagagaacaggatttgaatttctgtctggctgccttccatgctcttgttctttccattaaaccatgttcttaggtaataaaggacacaatgtcctgttttccattttgttacccaaaaattccacttaaataacttgccaaaccgtctctaacatgtgcagttctgctgtgcaccatgctccccacccccaacattgttatgctggactcaacaaggttgcaatgaggaaactgtcttttgattgggaaaatagatatagccaaagcttatggattctcacatgctaatgtgaagaatggaaagagaagagagagatggaagtggatggcttctgtgttccaagagcagacacgggcagaatttctctgctataggaaatggtataattctatgggaatatttgaaaatcatcctagatctagtgcttatttcattatactactaacgtgcagaaacattactcacagagctaattttcaatcacacacagctaccctgaaaccagaggcgggctaaggaacagactcctagctgattacagaaaagtggctccataattagaaataactccatccaagggcccctttcaacaccatgccaatttgcctacatttaccaaatggatgtaaataaatggcattcaatgcaattttctctttacctggatgtcttctccatttttcttcatttaagaaccacaagtatttttcttgcctatttctcatctatgtggatctcaaattcattcaacacacactcattagagaagctactgcaaggcaggctgaaggctttggtactgaagatacacagctgaataaaattgtgtcctgcagggtgatcattgaggccctgagggcagacaggctgagcttcgatttcagcttggccctttcacgggctgagtgctacaagcatccttcttcaggtgtaaaatggtgataagatacatctttatttcaggactgcaataagtattagaaataaagaactttaaagctctggcagacagtagtgggtgtgcaataaatgtaaggctggattcttattctagaatggtggttctcaaagtgtgttccccagaccaacaacgtcaacaacaccaaggagcttcctggaaatgcaagttcttggatcccacctagacctactacaccagaaactctgagggccagcaatcagtttttaacaagattaccaggtgattctgatacatactgaaatttgagacccactggtctagaagaacatgacccctggagggaagacagacaggtggaaatcataattcgttgtgaaatggtggaatttgggaagagttaattgccattaaaacactcactgtcatcaggttttcaaatgtttcaggcttacagatttgttgcttcagttaattataacaaagacctacactggccagagaggttatagaaatgaaagaagggaccattatttaaaaaaaaaaaaaagcaaacaagaaacatgaacttctcgggtttccttttatttttacagttttgatgaaaagtgactgcagacatattacttgactgtaaaaacaacatccatgcaaaagtgaccatatggaccaactagcattcagtctctaggcagagcagccataaggagtggtgagggctgcagtcagctcaggagtatgtgctggatctaaaggtggtagcagctacttagatctagctatgcagaaatgtgggtgcagatctttcgatttcaaagatgaggagatacatctagatcaatatttgcttatatttaaaattcacttacttttaattcttggctcacatttaaagaaaataacaaaatacccagtatgtataccgaattgcaatctttgcactgtttgagtttctgagctagggatgttgttttatccttttttttttttttttttttttttttttgcagtgtcctacttcacctcatccactcccctatttcccttcccccagctttctttttgaaggcctagtccaatgctacatcatcagtagtttctcagtggagactttgcctaggatcagaagagtcttaactatgagtctgggctcctcaagtggtgctgccagctacgaataaaaacactgaagtggcttacttttctgcctataggagcataccgaacctcaacattgtcttgtcagatctcagatatttttaaaattttgtagttgaataacatttagatttaacatataaggagggattgaggtgaaacaataatgtgttaatgatctatctggcaaatgacaacaaaatagtgcacattagtttgcagcaactatacgtgaaagtgctttgcaaactaatcatggtaataacagttaccatttaacagtgtgtgttctgtacagacactctgctaagcatagtgcatagattatatgtttccatcctcacatgaattctacagggtaggtgccattagtatctccatttataggcaatcaaggcttgaggaaggtaagtaacttgtttaaattcctgtagcagtatgggatggactttggatttagagctaggcagtgtgcctgcagagatgaagctctcaactttcatcttggaaaactactttatgaatattagccaatattatctttaagggaagcatctgaaatagcaattacagaacaaaaacaataatgatagacccggtgaagattagtgtttgatgagaattgtgtaggttccataaaacatcgccaattccttcctgtgttgtgcttcatcagaattatgataaaattaatatactacatttgtcacctataggtggcaacagttgtacagatgactttttggtggatttttttttcaactacacttgggaataaaagtagggctaaacagacaagatgcaaatacattttcaagcttaaataaatagctttgcatgttcttaaaatattttcctgcctttagtgtaaccatggaattattagtgataattcaagcaagaagtgtatagtggcatattctccagaaatctcttgagaattagacctttattaatttaattccttgtagtcaagcagtcattcaatcaaactaatctactatgtgaccagctttgtgcaaacagtcttgtggtcttgattctcagaggaagttttatagaaaagggtgctcttggaatggttttgaagggcaaataggattgaaatacacagtaaggaggagggagggaattccaataaatattcatctattatgcctctattgcaactgtgcaacactgtgtagtctacttcaggaccatgagttgcccagagggtctctccctttggggattctgtagtagacaatcactataaagacagaaattgagacgtgcctaccccaagaggttctaggaaactcaaccagactcatgaaagtatcagcccgtacatgggttataaaaagttttgacttccaaactgcgttctaatctatgactcactttgctcttccatcagcctggaaggtgaggaaggccagagtcagctatactttccacgcgatatttatggaatctgtgattcacacagattcaaatccaagtgaaattagaccttaaaacttagttttctgatttttcacacaaaaattcacagtagttttttttatagttcacaatagtcatgaagtagagatttttgactagaacaatatcctgaataccaaggataaaattggaggagatatggacccttgccataatgaagaggtggaaaatatgtacggtgatacagaaaaactcaagtgataaaccagcaaaaaatatatgcatgatggtatcagcttcaaagagatacatgttatgtgtgtacagccagaaactcctgttcatggtagaggagaacaaatagcaaatttatgaaatagtgcaatcaattattgttctatgataaatgctactctttcattatttcaaatacatttccatcctttgattatgtcttaaaaatattggttagtatatctagtgtcaggaagagatccaatctatttgtgaaattcaaacacagcattgttcctcagctgggcactaacatttataatgaggattggagctcttagcacaagttaatgcaaacaggactttaatcaacataatttcttatttctctattgctatagagattcactgcccatggatcaagaaaatatgtggtaggaaaatagccctatttataaagtgtttttactatgagtcaggtactgggttgaatgcactgcatgaaatacctcatttaatcctgacagcaagcctatgagatagcactattatcatccccattatacaaatgagaaaatgcagatagcgaggtctaaatgttagtccacatatatgtggctaataagttaggcaatcaggatttgagcagaaacagcctgactacaggacttgggatcttaatcactgtgtattaccccaggtttttaaaaaccagcgtgcaactcctggctttgtgctaattagctgtgtaagccctctgacccttagtttctttacattaaaggtttttttgaatcttcccagtctataaagctctgtgactctaaaatattcttaattggatatcttctgggcgtctattattggaatttgaggtggcacaataaccaaccctaacacccccttccctactttagttctcaatgacttaaaaaaataaaagaaaaaggctgacgggaggccaaaagatcagctttactaagagaaagtttgattggagaacaaggtttccatctgtaaagaagtgggtttcctaacactgatcccaagatatagacaagcttagtaattagcagccctgggctgggaaacaagtgtcttcctgtaaaaactacagcatgaaggaacagaacagaaatttgtgcttctgacagtctgattccagagggagactaggaagagcaagaagttcccttcctgaacttgctaggcaagtcagtccctcattccctgggagaagtgaataaggggggcccagagactccaggagggttaccctaggaagctccttccatgtttttctcaaacaaaagaatgtttgagaagaaggtgtccaaggtgtcccctactaccacccaacatctctgattacatatgatgcagattttaactagacagtcatatatggatgaaggccaagaagatgctggaaaattctggtgctgcagggagttagtttgcacagagaagtgtctccatgggcaaagaaataggaagatggtgatccagcaggtgtgaaagatggcagagcttccatttggaagcaaataaatgaagtctaagagacggtctgtttaatcaagggttttgggctgaagctgaacatgtgatttaccccatcccttttctgatgaacaaatcttgagcactgggaagatggattcagggaagagttttatgttatgttcttgttgtgggaatggtgaggaggtattttaagccaaggtctcttagttgaagatttgtgcacatctcaaagtctatgttaagtgctatttgcgaagggcaggccaacctcaagggaaaagatgcaactcaagtcatttctcttttctcagaggcactagttaatcacttccttaatgccgcctcttactgcattcctggtgaagctactttctagatgagacataaaaatagatagaatgacctttggtgatcactagagacccctccacacttttctcaagagttgtgatattaaccctgttaacctggtcaaatttcaacttggatattactttctcccggtgctcggttccctctattacctcaactggacacattactcttgacttgcccttctgaaaaattaaagtgacgcattggtaatagagaaccactctctccctccaaccacactcacggagatgtgatttggcacttgggggcactctgttttcttactggggtcctagagattcttcagtatcctcagggcaaacagattttattaggtgaaagagtaattttcagcagagatgtgcttttatgactatattaactatactgctgtcctttactgtgatcgatggtcctcaatgacctctccttgaacccctaaacccagaggggggaaataaactcactttttgagaaaaagagcaagcaaagagaaggtcagtgggaagcttagggttgttagaaaataatacaccttgtggaaaggaaaaggatgcattttgaagataaacaatggctacaaaggacatttaaacaccagatcaagagtactgaaggaaagagaagtcatttcatcagtgataagaaacatccccatatatggaaaacgggggaaagatgggaggggatgtcccttagtaggaagataaagtagcaggaagaaaaccgcaaatttgcttatggcacagaaaggcatctgggaagaggaaaggcatgtaagttgggataaaattgttataagaaacacatttgtgatttctgcaaactctgatgttagcgtcatcatttccaatgcccatttgaaaatttggattttctgttttccaggggggaacagatccacaaagacaatttaaaacgtaggttgactgcctttaataatgcttccgatttgatgagttgtggtcaatttctccaaaagtaaaatgtgcactattttctgatgatccagaattgggcaaacaagacagctcattgctatcagcctgtgtaaacagcttaactaaatggaacatgtttctcggtgttgttagattcctttttcttctagcacagtaatattaattaaacaatttatgcaggaatgataattgagcagttcctgagatgagaacttctaaatctactcaagtaaggttaagaatttcagctgacaagagttagggcatcaagattttctgcttttcatttatgtataccatatgagtaaaaataaatatacatactactcacttgacttaaaagactgattagcctttttttttttttaactaccctttgcatcgttttatgtcttaaatatgtcttaaagcctgttcagcaagccgggccatggcaggcttaggtgtcactgtgcttgtagcataaaaagtccgtgaacttttgtcagatgaaaatgcagcatttacttatgtattataacatcacagtgctatgttttcattttggagtgatagattttttactgtttgtaaaagaaaaaaataatttttttgtgtggatcaggtgaatataaaaaaagcttatactactatttttcccatggaagttccccttccaaaagaaaatctccaataccattggagatgggtggacatcatagaattatacctgaaattgctaagtttttatgaggtatgcggcgagtgccaaagctagggaaaaacattttatgttattcattaacctatataaataactagatgacctggaattacttccaacagagtttggtaggccatttaggagccacagtgcattatggcacccaatttattaggcactttacaacagccatggaattaaatgggactgcaagctaaggttcatccaggaacatgctgatattggagggtgcaagaatgtttgctccactgatgtgtgattcatttcctactgcaattcatgttttgggtcaagagctggtcagcttttcatttggataaagttatttgacatattgaatcctgacagccaggacaattcagaattggaacaaatttattgatccttattctaaaaagaagaatttttttttggtgggaattgttttaaagattctttcaacgatcaattctgtgtggcactctagtttatggcagcaattgtaggatgctcttaatggtcactacccaggaagcactggggttctagaatggggagacatgctggtggggaggttgccgatgggaatctgcttccgttccagattccatcccttgctctaccacaatgtgacagtgacaatcaccacttcaactctgtacccagattgtaatgaatacttaaatggggagtctgctgttcctgccacatcctttgtttattctttaggtatttaccaagtacctacaatgtaccagaaagtattctagatagtagagatacagtggtgtatgagaaaagtcacatggaatacatgttaaggactttttaatatgaagcaaatatggaacaaagcattagatataccagaaagtgagtccctgaaaattgctttgttgagttagaatcatctacccagtctgctctttggtctaataatggcacctagaacacaaatatcctgtcaaattcagagttatggatgtgcccaccccaaaggtatttttggaataactccctggattttctaaagcttcttttgatcttcttccattttcagtctgtaacatcatttaggcagatatttttcataggttaactagttactatttacactcaactttcttaacctttctgagtctggtgactttctgaaattgacatgtttaaatcagaatttctttctttttactttttttttttttttgagacagagtctcactctgttacccaggctggagtgcagtgatgcgatctcggctcacttcaacctccacctcccagttcatgctattctcctgcctcagtctcccaagtagttgagattacaggcatgcacctccatgcctggctaatttttgtatttttagtagagatggggtttcaccatgttggccaggctggtttcgaatacctgacctcaggccatccacctgcctcagcctcccaaagtgctgggattacaggcgtgaaccaccgcacataaagatagtctatagatggacgaatatgctatccgttctgacatcccgaaaggaccagagggagagggtactgcttgaatagaacctaaaaaaaaattcttccaatctcattagcccaaatggatggaaagaaaaggagggcaggcagattttaggttagcatcaagaaacctcttggattaatggaggtctgactattggttactttggcaacagcaattttctttttgtcaagagcaaagacatgtggattcacctcccatggtcacactggtttggcagctctgagccatctggggctttctcctgcacctctaggtaggcttggtcagcagttgggtgaggcagcagctgccactgctttatggaaatccaggtgcaatagccaatacaataagctcctcatggggcaaaatgttactgaaaagaacaggcccaggatattaccttggttcaaaagtaattgcaccaacctaatagatggtatagacattgtatctacccttttcttaaattctttcttcagccagcaagtgtcacctcacctggtctgagccaagtccaggcaatttgctcaaattcagattcctagctacttcaggcagaggaagtttggtgacccatcttggtgcttccaggtgacaatagaaacatcatgctgatgacattcttagaggcagcaatgagattgactacctgagtgataaacctacaaatattactggatgtatcaaaccaagaaattaaactgtagggagattaaattatagctgtcgtagtacaaaattctagtaccaggtaccacacagatgctatttagtctctctctgccacatgaaatatattcattcagcaacttgaatattgcattataaaaggtattctcttcaactggctttatgccactttatcaagtttaagtcagccatttgctacaataaaaataaacttcatttttgtctcacatgcacaggacaatttaatttttaaattaatgtagaagtgaaaggtgctttgctccaagagaagtatgtctgccctgcatggctgtgtaaacacaatgcgattgctatgagaattaaatatggatcagcaaaatcaatagttaattgtgtaactcagggtctttcatttcagatctaatctgtaaagaaggtccaggggatgtttgcttttgattttcttaaaatattatttaaaacccttctgtcaggcaagaaagttcacagggtctttacattatttccataagttatttggcttgtgagtagtcaaggtcatattgatcgcccagcctttccagctgtccttttaaaattcagtatctttatcagtcaaactgcctcattctgagtatctggcttgcacttaggctaaacaaattttattgcaaaaataacccaacgtaacaggtgtcttggtaccagacatggatggactagttgtattataaactgccttttggtctatgtaataataccattcggagtggctaagcagtccccttcccctacaaagttgacaaaatatactgtgctgtgaaaatgcaagatgttgtgtgacatggcaagaagtactgtagggttgggctgagtctatagatggacgaatatgctatccgttctgacatcccaaaaggaccagagggagagggcactgcttgaatagaagctaaaaaaaagttcttccaatctcattagcccaaatggatgagaagggaaggagggcaggcaggccttctcttgcaaaacgagtagcacagtgactgcggaagactgtgggggtaacaggcggactgccttgacccctgtgatatcacagcagagctaaaaatgtaatgtttgaacttcttttccctttaaagtgtaacctttcatataataagttaagccttgctctctcttacatattgttagaagccttcatccattttggggactgaaggcaaaataattcttgaaataatgaatcatttttctcttaccagcttgtccagaaatcccatgattattttgctatagcagacgatgaccttctcaaaggaagcctatcaaacgctcaagataaataatgagaaggtctctctctcctgcctccaggaaaaaactgcacagaggaaaaatgtttgctaaaccattaatatgttcatcccaggatgggaagcagcttggtctaaaagaaacagagtggcacatgtgtttgtgtgtgaccagtggccccattcaacaggactcctggggcagcatccatggaggggcctcaggagacacacctaagccctttacccagtaacgtcggaaatgaatgtttctctggtggcagacagggtaccttctaaacctcttgactcatgagcaaattaactcaaggtaaggaagcactgggtaatgccgtctctcaacaacctagaaaaaacatggttctgctttactaggccctggaactacaattaatggtaatgaattccctcttccctcacattcccaccttcccaccaggcagcaaatactcaggtggcaaaagaagctttctgtctgtttttctccccatggaagcaaggtttcgcagagtaggtagagagctgcagtagaaattgcaactttcccatgatttaagtgctttggctgccctggagaatggggctgatttctcagggcaaaagtcaactctccatccatttatggctcttgtccaatctatggacagctgaagacacagatcttaactccaggagttggtgtaagatccttcccagcagtgaaatggaaagagttttcaaagacatagggtcctctatgggaagaggtgggagagtcaggaggtgaggaagaaaattttctattccaaggcaagctcaggaatcaatgggctgaaccaagtagtacccaatggctgggtaggggcaagggtaaaaaagcaatctcaaaagtaatcaggattcaaatgatccagggatttgcagataaaattaaaactgctcagcaacacttcaggagaaaaagtcagtagcatgcagatagttatcaagcacattattttgccagccagctgaggatggcagcaagctaaattttgagtccagaaaggtggttagggtttctgtgctctggattgtacatcttcctctctctaacttgttctccccaccttttaggatggccaacaccctcttatcacttgagactcagaagaagggaaatctcctctgaattcttttctgaccaggggccctgatgactgccccttgttgtcccttcatccctgtgtggaccattctcatggcatggtgggtatttactgtgtatatcggttgccatagctcagtctcccttgtagggactgaacctatttatcttcacatctcttgtggccagaacacacctggcatataggtggtccataaatgctagtggaataaaaggaggatgctaattatgtttatttactggtcatccttttcccccctatcactttaactttcacctctctaatgccctttaatgtccttgaaagcgattgaattcctaagacaagctgccatactttctggtggagaatacacatttatttcctgaagggtagttaatgtctaatcacccagaagacatttaggtttcttttatttagaaagcggagataataactcccccagtaagtaaacaggaaaatagactttgttcttcaaaaaaaatttgattaacatagtttcaaggaacatttctactgttgtaaaccaaggttcttgaaataatcaacaacattacagattgcaaggttagagattaaaacatgcaaaataagtggaatcataccatttagcaatggaaagacagactatgtcggtgaggtgttttaaatacccaaacagttttatgacaaaaaaaatcctcactataaacaaaatgaattagggatttgccttggaatgaaggtttaaaaataatgggatgagtttaaagaatactgcaggcccttaaagacgatgagagattttgagaggcctgagtgacttcagtggggtccatccctaaaataatgaaggactaagtaagtcaaaccttagggtcgcctctgcagatctttagcctggcctgtgcaattgtattgcacagaggaatacaatatggcaggaacagaccaatgtaacaggtagcaattgttcacgcaccagatctggcaccagctaccagagggagggtgaaagaggggaaaattatcttttcttcaactctgtgaagacttagagtttcagatagttaaatgtgagtgggctggtgtttcctctttgctagatttagtgtgtgcggtttctctgccatgtatatctatagttctctaaagtgactggagaaatacttttccttaaatcagtggtaaagaagttactggcaaaatgtcccttaaatattcctgttgggtgctaccaaaggattatttaaaatcatgaaaataatccaaaagctgctcccactggaaaatgactaggagaaagatgtttaaattcaaaactgctaagcacggacacctacctaaacacacacacacacacacacacacacacacacacacacacacacccttcctctgaagctttccagggatagctatagaaatttcattttaagcaagggaaaaaaaaatagaatcaccccctcacaaaaatgtttgagtatattttggtctcttggtcagggccaataaagatctcttgttgtgagccaactagaacagaaatggagtgagagatgtactactttatgtggtctgaatgtgattagcgattagcgctggtggcttcagtcacttgggaatggcaatcagggttttgctcctgcaactctgaacgactacaaaacacccttggcttccatcccatatgatgatgggatattaactgaaaatctaattaatctgtgaatgaattatggcctaagaaatataccattttataatcaattttaagcgagtccctaacagaagataagatgaagaaaaagctgtaaaattgtaagaggttggtacattctgttcactatgactgatgattttaagggggataattttacaatccatcacatttttgtcattttaaaaatcatgcctcccaatgaatgttgtaaattaactttagaatttacatatttattaaaaattgtatagaaaacagcaggaactgtgccccatttgaataataaaataacttgttattccactgaagacaaaaacacacaaaaaaatcaaaagattttattttcaggtaataatcatattaattgctatctgaattagttaaaccaagaattaatattcaccagaggcagtgacacagcattaaagataatcctccaaattcccattttcaaacatgtctcagaacatgtaaaagcaagggaaagacaaatggggaggtgaggaccatgttcttagcctgcggggttgggcagcagcagatgtttgaagctgagctacatcacctgggggaaggggaggtgcagacagcaaaacacatgatttggctctgagatgaagaagcacaggacttcattttaaaagcctctttgcttgtgaggctgaggtgggcagatcgtttcagaccaggagttcgagatcaccctgggcaacacggtgagactctatctctacaaaaaatacaaaaattagctgagtgtggtggcaggcacctgtggtcccacctacttgggaggcagaggtgggaggattgatcaagcccaggagattgaggctacagtgagccgtgatggcaccactgtactctagcctgcgtggtggaatgagacaccaactcaaaaaaaaaaaaaaaaaaaagcctctttccaaaaagattctctactctacttctcctactttggttgaactccctacccagaatggaaggtttgctggaggcaacagaacatcccagatgactccagagcatgcagggaaataaccagaagggcatggaaccatgccacataacatgtgggtgaatacaaccattcactctagattaacctcataatggactgtcaactcaaagaactggctccaagataggaactgcatggattcatccacagaaggatgaaggggtcaaggggaatagaactggtgtgttaccacatgtactcactagtaagagtaacccattgggctgaactgacacaagatgttctcttgaaattcctgagagatgagggagaaggataatgcagtacatgtttttcatgaacttcagtttaatcatgattccttctttccatgagggattcatgataggctgttaccactatttttaagaaaagagcagagatccttcatgaagtactgtagttgagtgtgaggcttggctcacactgcctctgctactcagagttcattgcttcagtgcagacatggctaatacctggcacttgtgcggcaaccaactcctctcatgcccacagcaggcattgcttatcagtctctgtcatctgtcatctgtcatcccaagcatggatagggcctcagaatccttcttaacaccacaattcaggcaacctctgtctattgattgtccttggcatttgagatgaaagctatcttgcatccttgtgtgtgtgtgtgtgtatttatacatgggaaatatttatatattatcagcatataattaaatctagctagctatatattacatctatatacagagatccaaatacctatattatatctaactgtctgctaatggtgtagtcatattccttagtatctgcagctaatatgagatatagattgatatcttagtatatgaaaacttgaagtcacctttgactcttctctttgtctcatactccacatctaccagtcttctggtaaattgcctgtttgttctcagaaacagcaagtccttgaataatatccttttgttcaatgttatttttttataacattgatgagaaaaaaaaatcaattcctgccaggccactgtctgtgtggagttggtatgtctccccatgtctgtgtgggttttctccagggacttcaggttcctctcacatcccaaggctatgcgtgagagataaattggtgtgtctacatggtcccagcatcagtgagcataagtgttctgcaaaggaactgtgtcctgtccagggctggttcctgctttgtgtcctaactgctgggatagattccagccacctgcaaccctgagctggaataattgggaaaataatggacttacttgtttttattcacctttcttaagtacgtgtacagttcacatgtgtttcaatgtttaatattagaagtgttctggtctctgtttagaagtttagtaatgtttctgtgaccaggaatatgccctaggaactcagctcttgcttgtatcaattagcctcggataaagttggtttctttatatgttgttttgcctaaagtcacagcttctgagaacctacaactttaagcaaggacttactgtgcattcttctcctttcccctgctccactctgcaccataggaactacattttccaggctccctttatttctggcttctgggaaggttcagccaatgggaagcaatagcagaaggcagaagcctggacagtaagaggagggggggaaacaaggcatttctccccttctctgtgtcctgtgctgttcctagcagcacccacttctccctcactgctctaacttccaccatgtgccccttcccatccatggttttagcttccattggacagtccagcttctagactctaatgtcactctgccatttccctccatccttaaagagggtggtgacttcctgctctgctaatttctagatcatgactgtctcctgttgagtatctcagctattccattatttggataagccgtttactgtattgaattccctctactgaaaggcctaaaatagttcccattccatgctaggccctgaccaatacaatcaggaaattctgtttgtgcaactttaatccagtcattcttcaccatttgttttttgctaccatcagctcttgcctagatgaccacattagtttcccaactgtgcttccactctctcctcctgatagcctgttcttcatacaaaagccaaggcatcccttagaaactgtaaatcaggtcatcccactcccctgttaaaactcctcagatggtttccctttgctgacaatgaatcctaaaattctccccacagcctataaggtccgatataagtggctcctagattcttctccacactatttctcttcctctctgtggttctgctccagccataatggtccagggacacgtcacacatacccctccttcagggcctttgcacttgctatacccgctacctaacatgttcctctttcgattagtcacgtttcagtgtttcacttcattcaaacctgacagagcaagagaatcaccatcttggacaagcaccgccattttaaaatgccccttgatcaaaaaccacctaaatccaaagggcatcagcctaatggctaagatcagcatgaccataaatcacaaatgacatctccgaccagaaacattccaacaataagataaacccctccctgactggagggatgtcagccccaagatagcctctcctccaaccacagacattcccaccctgcaataaacttctccccgccacagaaatattccaagcccgtgataagttctctcaccctgaacccttaaatactattagtctgtaagagagagcactcttgacaaaaattggccagaagcccctgtcaggtttattctccaaaataaacctgtctttgacctttcagctgcttttcatgtttctttcctttctttacctcttacaaaacctctgttcaaatgtcccttcttcagaaaggcctttcccaatcagtcactctgaagccatgccctcattatatcccatctatgaagcctgcttgattttattttattttattttattttattttattttattttattttattttttgagacagagtctcactctattgcccaggctggagtgcagtggcgcaatcttggctcactgcaacctccacctcccaggctcaaatgattctcctgcctcagcctctcaaataggtgggattacaggtgtccaccaccatgcccagttaattttgttgttgttgttgttttttagtagagatggggttttgccatgttggccagtctggtctggaactgctgacctcaggtgatcctcccacctcgcccttccaaaatcctgcttaatttttaaataacataaatcattacttggaattacattacatttttttattatctaccttccatattaaaatataaataccataaaggcagggaccttgtcttttttttttctcaaacttgctccatccacaatacctacaatgttgcctattaaatagtatgaactctataagtagtcttgaatcaatgaataataaatgatgaacctatgtcacactgtgaaaaacaagtggcaccaagaaatagttgtcttattaaaataaaaacgaagatataaacatttctctaattacatcaatactcatgtttaacgtggaaaaccactgcaaaccaaggtactgcttggtagttattacacgagctaagttaataaagttgactgtggccagtgagaaattctccatgatctattctttccacatctctgctatctttctttctcaggcactattccatggtacctatgttcagtgcacttggaactgatgtggtcagggaaccatacagactgtgtctatagccctttagtttgttcattttaatcataaagctagaaaaagatatctgagatattcagggttactggcctaccaactatttcttttggccacaaattacagctggaacagccacttgtttatgaaatatgaaactgagaaattcctaagaactcagtaggccaaagtggatttcttcctgctgaagtcaaaattcattcatttctctatccttccatcttctgcttcttggcttcacgtactctcatgggttgaactaggtcccctaaaaagatacgttgaagttctagctgctgatacctgtgaatgtgactttatttggaaataggttttttagattttattgagatgtaagttaaggtggatcatactggagtaaggtacaccctcaatccaatataactggggtccttatgagaagagaaaaagagacacaggaagacatgcacggaggaaagatgacaggaagagacacagagaagaatgccatgtgaagacagacacagagagaaaacagagacaaagatgagagctgtgcggctgcaaaccaaggaagaccagggattgctggcaatgacagaagctaggaatgcaagcagggccctgccgacacctggatttcagacgtctaggctccagaaatgtgaaagaataccccgaataccccaccccgccttttttttttttttttttttttttgagatggagtcttgctctgtcacccaggctggagtgcaatggtgtgatctcagctcactgcaacctccgcttccccagttcaagcgattctcctgcctcagcctctcgagtagctgggactacaggtgcctgccaccatgcccggctaatttttgtatttttagtagagatggggtttcactatattggccaggctggtctcaaactcctgaccttgtgatccacatgtctctacctcccaaagtgctgggattacatgcatgagccaccgcgcccagcccctttctcttgtgttaagccctctcgtttatggcagctcctgggaaaccagtaaaagcactctctggattacttatcaccattaacaggagctgtttggagacatgaaatttccaggagttgcaaaagtgtatttatgaggtttttaactgatgggaaaaggaagacaagttttaagtgttttatttatttatttatttatttatttatttattttttgaatttcttttctttatttgacttaaaaatgggatgcttgaagatagaaatttttgttcaacactgccatgtgaaataatgattacattaattctctaaaatattaaaagatgcttcatttgaaaaggaaaagtaatcaggaaggaaatgaagatatatttagagtatcaggaagcgatgaaacgcagcatttcatgggaagtctatttggatgcacacatcagcacgcctgctgtgcagtgtgctgcacagctcaccttgtttggtcactctacaaatgacggaaagattgtaattggcattttcttgcaaaggtgtacttggcccaaaacttttagtcccaaggctttctttctttaaaagtaaattcaaaatcaattccctagtaaaatttgaaaatgctggaattaggcccaggattcgattcccagttagaatttctccccacaatatgctaggggaaaacactggtgggatttagatataaatggcttcacttccttcaatcacctaagaatgataaccaaacaaataattgagttactgactcagctggggtgccatctggcataatgaacagtgtatgaccaacgcctcactttgaagcttttcctaaaatgaagtaaaatatgcataggctctttatagagtctctgttgtgtcacaaaagttaggttagtctagcaattttggtaaaggccgagcttagtcgccaccctccagtctccagcatggaccttgtcttaatccacctgggtagcttataaacaagagaaatttatttcccacagttctggaggctggaaagtccaagatcaaggcactggcagttttggtgtctggtgagggcttctggggtcatagatacctgccttctggctatgtcttcacatggtagaaggaaggagtgaatgagctctctggggcctctttcataagaacactaattccattcataagagctccaccctcatgaaataatcacctcccaaggcgccacctccaaataccatcacaatggggatgaggtttcaacatatgaattgtggggggacataaacattcaatcctgaataaagttgtggatccatgtctgtcaaatctatgcttattgtgaaggaagaagtcttttctctaaacggaaaaaaaaagtctgttattttctcggtaaagagtaaaaatcttcagaataaacagcagcatctctgccctggaaggtcggttgagagtggcacctggttccacgatgggaaaagcaatctggggaggctggaaatgtcagagcccatgctgtccttatgggagaagtggctttttgatcttggagcttccttttattctatgtgtgattcctggccatggctgtccccttgtgccccataatccctaaataaatgatagctcctgagaaatcctcagtggaattgcttcttttgcaaggaaatgtgccagtcttaattctactggcttcttactttgacctttggtggataaaggcaggagcgaatccaaaataggaagcgttggtagtttggggccttataatgtaaaattgtgcctgaacttgaaacaggatccaaggatacttttaccgttctgttacctccagctcagccaccatcacccatatttgcatttcccccatctgtccctttcaaccgtttacacatcacacaattttacatcttctctgatgatctattgtttttcatttattttaactctaaaaacctttaagagcatctaatttcagagatgtatacccttctactagctttgttgattatttttcttctgaagattaaatgtgtttcagaatatcacctacactagcagttaactttcatttgagtattttggcttcacccaacacaaggtaataaatcctgggttgttttaaaaaaataacactcagtgaaattaatttggaataaatgtgatggtgcatatacttattttaaagtggcaaatatttatctacagggacacagcctgaccaaaccaaatgcattacctttgtatgcaaaaatgatgccatgatgactccagagaagggcagatttcatggcttctattttgcagtaagcagtacagattgtggttggttgatccattctacagaaaccagtcctcatgagctggagctcacacctacaaaaggtttgctagtatggagatgtttcaatttttgtgagcagttaatgctattattatttttattgaaaactaattggcccttgtggagagagtgattagactactgcttattgaatacttcttatgttcaatcactgataggacctgtgttcaatcactgataggagctgcatctcctgtaaagtccttcatctcctttgaagtccaacgacttcactgaggtagattctcttatgcccattataatggtgagaggttcagccaagttaagaagtttatgtggggatggaagagctttctgattccagagcctgtagtcttttcactcggatcattagcagagagcttaatcatcgtacatgattcactggcttaaatgtagacagattaaaaaagctctcagaatttaaggagagaaaaaaaactcaaaactcaagaagaaattctcctaaactcacagtttacatctttttaaatgaccatggtaaccatccataagtgaggacacactggggaaataaagagagggcaagaccaggtagattccagggtggtgggtggtctaacatcctcatgcttcttattcttcttttttatttgggttgggggaacatggtctcactctgtcacccaggctggagtacagtggtgtgatcacggttcactgcagcctggacttcccgggctcaagcgatcctcccacctcagcctcccaaatagttgggactacaggcatgtgcaccatacccagctaatttttgtatttttttgtagagaagaggttttgccacattccccaggctggtctcaaactcctggcctcaaggaatttgcctaccttggtctctctaagtgctgggattacaggcatgggcactgcgccggccgacatccttatgcttctaacagttatcccttaaagagcagtcaccttggaggagctggtcctcagggcttcctgtcaggacagtgctcccttgatgcatgggggtcagttcacacacccctgataagtgccacttgagtttacatcatacttttatattttgtacatttaaattttatagttgttaactcacaaaccatccaaatcatctttgtcattcttcactactaatagtgctgagctctcaaaggggatgtcatattagattctatttcctcttgttgaaaatctgaaggtttctcaagaaatgaaagtaacttggggaacattaacataaatagaaagaaaaatggcatctttgttttctgttgagcctttgtgacctttctagaggctactgtggatgaacttaaggtcccatctttttttttttttccatgtcctgaaggaagctaagtgtatgtacacgatgacatttttcattttgatatagttggtctgttttccagactatagaaaactgggaaatgaattttctttcaaataaaagttgaaaccctttgggaaagtaaaagaattcaagaaatatagagaaatggctgtttccaagccaacaggaagaagggagagtctttttggttttcaaattagttgttagggaaaacgtttttcttcccatcaaactttcactttttcttctttaaaatagattaatcatagctgtgtaggtttagttttctgcctgcttgttaaaatgtggaaaatatgaacagtggcttcaaacttttatgagtaaattgtcattttgtgccttttattggcccgtatttcaaaccccacattgcaggaactcactgcttacttctgcgctattcactggcaagagtatgctaatgggttatgcagaccatgtctttatgaattgacaataaattccaaaggacaaaacagcttccaaccataattcagtagtataaaactgttctgtcaacaaatctgatggtttttttggtgttcacacattttaggaccccatcatgcacagacacctgctcatttttcctgcttaaaaaagaccaaatttgttctgtcttttttactcttaaaaatcaaaatagcaccatggtgaaattatactacctgctttagtcttcaaaattattctttagagcacaaaaggcagacatactgggcagaccagagagtgaacactggctgtgtcactctggacaagtcattattttttctgaatctcagttttattatatttagtatgggggaatgataaggggtaactgtaaagccatgtgtgatcttaagactagcaccaccagcattgactgggaacttgttagaaatgcaaattgtggccgggagctgtggctcacacctgtaacctcaacactttgggaggccgaggagggcagatcacaaggtcaggagatcaagactatcctggctaacatggtgaaaccctgtctctactaaaaatacaaaaaattagctggatgtggtggcacgtgcctgtagtcccaactactcaggaggctgaggcaggagaatcacttgaacccgggaggcaagggttgcagtgagccaagatcacgccattgcactacagcctgggtaacagagagaaactctgtctcaaaaaacaaacaaacaaacaaacaaaaaaaaaagtgcaaattgtaaggccctacccagatccagtgaaccagaaactctgggttaaggcccagcaatgtatgttgtaacaagccttccaggtaattctgatacacactcaagcttcagaatcatttctgtaaagatttaccacaatatacacaaagggcttgtttgccacattgcagaagcacaagaaatagcagctattctccttttgttattatcatcattgtacagaagaaactgaagcacagaaccaggtgcttcagcaacagcagtgggccttgtcactcagccgagtggtggggacagcctgctcctccactctgcactctctctttatggatgatagtagacagtgatataaatcctgattctaagtgtaaaaggtgtcccacatagcatgttgcctagttctggcatggatgatgcattcaggctttaatgtggagactatagctcttttgacatgatagattttttttaaattatattttaagttctagggtacatgtgcacaatgtgcaggtttgttacacatgtatacatgtgccatgttggtgtgctgcacctgttaactcgtcctttacattaggtatatctcctaatgctatccctccccactcccccctccccacgacaggccctggtgtgtgatgttctccatcctgtgtccaagtgttctcattgttcaattcccacctatgagtgagaacatgcagtgtttggttttctgtccttgcaatagtttgctcaaaatattggtttccagcttcatccatgtccctacaaaggacatgaactcatccttgtttatggctgcatagtattccatggtgtatatgtgccacattttcttaatccagtctatcattgatggacatctgggttggttccaagtctttgctattgtgaatagtgtcgcaataaacatacgtgtgcatgtgtctttatagcagcatgatttataatcctttgggtatatacccagtaatgggatggctgggtcaaatgatatttctagttctagatccctgaggaatcgccacactgacttccacaatggttgaactagcttacagtcccaccaacaatgtaaaagtgttcctatttctccacatcctctccagcacctgttgcttcctgacttgttaatgatcgccattctaactggtgtgagatggtatctcattgtggttttgatttgcatttctctgatggccaatgatgatgagcattttttcatgtgtctgttggctgcataaatgtcttcttttgagaagtgtctgttcatatccttcactcactttttgatggggttgattttttcttgtaaagttgtttaagttctttgtagattctggattagccctttgtcagatgggtagattacaaaaattttctcccattctgtaggttgcctgttcactctgatggtagtttcttttgctgtgccgaagctctttagtttaattagatcccatttgtcaattttggcttttgctgctattgcttttggtgttttagtcatgaagtccttgcccatgcctatgtcctgcatggtattgcctaagttttcttctagggtttttatggttttaggtctaacatttcagtctttaatccaccttgaattaatttttgtataaggtgtaaggaagggatccagtttcagctttctacatatggctagccagttttcccagcaccatttattaaatcgggaatcctttccccatttcttgtttttgtcaggtttgaaatgatagattaatattaacccatctttctcttttgaggacagtactggtgactacattctgtcaataaacatttatggacttcaaaccatgttcaaggcttgatgctgggccaggcaatgagtaagaaatgatctttctcctaaatttctgacatcacaaattttgacattactaatgatctgtttagattcatatgtttttagaagtggaagtcgttttcttaagacaatccatttcaactttcaaattctgcctttcagagagctaaggcagtgggtctctttcctgcatgctggttacaatcccctgggcgggggggggggcttttaagcaatactaatagggatatccatccaagaaattctgatttaatcggtctagaatttagtcggcaataggtctgtgggtaggaagcttttaatataagtaatatacttaacgataaatacaataagtattacatatataaatataatatatacatagttgggatatacttaaactaaaagctattccttgtttatctgatattatagtttaaccaggcagcctatatttttatttgttaaatctggcaacaccgtggaaagattctaaagtctatcctaggctgagaaatcatcttgtagggtttccactgaaataccacaggtaatgagggcgggataagagagcagggtgccatctgggcccattacacacaaagttttatctgttttacttatttggtctctggtctctgtaacatttcacttgaaaaaaatggcttgaaaaagtttgcaaacatctaatctaatcatatcaaaacttaaaacccagagaagatgtctcttagccaggttctcatagctaattaattgcaaaaccaaataccaggtctctttctctttctattacatcagatactgctgctgctgctgctgctgctgctatgtcccttttcctcttgttaagtgatagttcaggaataggaggtgctatgatcctatatctaaaagtgtttggcaaacatttggcaaacccattaagatatgccagacacatataaagagatgctaggtgctgaacatggggattaagatgaggttttagttctcaaggagctgatacaggaaaagaaacacaaatagtgtttctgttcctacaaaaaaataccacttatgtctatgacttgttccctccacaatgtgattattcaaagcacctttctttggtcctcaatttaaaaatggtgaggtgagaggacagcactgggttcccagaggcaaccggatggaacctggaatctaacctagattttcattatgaaagttataggaatgaagaatccataatgacaaaagacacaaggatgactgtactttgggctgtgggatgactcacaatggctatatctgtcaggctttttggcaaatggtctcacatggtctccaattaagtgaaccacatagaatttaaaagttgcagggagtaaaagaacgtgtccttccatttttggggaatacatttactcccatccagattaaaatgggtaagcactaatggtgcttctgtgctatagggaaaaatgaaacataaataggcaatgcatggggtggaggtaagacattctccactgagctcccgtccactgtcactttggaaaggtttgtgatgagcaacatcagaggatggctgctccctggcaccactcttggatgccaatgacccagaaatttaaggggactccagcctcttctcgctcctcagggaccagggaagatattttaggtgatcagttggcttagggaaagaggaagaggaagcaagattaacaagccataaacagatcaacttaaaggggcaagagagctccagagatacagttgtctctggacttggagactggagttcccaacattgagggacttattgtatgtttaattatttctaaactccagtttggacttagaatccaaacagcccccaaggctcacacaatgtggagaaaatggcagtttattcacaccattcacagaataattactcatttctaggtcttggtactttctgtttttcttcatcatttcttcttttctaccaccatcatcactcccaatcaaactatctcctccatgccctgaagtttcatgacttcaggttactgtttggctgtgatttccaaacctcccatcactttctcccaggaacctcggggtaggaatctctgacttgcagagtgatttttaggatttataatctgagtctgttatcatttgaggattaaaaagtatttattggctgggcacagtgactcacacctataataccagcactttggtaggctgatgcagaaggatctcttgagggtagaatttggagaccagcctgggcaatatagtgagaccctgtccctacaaaaaaattttaaaaattagccaggtgtaagggtatgtgcctgcagtcctagctacttgggagactcaggtgggaggatcgcttgagcccaggaatttgagattacagtgagctatgatcatactagtacactctagcctagatgacagagtgagaccctgtctctaaaagattaaaaaatttaaaaagtatttaattattactagatgtccaacaaagttgtgaaaaatttaaaaataaatgacatgctcaaatacatatatatccaaacaaacgctcttcttttcaatattgtcatgttgggacatgtaaaagtattctgacaattcatcttggaaattcttttttggaaattattttcagaatcagttcatgagctttattacttcatgttagattttaattttgactgaaagttgtattattgcctggatttactagatttgcttttgaatgacaccggctgattccaaaagccaaattcatccccagtggatgaagatttgctccctttaagggaacatgaatatcataataaacaatgagtcagattttcctctatggtccattgcgatggctgacgttgaagacttggagttgctgttgttattggtgggagtgcacagaggagagcattgagatggcatgaccaacggactgaattactgactgggtcattcattcattcattcattcaacaaacatttataatgcacttattttgtataagtattgtgataggttgtagagattaccaagataaataaaatgtggaaataagctagatgattaagatcctttctagttattttatttatacatatttcataatgtttgaatccctaatagtattctgggcaaatccagcactgctgacatacatggataaccccctggcccttatttgtacatctaagttctgatgtgccagttaaaaaatgtactgagtttaactgaagtcaccccttagtcacatctgaatgacccctgttgaagccatctcttacccttctcctgcccctgaaacccttcccagtgctcttgaaactcaaggccaattagcagaaaagctacctatatcttcaacctcttttctgaaggtgtctttcaccttgtagttctaactgaaatttgatttcccttggggaagtggctttctttggaaccctttcaagtggtggcttttttcttttctatactttttgtatcactgagcccagaggtgaagtaggtatccgtctttcctacttcctgctccaggaatgaatttcatgtcatctgactgccagactgccacctgcctcccctccttgttataaacatcgattgaactcctggtcattcttcctagctctttgacattttagcttgccacatactatcagactctccaatacaactctagccacaaatcttgatgatttcaatgccaacacaggtgaacacctgagctgtgatctctcttctgcacatctcctctgtgcattcccaccaataacaacagcaactccaagtcctcaacttcagacttctcactctccaaagagcacctcctggtttatctgcttattctctctaatacttaaactcaacagtcctttggaatctaccatccattgagtctaccaatgttttatggttcctcatacctttcgtgtccacatttccattcctactcagtttagtctccatggttcattgtaatcatttccctttaaacacccttaactccactgcccctctctctgtgtaccactaacaaaacctaactgtgtgaagtctaacactctacctgctttacattcatgctattgaacatggatgtagataaatacacaactatgctcactggtctcatttaactcacaattactaacttcaagttgataagatcctgataagtttctctagtccattccctctcctcctttcccagactatttcacactttctcttgcttcttgaaaactgcaatgccttctaacttatacttaactctcagttgacaatcttgctttctgtatctctcaggatagaagaaatcagaagagaattctgacaaggttccatccatgtctaacagcatctgcccataagttgtcctcccctctgctcactctggatagacatcatgtttctatgtaagggaagcccttccactgtttctcatctcttacatcatcagtttttctctctctctctgctggattacttccatcagcatacaatgtgtggtaatttctctcatccttaaaaaaaaccctctccagtgaccccatttatctatacccttttatagcaaaaatctttgaaagatttatatatacttaccatctccaattcctctctttttaccctcccttgatccctctccaatcagactacccctatcattctactaataagtctcctgtcaagatctccaatgactccatattacacgaaaggttaattctcagttcttatgtgacttgacctatcagtgtcatttgatatatttgatctcttctttccccttgaaaactctttcataatcataatctacgtttaaaagtctagtcaggtttaaaatgtaagttgctttgcaaagccccagtggtatcaaattctgaatcatgatgtgttcacctccatgtgggaaatattgggagaaaatgaaaaaaaaataatgaaaaacaaaaaaaggacccaagagcatgcctttaaaatacttgatgcccacattttaacttagggattgtgacagctagaaagaaccttagaattcatctagtccaatactcccattttacaacctaaggacgtcaaggcccagagaagattagtgatttctctatgtttttacagaatggcagaattgggattagaatctaggccttttttccagaggatttcattctaatgtccagtttatactgcttttcctctcatatatgtgtatgtctatatgtatgtgtgtattaataaataataagcatatacatggagacatatatatttgcatatgtacacaatatataaatacaacatacatatatatacacatatacaaatatagttatatacattacacacacacacatacacacatacacacatttttttaaaataatttttttcctgaatgaaataagtgttgggatgagctcatgcactccctctctgtcctttcctctgatagagtcaggtatccctattcggttcccctgggatcaagcccatcttccactaagatggatgatactgaagcaaaaggactaagaaagcccttgacttagcagatcactggctgaataaaaaactcactgctctgggccaccatctcagttctgctgatggaaggaggctggatctgggaaaagagagatttaggtttagtactggctaaatcactgggtgaccttgggtgttctcatctgaacaatgagaggctgtattgtataaagtcttaattcttcccttctaaccttctgccttgagctcaggttatttgggctgatcccatgctgtttatgtcatcttcttctatattagcttctcctccatgtcctatcaccatccagtcactgaacttcttgcctagctaggtgtgtgctatctgcttgtctgttttggccctcttagctgacctccctagatgggatatctggactatgtgatctgtgttttttgccaggctcctttctatgtaattatacttttggtcctggctgttagacagctgcttcccagggtctgatatgacatgaaagaatgaataagtaatgtggaaagcaggtctcacaaatgaggagagggagcttgcacaaaaatgtaaacaaaatactggggaagaaggaaaaacaaaaggaatgaaaaaaagaatggcatattatggcgcttaagcataatactctctgagagtgactccggcctaaaaagaacataagaagctggagatgaagcaagatggatgaatagatgcctccacccattgtcctccccgcaggaacaccgaattgaacaataatccacacaaaaagacatctttgtaagaactaaaaatcaggtgagcaatcacagtccctggtttcaacttcatgtaactgaaagaggcactgaagagggtggaaagacagtcttgaatcaccaacaccactcctccccatcccctggcaggtgcgttgtgtggagaatccacactcttgggagggggaaagtgcagtgactgtgggactcttcactggaactcagtgctgcactgtcacagcggaaagtaacacgaggcagaactcagctggtgcccacagagggagcatttagaccggccttagccagagggaaatcacccatcccagtggtcagaatctgagttcctgcaagccttgtgggctaatgtggtctggggttctatataaacttgaaaggcagtctgggcctcaaggactgcaactcttgggcaagtcctgggactgtgctaggcttggagccagtcgactgtaggggcatgtgagctactgagacaccagctggggtggccaatggagtgcgtacatcaccctcccccaaccccaggaccaatgcctttcactcattcaacaaatgtttgttaggtatctcctgtgtgccaggcactgttctaggcactggtgatgtaagcgtgagcaaaaccaaacaccctgtcttcatgttgtttaaatgtccagaaacgtggcagtgttctacaatagtgaacatgagggtgagcccagaagatcctagaatatggatctctcatagctttgcgagggactgtgtttcttccacttgaggagaggagagggaagagtaaagaagactttgtcttgcaacttagatacctgctcagccacagtaggaacaggcagcaggcagagtcctaaggcccccttgctaggccctagctcccagaaaacatttcaagatatacccgggatgatactgaagggaaccccctgtcttaaaggggctaggaacccagtcctggccagattaatcaccttctgactgaagagcctctgggacctgaaaatgcagcagcagtacccaggcagtacttgccataggccttaggtgagactcaaggatgtactagcttcaggtgtgacccagcacattcccagctgtggtggccatggggagggacatctgcttgagaaaaggagacggaagagtaaaggggactttgtcttgcagcctaagtaacaggttggccacagtggggtagagcaccaaatgggcttttagggtcattgattccaggccttgggtctaaaatgccatttctggacctgccctgggccagaggggagccaactgcgctcgagtcctagccctggcagcattcaccacaagctgactaaagagccagtgggccctgagtgaacacctgtggtagccaggcagtacttgtcatgggcctagggcagtggtggtcatgggaagagactccttggtttgtggaaaggggaggtaagagtgggaaggactctgtctagtagcttgggtgccagctcagccacagtagaagagagcaccaggcagattcctaaggcttctgactccaggccctggctcctggatggcatctctggacctgactgaggatgggggaaactcaccatcctgagggaaaggacacaagcccggctggcttcgccacctgctgaccgtagagcgcttcatgtgtttattaccgatatttgttttctattctttagaatgccttcttacgtctttcccctttttctattatattgttgtcttcgtattagtccatagaagattattatatatacatggtgctaatatttgttggctgtatgtaataccaatgtctttttttgggttgtattttggcttttaattttctctagggtgtccattgatgaatagaagctcctaattttcaaggaatgttaatgctttttgcatctgatttaaggatcctttctcttctcttccctcaggtcaagaaggactttttaaaaagtttattattactgttatataaaaatgcaattaacattattatattgatcttatatccagtcaccttgtaaaactttcctattatttctagtaactgtctacacattcttttgggttttctatgaacatatcataatatctacacccccccaccaaaccaaaagcaagtgaatttaaaaaaaagtttttaaacccaacacaaaaattcttgagccccaaaaataaataaaaaagacagaagatagaaaaacagaaacatcaaaaatgaacaagcttagtgtctttctgaaaagtttaaaagaagaataagataacataagttgaaagaagaggatgataaaaataacaaaagttaataaaatggggtggtggtagaggggcacgatacaataggttcagccaagttaaaagttggtttctggaaaagacaaaattggcaaaccactaggaagtcttaaaaaaagagaaatgataaataatattattaataaaaaggacaaataactacagatacaatagagactaaaacgataagcaaacccaatcaggtggtttatgtcaataaacatgaaaacttagacaaaagggatatattcccatataatttataaaatttatcagaattgatagtgcaataaagcctgagagtattataactagtaatgaaataaactagtaataaactattaataaaagtcactaaccatctgcctacaaacaaaacatcaaaccctgatatattaacaaattttctcacaaattcaagggctaaatcattctaacttatacaacttataaagaactgaaaaatagggaatatttcccattcattttatgagatcagtattattttgacatcaaagtacacgacaaagtacaagaaaataatgtcgctgacacatttcaactcatttattaaaatggttaataaaaaataaaatttgttaataaatcaatatagatacagaaatcttaaatatgacattagctgactaaacggatcattatttacaaaaaatatcatagctatatagggtttatctcaaggatgtaagactggtttaatttttaaaatatataagtatctttcatttaaggcattaaaggcaaaaaccatatgatcatcccaaaagatgcatatgtaacttctgataaaattcaacatgactacgtgattctaaaaaaacccttcttagttaaggaggcttaaagacaacttccacaacctgattaagttaatctaccccaaaacaaaactaaaaacaaaacagttacaacaaacgtcatcatcctgaatggagaaacactggaagtattccctttaaatatcaacaacaatcaagaatgtctatcaccaccaatttaactcaacattgattatagattcttttagaagcacatatccctttcatagaatctcacatacaaaccttcctcttaaaggcaactcttaaaacagatgttcttaaacctaaggcactgtgttctgaaaaggtagaacactcttcccaccccaaagccattatccagtttcttttaaaaaatactgctcagaagcatagcacatttgagcagtcaatttaaagaagcgggggaaaaagggaaagtataatttgacatagttagttgtaaatccaggagtattatccaggctaaatatcatctcaccctgggaccaaggaattaagctcattttgctctttcatcttcaacaaatgcagaacttaaagagctgttttagcccataatttcattcatcttatgatccaactggtattatactgaataacatttgtaatttgactgtattatgtgagtgaactttgcactcccaggagaaccaaagagatattttatggcactgaagtgacaatttttttaaaaaaaagatccgtctttttaacatttgagaaaggtactagaaatattgtttcgcttatgctttgttctgaaaatccagctaagtttcgaatgaagagaatgatttatttcaggaccaatgtctttcactcattcgataaatgtttgttaggtacctcctgcgtgccgggcactgttctaggcactagtgacataagcatgagcaaaaacactctgtcctcatgttgtttaaatgtccagaaatatggtagtgttctacaatagtaaatatgagggtgaacccaggaaatcctagaatatggatcccctatccatcccatgtgctttccctttctctccaaaagctttccattactgtcttgaaggtaaaagaaaaatgtctgggttgattgccttccaggctttggtcactgcatcacaccagagctacacctcactgagcctttcttgggaaatttatttataataataacatagccagcatcaaaagggcacctttcaaaaaggcatgtggcatatgctgtctgattaaaatcctgcaattaggtattatcgtcatttggtgggtgagaatccgaggcacagaaaggctcagtgatccaacattatagaaattaattcaagtttctttgactccaaaacctttttgaacattttctagtatatctggttgcctcattcattcattcaccttctcatcaaatactgagttacgtatcaaaggaattctgaatttcatgttattcttctgagtatgagtatagtctttatccataatccataaatatcctattttccccagctgtgtaatactgtgcaacccagacagaccctccttttccctccctcaccacagagaatggtatagaaaaactcaattaggccaaataaggataggataaggggcactcctccttcccttcctccctccctgcctcccttccttccttctccattgagcttacattccactagggggatggtagacaggataaattctaagctcttttccaacataaaggctctagcttattagaaatggggagaataagcagaaataaagaggcaagtattttggtgttgtggttgtatagcgaaggctgcaggacagactcaggtttacaaatctaggcttgttcatcacctgtgctctgggctgctcctctactcacctctcaaattcactggcacacacagatcacacccactgccagttggtaccacatttgtattatcaattaccctcacagaactgtatgacctctgttctgctaaccagctgtagggaaacactggcagtcagaggatgtcaccactctcttctcaccctctcttcattccctgatttgctcacttgcccctcagagaaatcctcttcccctttatgcccacccaaacctgattcttcaagactcacctcaagcccccttcaggaagatactttggctacctcataccttttgcttagaactatgttgggattcaggcctggcggggtggctcactcctgtaatcccagcactttgggaggccaaggggggcggatcatgaggtcaggagattgggaccatcctggctaacacagtgaaaccccgtctttactaaaaatacaaaaaaattagccgggtgtagaggcgggcacctgtagtcccagctactcaggaggctgaggcaggagaatggcgtgaacccggaaggcggagcttgcagtgagcagagattgtgccactgcactccagcctgggcaacagagtgagattctgtctcaaaaaaagaaaggaaaaaaaaagaactatgttgggattcaatctcagcagtcacagtccattcattcacccagcatttcagtagggattcagtaagcacttaccatgtgccaaggattcagtatgaaacaccatgatctctggtgttaagggataagcagcagagaacaagagcaatttgatggtcagggtgaaaccaaggtgttatgggatcacagaggaggggcacacacccagatccagatcaacagtacaactgctgggaattgattccatagatatccacagaagacaagttaagtgaatgatggtacagccacacaatgtagctggaacaaagaacaagggagacagtgcactgacatggaatgatctccaggatatattaagtgggagaaagcaaaacaaaacaagatgcaggatagtgtacacagtgtgctcccttttgcgtaagaaatgtgcattttttgctttgttcaatgaaagactggaaagatgaacaaaaaaaaaaatcaataaaaatggttacctatatggggctagggacacagagatggaggagagaattctatgttcaaaacgacaaagtcaaattttgaaaatgatatctgagaaaaactttgagaagctctccacgtagcagagactgctgaatactgaagcatgaagactcacttcctagtcactacagcatttgttcacagagtgacaaaacatcaagcctggcagtatctggaggaagatatctcttcccaaagaagggagggaagacatgtgctgaagatcaccaagtaagttatggtccaagaagacacatgccttctccaagatgggtatttaggtccttccacacatctcaaagatttcatgggacactgtggtgcaatgaatgctgttggcatagcttccaggttttgcctaaaatatattgatcctgtggccttgccttctgaataatcctaataaaactcaggaagacaccaggagatatccgggaaagaaacattacagaataaaaagggacaaagtgacatattacatcataagacagaaagggccaaacaaaaaaaaaaagagctcttattttaaggtgaaaaagttgagagtagaagaagaaacattctgtatgatgcttgtggggggttcataaatagagaagcaagctgactggggaaagctggaaaccaaccactaacctctctgcctgcacaagatccagagccagcttggccaatggaagggatgctatctccttttctaattaaattccttaaagagtgtgttgatttattcatttataataaaatcctgttctaattaaaattgaaacttctccccacctgatccagcctcaccatatttctggtttccatgtaattgaatttgaaaacaatgatgctgagtgatagcttgggatattgctgcttattgtgaaagtaaataataaaaaaggagaatgctgctaggcttgttttgggaaggcttaatcagtcctttctcccttagactgaattttaaccacagttgaagataatatgatatttcccttaatgaaattgtatatccgtggctaatttatgagggaagtttacctttctggggctttagcttcacattattttagtcaatagtttttaaggtccctgggttcccctctctccctctgacatcctcaaccttcaattccagaaattgttctgcgtatcagtccatttaatacataatactcagatttattagaattcttcagattggaagctttgccacatctaatgtcatatctgaaacacccatgagaaagaggcaaggtgggcattatgtggttgatgcgactaatgctcagaaaggctgacatgatttatctaggatcaaaaagtcacttaatggccaggcacagtggctcatgcctgtaatcccagcactttgggaagccgaggctggcggatcacctgaggttgggagtttgagaccagcctgaccaacatggagaaaccccatctctactaaaaatacaaaattagccgggcatggtggcgcatgcctctaatcccagctgggaggctgaggcaggagaatcgcttgaacccgggaggcagaggttgcagtgagccgagatcatgccactgcactccagtctgggtgacagagtgagaatccatctcaaaaaaaaaaaaaaaaaatcagttaatgacacagccagcgctgaaacccaggtatgtaagctcccagttatgggcatttctaacatacccagccaaagggctcatggctttgggtttctaggttcttggaggttcacagaggagcccactgtgtaattcgctgagtaatacttgacatttgtcctggtttttcccaagctcatctccttggttgtatagtaagtgtatatctctaggtttctgattagttaaggaggagcagttgggatgcaagaaggtttgaaatggtctctctcttgatccttaaaagtcagagaaaaagcaattagaatatatctgttcttcttcccccgatacctgaaaagactgcaccttgctttttcctcttgcacatgataatagttacttctacaaagattcttcctgaataccgagccctttcttttccccacctaccccacttcttcaagaaagttccttctactgaccccagtattttcattctgcagatgattgttaatcttccgtgtctggtgtaaccattcagttggaagagttctggcaaggggctctttctaaatgtctctatgtgctttcgagccaaatataaaactctaaggtctccaaggaaacccaaacacctgttgactacattttttttctccatttttttcatctaattgcaatttacctacttcactagagcaacgtgaggattaactgtccttgggtaactttcaagtctgtaaaggatttctgcctcctcagggcacatgttctctaagagagacagagccgaaatactaataagagacttaatgtgtagcagcctcgaataatctgtgctctgtgttaccacttcagacagtcagtgtctccctaacacagtctgacaaagacaccgtggagggatcaacagccaagtctgaaagtcccagacaggagcatggacttccctttcaaagcccttgggaggaagtgatattaaccaccaaattaggtagctggaccagggcctggtgcacctgctgggcaggcgggggtgtctgcctgctgtcatattttggcacaaacatttgacagcttctccctcccaatgaacatttctaatacccaaaggttaatcttttcttggcttcttcttgtcactactgacattttgtacccattatctccctgtggttgggggctgtcctgtgcattgtaaggtgtttagcctcatcccttgactctgcacagcagattagtatccccttccctctctgagctgtgacaattcaaaatgtctccagacatttgctgaatgtcacctgggggatggagaggcacaattgcactggtgagacgatccattttaaatgcctgatgtattactcagattatgagtaaacctctacaaaaaagccatcctcaaacatgctcatggggctgcagaaatgtcagttgtcttggaaaccactcttctcccatcccctagcaagttagatttaattctgctcccccaacatgaagtggaggagacacacaaattttcacaagtgaagcagcatctgatttggtgtttatttatttagcaccattgcctagttccgttgcctagttttctttcagccctggcggccaaagcctgctaatttgcacagcattaagtatcctttgctcccctcacctattccacttcaaccaaggatttgtcttttgctttgaaattccactgtgcaagctcctttttaaaagtgttgggctgcaacacatttgaacttgaggggggtaacactgggggttcggtggtaatgggagggaatgtccatcaaagggtgacaaactctggggggcatctcttccctcaaaatgtctcattagggtccccaggcttggtctccatctctgctgtagcctgcagtccaatttaattgagcaacggccttgctacggcacactgctctttcgacaggagggtaaactcattctgtccatcatgacatttgctttcttaagggcctcccaatatgcaacttaaataattaaatgcaagtcacatcacagcctcccttttcaagcctgtctgagggcacagtgggttctttctgatagttagcttttgaccatgtgatttttagaagctggctgggttttttgtttgttttgttattgtttatgacacttctcctcactaaaacccccaaaactcagcatagtgcacacccaatgtgcatagctaaaagggctgtggattttctgatgttggatgaatagtgactaagagaaatttgagacccctggttctggcaagggtctcagagcagcctgcttgtcatggtcagtacttttcatttgtcatccaggaaagtgtaatgctgggagacaaatcccttgtgtcccactgcgcatgtccatccacttcgagctgggatgggcctgttaaaaataaagcaaacctttaaaatgatctaaaaagagagaagttccaggaaggactaaagataactcttacctgtagtgtccactttaaacaatagatttctctggggcaacttggagtgattataacgagtttggatttcgttgaacccaatgctgattttgcatattacagagatttgtcatctttaagtaatgtgccagatgaatgctttaaaatagatgcaactttgtgtgaattttctataatatagcaagatctgattgctctattaatagccaaagtccttggccttgagaaggcaggatggcagcgtttttaaaattcatcatctctgcataattagttatgaatctctaaatatccaagctgaggaattaaccaggaactagagctgttatccctcagcgtcccttttaatattgttccatagtcatcatttccttgtgtttttctaattactgcaaaaccaattgtttttaactcaacttccctggctctttgtaatttgttgaatgtaatcaccttcaagtgaagaaaatgcacttcttgtttgggaaattggggcttgatcagctgagtatcatcaagcggctgggggacgccagtgccaaagctttgcatattttacctgaccattgcattttgagggtatgaggctggagagggcatgctggaaactgagccctttgttgtggtgatctatagaccctactgggattttatttggagatgtacataattttataaaaaccaaaaagaactaggaattctggttccttactctgagtggccaacaatacggcactaggcactagaaaacaatggttttgggtactggattaccttctctctcagacttgtttcagtctgtatgtctgattataagcacctagggcagggctgtgccattgaaccttccctactccttagtgtctagcagtgacctggacacagtagaagctgaacaaaccaaataaactagtgtagaagtcaagtctctctcttgctttcactctttcccaatcttctatcctctagcactagaatgtgctacccatctactacccagttctacttgaagatcctcaaagaacagatattggaagagcgaaagttttcaacctttacttctctctttcataacgggtgtgatgcacactcatcagttaagagtggttctctgtgacagtaattcccaatttgggacagagactatgagaatcaagccaggaggcacgggactatttagacaaagcaaaacaaaacaaaacaaaaggattctgatatgcctgcaacagcctccatgaagtttcatcattgaagagtaaactaaaagtctatatccttgagaaaaaattggacaaatggattcatcatttttctctagcagtgtcctcaaagaagaagaaaggtccttattgtatttctccctgcaggtagccatgctgggtctttctttctctggacaaggaaatgtatgcataaggggctacacaagaccatagtcaatgcagtgagatggctgcatttttatttgacacacatttattaaatacctaggatatgccatgtcccctgctaagttcagagcatgaatgaccagcaattttggcactaatgagggagttgaatgtgcaaacaaacaggtaaaatatcaagtggaaatgaaagagatacagggtcttacaggggaacagacaaggagtagtaactggactttgggcgtggctgatgaaggggcatcctgaagacttcctgctgggggtaaagtctgaactgaaccttaaagatgaagcaggggttaaatgaaaggttagagaagaagggtgttagtacaaaagccattccagggaggccagaccatataagcaaaagcatggaagcctccaacagcattgtgtgttcaggacatgcataaacaaggtataaagtacaagccaggaaatgaaaaaaagtgaagctggagaagcaagaccgaggtgggctttgtgagccttgtaagaggaggtgattggatttaaaaaaaaaattttaagtaaaacaaaatttaaaatgtgtcatttaaaatattttaaactttattttgtgcaagaaatattattttaacagcaaaaggacaactgggacctctccttgctcttgaagttgttttcaaaaccactctactgaggtataattgacagacaaaaagctgaacatatttaacgtgtaccttggtgattttggagagatacatgtacctaggagagtggactgtgtgggtgatggacaaccctcgaaaagttcccagcaaaggaacagcatgacaggctttggcatttcagggagggcacttcggtggcagtgaggatgatgcatttaaggggcacgagactggcagcaaattgacagggtctagggacaaagggaggcagcaggctgcgtgagtcagatgggggccaaggccgaggcagtgctggggtgagtgggacagaggcagacctgaaaagcctctaagaggggaggcagcatgccttgggatggccagagcatggacgatgagagcgggagagtccagggcgactccttgcttcatagtttgtactcctacaaggatggcgagacattcagtgaagacagagaacctgggaggcagagcagatttctagaggaaaaaagagaggtttccatttggatgtttcctcttggggtgtctggcagggctggtgattggtgacacacagccaggtagatgaaacagaagcttgggagagctggatttactagaattgttattttactttttaccagcaaggtccattgggtccaggtgagactcccctttctcccttcatccggagattgggaccacactaggtcttccccacttcctacaactggcttgctcgctccttcacctttacactgttgtcccccgcacatgccttctctgaggacttgcctgctggaaaagggcaggaatgtttgtcatgcccaacttggcaaattagagtgggtagctctgtgaacaaaaccacaacattacttctgtctactacttcacccactgggccacctatccagctcctaaatcctgctccccccactgactctgctaacaactagactttctaaacatttttcagagtgaagctaaagaaatcaaccttgaaagaaaagtcgtgtatttatttcagtgtgttatgaacccagaggcagggttttagaaagtagacttctttggccacattcagtgtgttgcaaacaaagcaagtgggcccccaaaaccagggaatgtggggccacagcccactctgttttgaagggtgggttccaagtcatgctgtgaccagcagggtgagcagctagggaaggagccagggccaatgggagtgggtggtgggagggcacaggagacaggcagcagcctctgtaagcttcctagaagctatggaggaccgactgccactatcaaatgtcctctcctgcctaagggaaattccagggaaccggcccggcacagtggctcaccctgtaatcccagcactttgggaggccaaggcaggaggatcacctaaggtcacgagttcgagaccagcctggccaacataatgaaactccatctctaccaaaaaaatacaaaaattagctgagtgtggtgggaggcacctgtaatctcagctactcaggaggctgaagcaggagaactgcttgaacccaggaggtggaagttgcagtgagccaagatcgtgccactgcactccatccagcctaggtacacagtgagactccatctcaaaaaaaaaaaaaatgctgtgcacagtagctcatgcctgtattcccagcactttgggaggctgaggtgggcagatcacgaggtcaggagttcaagaccagcctagccaatatggtgaaaccccgtctctactaaaaatacaaaaattagccagacgtggcggtgggtgcctgtaatcccagctactcgggaggctgaggcaggagaatcgcttcaacccaagagacggaggttgcaatgagctgagatcatgccactgcactccagcctgggtgacagaacaagactccgtcttggaaaacaaaagaaaagaaaaaaagaaatttcagggaaccaaggagaaagggtgtgtttgaaaagggcagctatcttggcaaacatccaataaggcttcacgatctattggtgaattccatcctgcaggttggggacctctattaagagccttgttatttcaaaagggactccaggggtgggacggccaatctccttttcacaggcacgtgcgacgaaagcaaggaaacactgactcacggggaataaaatctccaccagacactcaaggcacgtcctcctgttattgtctttctcctgtttctattttctttttatacaacctttgccaacatttagaaagttaatggtgctgcatccatcctttaatgccccttcctagggttattggaagccagcacacacccacagccatgccagctgtctgcatagaacattttcccttcctggcagcattgccacagctggggctgacctgtggctgtcagggtgtgcgaggacagatctctggcaacacatcctcttttaaaggcaggtcgcagacaccttggtggagggaaagactgtcttgctgtttgtgctgcttctaggacctcaccaccttctcccaagaagctaaagcaatagaataaaatagagatgttccttttcaaagaggggtttgctctggttggaggaaataggatgagcaaagtgagttgacagagaaaaatattcaggctgggactcacttcattttgcagaaggatttaaaaacaacttcaagcagtaaatttactgttcatcatgaggtcatccaaagccacaacctaatgcggattcttgattgccttgcgcaactcatgtagacaggcatatgatgctgaaacatgggccctaaggtaagtgccctcatacccaggtactctctcatgtggagtcagtgaatttgttttaaatcttgtctcctttttcaggacacttagaccatcctccccctccattcctacttctcctgtctacactggaaccccactggcagaggaaggggtaggacagaactgaagattgcttgccactttttagtaacaagcaacagacagaatcatgagtctcctccttgacataccttcctcacttggcttctaagacgccatgctccccagccctcctcttccttcacagggtcttcctcttctctgtgactgagataaggcaggaggacctagtcttctcttgggctacactccctcccttcctcatcacatttggacacacagcttcaaatgcggttgatgtgctgatgacactcaaatttacatgagccccagactctcctagcctcccacctacccaccacttccacttgcaggcttaatgggcccccaaatctagcatgtccacgcagaactcccatttcacttggcagaaggcaagggcaaatccagcctttctaagagccaaagcttggagtcatccttgaccctacgttttttccagtataccagtgaattgtattatgttttttgttgttgttgtttttgttttgagacggcgtcttgctgtgtcacccaggctgtactgcagtggtgcaaccatggctcactgtagcctcaaattccagggctcaagcaagcctcccaccttcctctcccgagtagctggaaccacaggtatgtgccaccacatccactacacctgtcttatttaaaaaaaaaatttgtaaagacaggttctcactatgttgcccatgctggtctccaactcctggcctcaagttattctcttgccttaccgtcccgaagtgctgggattacaggcatgagccaccatgcctggcctgagccaggtggtatttttttttttttttttttttttgagacagagtcttgctctgtcgtccaggctggagtgcagtggcatgatctcggctcactgcaacctccacctcccaggttcatgccattctcctgcctcagagtagctgagactacaggcctcccaagtagctgggactacaggcgcctgtcaccacgccaggctaatttttgtatttttagtagagacggggtttcaccgtgttagcctggttggtctcgaactcctgaccttgtgatctacccggctcggcctcccaaagtgctgggattacaggcgtgagccaccgcgcccggccattaggtggtatttttaattagatttggaatccgactgttctcactccctgtgttgtacgagccacatgtgactatatttacattaaaattaattaaaatttcaaataaaagagaaaagaaggaatggcccaaatgagaactcttaggaaaactggagcacaaattaaattttaaaaattcagtctcttacttgcactggctgcgtttcaggtgcttaacagccatgtgtacagacatagagcatttccatcgttgagggaggtcacttagccagtgctggtcactgtgtggagtgcaaccaccctggtccaagctatcaacatctcttgcctggatgcctgtaacagtctcttagttgatcctgcttcttcagttttctcaatacagcagccagacgcatcctttttaaactttgcacgtcatgccactcctgggctttaagtcatccaaattccctctcagaggagtggttagtcctcagaaaggcatacagggttctagggttctggccccttctcatttggcctcatccatcaggttgctctctctgcagcaacatgcgagcctcctgctactcctgggctccagagcttgctctgcctcaagtctaccacattggccattccctctactgggagtgcccttcctggctcactcactctcctgcttcagctctctctgctcaaaagtcgctttcttggtgaggctccttctgactattccacttcaatttcaacttctcctccaactgccagcactctcactctccccttctctgcctgactttgtcttttctgtagcactcatctcccatgaacgaactatatacatttacttgtttatgatatctattgtttactatctggaagggatctttgtccatttactcactgctggaaaactggctcagaggaagctttcaacaaatacttactcaataatgaatggagaacgttcgagagctgaaaggggccctggaaaccattcttgggtgtgtggctgagggttggtgaggtgaggctattccctgaggactcacaatgagctcaagggaacagcatggattaggagccggcatcatcctaggcatcttcattgggcgagctccatgacaatgaactccccttccccttcatctatcacagtcagagggacaccaatgaaccacaaagagccaacagggacaacaaccaactaaaacatcaggggtattcaccattttcttcttggtaaaccttcgcatgattcaaccaccaatcctacctctctgataacttataagaagcaagggacaaagtggtgattcagattaatgagctcttcttacatgctactctaaccctccctcccccaacgcaaataccaagattctctgaaaactggaaatacacatggctactagattatgttttttccctaaacatatcaaacttgttttaaaaaaataaaattatggtttcattacatagtttataaattagtattttagaaaaaagttgattagtaggaaaagaatagctttccattgcatcattacaatatttctgacaatccagaatgaattagaagaaaagcagagcccagatcacattttgtgttagggatttgtctgttctcttgtatctgaaaggaagtaccatctgaatagacatagttttaaatgtctagagataatgacttttctactgccaattctggctcaaagacaaagatggtgagggagcttcaacctcacaaacagacctgttcataatggcacagctaacaggtccagggctacacagcatgacgttagcagagagcctggaaaactccatccacagctcactggatgatttaacttgccagagtatataattaagaacagttatctttatagtcattccttcattattgagataactcaattggaggctgttttagacatgctggattcagaaataaaatccttacagactgcactgcaatgtcatgaagattacaccagaaaacaaatggatgtgcatagacaatcttctgtatgtaccagaaaattagatctcaggagagacatgaagaaaaaacataaaatcaaagagggtgggggccgagcacagtgaaaggtataatcagcggcttcccagagagaggaacctgcagggccagcaagttcgctggttgttacctggggcagcgctcttcagtgctttcactaactgtccccttccagctccaaaaccattatctccatagtccaggtcactgtcactattactgccaccgctggcagagtacgtacacattctgggtgccttgtcctaaatgagtaatatgagactgttaagataattcatacaaatcaaaatgaggcagagcatcctgtgaggatgcgacacagttcacatctggctgtcaatgtgtgcacagaattccattcccactgcccagcccgccgctcacccgagagcaactctggtttgccggtttttctgcctcctgaggagctgatgctgtctactcaattaccagagctgcagaaataggcctgcaataatgaagctgtcgacggcactctgccgttgtcccaggctcaggaaggtccccacggttacctggtctgcattttgtacacttctttatagggtcttatttttctcaagtgcctattatgagctgctgttccaaacctaatggcttatttatttaactgatctcatcattgccttccaagtatcagaaggtaataaaacaatcaaccttgggaacaaaagaataaatgtttgcctaatttataattttctttcagctcccaaaaggacagtagcttttagaaaagtaagcaattgctgactccatgtaatcctcaaatctgctgacagttcatgggctgaggagcccagtttcccctcttgctcacatgtacacatcacctgaccccatcccctaaggatgtcactggtgtggcaatgatgctgtattcagaaattgctgaggcggttgacgctgtatgaacagtattcccctctgtgcacataagcagaatactggatccaggagcgcaactcctatgtgttgaatcgaggttatttggggcccttttttctgtttgtagaatgtcctgttagagcctattattcctccctaagccagatagttccaatacagatgcattagatgggtctctgaagtttgtttagaagggtgtcatttggttggggaatgtaaaaacacattttaggatgtaaactcgcttatctggggttataaattcaagcactcatttcctttactctttcattcatttacttagtcacccatccattcaacagtgtttactaagtaactactctgtgctaagcagtatgctaggttttaggggtggagagcttaatactggagataccagtagtctagcaaggactaagtccatgaagaaagacaagtctactgactgtagttctgggtaacgtgtgtccagacctccaaaaggacccagtccagtctggacatgatgaggtacatcctttcatagctccattcaacaaatgctaactgaaccaggcatcgtgccaggtactagaaatataaagctaattcctgcttgaaacgttccctatctggcagtcaacaaagcagggttctgagtttcaaggatttccagtgcatggggctagtgcaggacgatgaggaagggaatcctagagaagtgtgtccattggtggatgtatgtcttatgtgaggagtgcaggtcccctctgggtcagcaagagtaactttttttttcctttttacgttcttggaattattcaaactcctttgccatcaacaccaactgttgttcctgaactggttttctgctctccaattctgtgtgtctgtcatgattttctaaattttacagctctcaattttctcaatttgccagtttcccaatcctcccaaagccagcacagagtcctttggaacagtggcagcaatgctctgtgcaaagtgtgttccatggatcagcagcatcagcatcacctggggatttgttagaaatgtgtacaccttactccgtatatgccaaatcagacacaagtctatgtgggcaacaagattgtagcccttcaggtggttctgatgcctgctccggtttgggaggcactgatctggaggagccctaacattctgtgtttgacttaaggcatggcagaacacagcagtttcctcctttgcctctcagacccacgtcttgtggaggcagccatcccaggtgctgccctggacttcagagggcccagttccagtctcggctctacagcaactttccccgggaccctgaacatggtccagcaggactctagtgttccccactggaaattgaggctgtgggcccagaggatctgctcccctacttgtccatggtccccttccatactgaggcagatgctcaaggttgaaaggtggtttggccacactgagtgagggagacctcagatgtgggtgaatctgggtatctcatcatcatagttgggcagaaactttagtaaaaatagcaaccaaggctcttgataccagacctgggaaagccaagggcagcaaaagtgggaagggccaaggaggggccaggaagttctggaaaatgaaccatgtgtcttcctcctcctttctcaccaccaggcaccagggcagatgctgcagtgggccaccccaggacgagtggtgaaatggcaaataggctgaccatggtcagagtaacctgctggaaacggtaaacaggagggggtaccacataacccccactaggaatgagcaaggagtccctgagccagacacccatagccacccatagccacccatcaggagttccgtgtgtgtcatctcagggcagatgaagaacccactgcaaaaatgaaactcagggctcacggattctagcaagtcatttgaccacaccgagcatctgattagccatccttaaaagcaatagaattagatctgctttccctgtttcataagaacaaagtaaaggttaaaataactactgagatactgaaaaaatagaaaaaacatcattccaatggcgcccacatggcttgggagagtgaatgcttgtcccacaatatctaatcaggggagtgcatccatacccaagaatctgggtgcatttcagaagcactttgatttcttcagaataaaagtgtcccaagaacccacagtattccttaataaggcaggggaaagggtgaaccctagaccttggtttatattcagtaaaccaacagcaaatttcatttaaagtgaaatctatcataaaagtgtttttagggtacactttttagaatcaggaccaacaggtggattgcacccttcacctcccccgacccctcacctgggtcccggtggcagcaacttcactcccccagtctggaagcggctggcttgccattgggtcttcagcatatccgaatgatgagcatgtctgaggccttggctctgcttcattctgcttttgggaactgacttttcctaaatgaggacacgtatgtggaatcacatatcacctttcatcaacattttacaagtttagggaaggaggtgggggagacattcagaaataataaaaaaggtccaaatacagtgaaagctgggcttcctgccactctgtcccactgtagtctgtgctgcccaaaacatctgcttaattatgtatacacatctatagaagccccttttcaagaccccgaggcaaactgttcttagactacttttctacaaaatgttgaaagactacaggttaggaagggttcagcaggcaaaccattcaggaaacactaaagttattcttcaaataatgttattcatccaacaacaatcaagtttcttttttggaggacttctcagaggcttcagtgtgccaatgggcattagcgtagtttccgaagagaggatttgaatttgcaggcttcctcaaacatagggaaccccgattttcctaaaatacgtattaaggttattttgaatagtgtggattgggaagctttgcttggagcccttaaacatctctcagggcagtacttttcaagctttaatgtacatatggatcagctgagcttttgttcatgtgcatgctgattcagtaggtatggggtgggctctgagagtctgcagttctgacaagctcccaggtgatgctgatgatgctggcccatggaccacattgagtagcaagggtgtaattagcagagaacaattaaagagagtttccccactacccatgaaagtagattaacctgcatagtgtatgcctttgtcatgccagaatggagaattgctgtcattatcctccaacctcagtgattataagcaagacatgctgtgacagcctctccagagcattttgtttgtgaggggaagctaagaactgtgttttcatcagcactgtgagttttgtatagtgacttccatttttcatatggggataagaaaaataaccaattcaaatgtacacatttgaattggcagtgactgctcaaaaaggagctataatctcattttctttttgttccagctagtcctcattccctaatttttaacatgcataaccgatggacacagaaaagagaagcactggaaagtaggccctgcctctggaccacagatattatgtcaggacaggaaagttcaggatgggtgacaaaaatttcctgcagtgtgttcacctcacactctaccatatactacctttttacaactcttcactgtaatttaattaagatagaacccaaagccaggtgcggtggctcatgactgtaatcccagcactttgggaggccaaggcaggcggatcacctgaggtcaggagttcaagaacagcctggccaacatggcgaaaccccatctctactaaaaatacaaaaaattagccaggtatggtggcacatgactgtaattccagctactcaggaggctgaggcaagagactcagctgaatccaggaagtggaggttgcagagagccaggattgcaccattgcactccagcctgggcgacggagtgagactccatctcaaaacaaaaacaaaaacaaaaaagacagaaccttagatacctggtgcagtggatattagcagcaacatctgaaaaatctccttctgatcccttatgaagcaattcaagacttgcggtttctattcaatttgttataatgacagtgtttaatcacggagtctacagcagccgccgctgaattgaggtcacatatgtgactattcaggcatggagtacacaacctataactaagatttcgcccctgaatctctggaggctgtgtcattaattaacaacacatttatctcaaaaataatatgcattacagtctttaaaaatgtagccttgacttggaatgagcagaagtttgtgacgcaacattcgtggcaatgggtattcctatataaaggaagaactcagccatgggaatagcccaatcacatttattcaaagatttataattaaaagtctccttttctaatttctcagaagcctatagcataatctccacttgcagctcctttctaatcatcaactcatacatgaaagtgttcgatttaaagttttagttcctatatttatgcatgttgtaaaagcaacataagacatacaagttaaaaattatttagtgtcatcctgggctgcaatacacatttttaatcgtgagggaacaatgaaaaactgatgacccttagcccagccctgtctttcatcatgaaatcttgtttcaattgactgccacgaaggatagtacttctcaatgggaagactcactctattctattgcaatcggtgcacgatctactgctgatttatcaaactatgtcttttatagttcaacatataaagatattttaactggataagaatacaccagaacacgtatgtttctggttagaaggcaaacaacattgtagttaaatctatatcttgggctgaaattggtctatattcagagttaagttttataggataaaacctcacaagtgtatgttgcatggcttttttcttaatcagttcatatatccatataccagtatttacatgtctgtttccttatatgtgtgtgtactgcttgatgtaatactatgagtagatattgtcttatacacattgttttgcttgttggtgaaggacatgaaggaattttcacatatctacatttttatcaggcaggtcactgacttactcatctcctggtgaaaagtttcccttttttttgtcagcaaatgtcttattaagggtgggaaattggcattttacctgaggaagctggtttggggaggcggctctgaagaggcctcatccctctggcggtcatgatggggtcggatgtggaatgaacaatggcgctatctgcagggcgctggccgtctgtggaggaaggcacttcacgttcaagggtttgggctctcatggaagaaactgcagaaagggctgactggagaggcaggagaggctcagcgtcctctggggagtctggctggcataggtagcgtcctgtcgagcgatttcccgagtctgggagtggaaaggttccgatcccactgtccaatgttctcatctggcagttggattctgagatagagagacagagagagaagggaatagagaaggctcacataaaaggataaaagaatcatggaaattggggtatgatctggaggaaaggagacacctagaagggtgaatttaagaaaaagaaaaatgtcacaaggacagaaaaccaaacaccgcttgttctcactcataggtgggaattgaacaatgagaacacttggacacagggtggggaacatcacacactggggcctgtcaaggggtggggggagggatagcattaggagatatacctaatgtaaatgtcaagttaaggggtgtagcacaccaacatggcacatgtatacatatgtaacaaacctgcacgttgtgcacatgtaccctagaatttaaagtgtaataaaaaaaaagaaaaatgataagcatttggaaccagtattagtggtgtagtaaatttccagtgaggtgcatgaagtggacctttttgaacctgaaaacatcccccttcatgtaatatgagataagaagaccagcctgttacaagcagcaatagtcgcttgtgcatatatcctggataatcagaaaaggaacagtcattagagaccaaattgtggtcacccttatttcaatctgggaatcatacaacttcaaccaattaggtgaaatttattaactgaaataatgagtaatgagaacacataaattgaagtgacgtcctaacaatggtaattgtgtatctcgtgcatgaatgatcacccattcagcagttgactaaatctctggcctcttaatttgactgtggggacaagtaattcacacgccagaagggtcatcccaaagggtacctttcccatcataacaccacttatcatgtggacttcattcgacccagctgagaagactgcgagccactttctttcactctcactttattcaatgacaaaactcatcaataacgctttggatttcttggcagtcccagggatcccactattctctagaacaaattaagatgatttcaccatgtgtgtgacatagtctgttaattgtgtgtcagctgcaaaacattttatatacggagaaaagtacagtatctgaaaaaattaccacgtcatttctggaatggtggtgtggtttatcaaggccaatgaggcagcttccaagatctggatgtcacccagaaagtctcctgttcatatgataatcctggaaggaaacttcctaggtttcatcttagaagcatcttacaagtctagcactgggtaagcggaacaacttagcactgtgttaggcatggtggggaatgtaatagattacgacataatgtttgtaccaaaagctcaacagctaccacttctttggtgctttaagaacagaggcttgtggtgtgatctccgcctatgactaattgtttcaacccctgtgcaagagctttagcctctcgaggtctaaggttccttttactgctgtgaggattaaagtatgttcatcatttaatccttagaatttagaatggcactaagcacactgtgagacagccaagtaaatgaataaagaatggcaaaatgcacaaagtatttagtatatttattacatattagtagatatctgataggtgaacagcttatccttaagtatcttttctatacaatctcacttcatactaagcaattactatccaaacttcagaatttgcccattcccctaccttcctcctcaaaacctctttgctgagtagcagaagtctgggaatttcctaatactgaggcaaaaataaagggatgggaatgtgtacagagttggcttttctaggctcaaagaggtttggtgcttggtattggaagtactaggaagatgaagtccctactcaagaggcttcaatcttcacagggatatttagtaggaaaatacagatactcttttctccactatggtgtcatttaaccatctcatatgccatgggatgtttggtcatggactccaggatatctgaatcatacagacgcaccaagagaagtgcttttctttcccaggattacaagggttttagcctcattaatttcagggcccccacctggccagctttattctcaaccagacttgcagattattcatgaccttctcttttcattttctcctcaattaagggtatttaattgttatagaatggtgtttttgagaaaggatcatctgtttgcatggggaggcactgccagatgagtcaaagaaaggacactgctattcagacttctgtgtcttttcttaattttagcctacacatacaacacttcagatttacatgtccatgtgttgtaactggggcaattctggaagactgaaatatttcagatttacaggagtaagtagatcttcatcagaaccgactcagtctttgaagatgagaatcaaagattcatgggatgtagcagctgagatgtgtcagaccctatgtaccccaggctgcctgccctaataatttaccccagcatcctcaggaccacctatccctgaatcaaagagggctcagcagggcaggacgttaggggcgctttttcttttgagaagacgcgtcatcaaaagtttggtgcttattacagctattaggagttctgctttctttgtatcatttcttcatcctcacatacctataaggcaagaactattattgccatttagaaatgaggaatcacagctaaaagaggttaagcaacttgtccaaggtcatatgctgtaaatgaaagcctggacttgaatctaggcctaactacaaagacaatgctcttagccaccaagctatactgattccccgcagaagcacaagtaaaccccaaagtgggctctgctcagttcatagccattcaggcagccacgtgagcagaagcctcacagcatggccccatggcttccaggcaaggtgcccagcttttcctctgaaattggtgctggccctggaattctagcttggttcctgggctccccattctgtggctggagtccactgtcaacatgcctggcatctagctggttgtctggtcctttgcaggatgcctatgcaaccatatctatatagttctgagaatcccaaatgcctagcaactcttccttctgccctcttggattgaatccttagacttctcgccaggattttttttagagtttactttgcctcctgatatggtttggatctgcgtccctgctacatctcatgttgaaatgtaatccccagtgttggagctggaggctggtgggaggtgtttgaatcgggggttatatccatcattcatgacttagtgccatccccttagtgacaagtgagttcacatgaaatctggttgtttaaaagtgtgtggcacctcccaccttctctcttgctcctgctcttgcatttgagacacctgctcctccttcaccttccatcatgattggaagcttcctgaggccctcaccagcagctaatgccagcaccatgcttcctatacagcctgcagaaccatgaaccagttacacctcttttcttataaattacctagcgtcaggtatttctttatagcaatgtaacaatggcctaatacacctctagcttggtgataggcagacttccaagggcaatgtttttctggctttgtctccctcttctatgtattataaggcacatagagcacttaatccagtctcctcaaatgatgattcaaaaaccgaagtaagaatcttgacagcctttttcattttggcaataggtgccataaacaaagctcatacacgtttgtctaacctataacacaaagccatcgggtagttgcaggaaataggccagaggaggaatttgggggtagaaaaaatgttgaaggtggtctaagtctggagcctttctgaagacaacaacattttctagcatcagtccccttaaattattttactttcctttcaacacccaatattgttataccagagcctataaaacaggacttttggaattcttgagttctctgattcccagagaattgcatgccctgacattaaactcataaaccattcactattaaggccatttttatttctagaaattacagatgccaaatgtagtgaatgtgaaggattcatttgtaagtacctatgaagtgaggtgtggacagtcaggggctcagacacatgccaagtttccctgcaagaaaatgtcttcagaatacataaacctttggaaatggaagtttatattgaaaatgctgacaccatctttatgtagtttctttaaggcacaattagtttcttgcagttcataaaaatattgtaacccgaattacaagtgttaagatattgtacttctgaagccagttttttttctcagagaattttaagaactcacaaaataatcaaatggttgtagtaggacccaagttcaaaggggcaagcctccctcatcttcaatgagttgatgcagtattgctctcaacaaatgtgagttcacagctgggcgcggtggctcatgcctgtaatcccagcacttggggaggccgaggtgggcgaatcaggatgtcaagagatcgagaccatcctggcccacatggtgaaaccccatctctactaaaaatacaaaaaaaaaaaaatcagttgggcatggtggcatgcacctgtagtcccagctacttgggaggctgaggcaggagaattgcctgaacctgggaggtggaggtggcagtgagccgagatcgcaccactgcactccagcctggtgacagtgagactccgtctcaaaacaaaacaaaacaagaaacaaaatgaaaaacaaaaaaaaccccacaaatgtaagttcacatttctggctgtgagtgtagttgcccacagggccttgctaagaagttcaagggttgggttgttggatgtaccaacgggcttcatccttgcaaggtcaccaattacatctctgattctggtcaaccctctcacctgttcccattgttccatgtgccttctctctgtctctcaaggtattaacaaattctcacagttaccaccaccatcaagacccaggcacctcatgggatgacttaaggcactacttcccagtccttttaaagttgtatcgcacataggaaatatacagttggttgaggaaaacaccagtccccaggacaactggtcaactgagggctgaacaagctccatctcggtacacctggaacccattcagagcagtctacagcagaatggtagagaatctcatagagaatggagtccccattctcttttactgacaccttgaatacattcccttgcatatgtttggtatgcaaggaggagaccttttcagtctcctagaagcaaatacaggactttctacaaggctctccttttgggggaagaatgttaagactgcttggggcagaaatattgtctggcaccagacttcagtaaagaggaaagttactgtgtctcagagggacataagcagccaagatgggtgtggttccttgtgggatggtggcagagaattttgaagaaacatttccactggggattttcaagttgctaccttagggtgtgtggctgaaaatccccactcatctcactaatgagtgttaccctgctgctccctactcccagctgcctccgcttctggccttagtgtcttcatttgcaaattagatcccactatcttcattataggggtgctttgaggactagaaacaaagcatgtgataagcctggcacaatgcttgcaagaggcacactgttataattcagaaaatggcaacagttctcaaaataaatgttattagactgtaagcatcgtgcaggcataactggatttgattcatctcctccattctcccatataagtggctcctgctccatgattgctcttattctacagaatggtaattatacttcccaggcgtctgactctatcaccagtgctcagcatcacacctaacacatagtcagccctcactgatgtggaatgaatgaacaggtgaatgaaaaacaataaacctttagaatggtcttcctcatcgttaatggatgtgaacctcttcttgtgaaatcacaatctgcttcttttttgctctgactttagcaaccaaagcaaacaactgactcccttttctgtagttatttttcacatgaagccagacttcattaatttagatggccacagagataagatcattcagaattcctgaatattttaatgatggatttcttagtactttaaagtccttgggacaagaatggatgaccaagacaaaggacagccaacagtaggctgttctaacatcctcctcagtccctgtgccagtacacagcatcactgggcctgaaggtcccaggtctaggaagctagtgtggcacagtaactctggctctcatcccaaggaattctagatgccaagtggaatgctgccatactgtttaacaccagcatccacagtattgtgagaactaagttcttactaaagagtcacgttcctggggccatttgtagtgaatgaatgagattactcattatatgaacttcttaatgcatttagccagaaaagtgagttgccctcttttaaagcaaatcactctgttaacttcattgactattgccttagtccatgttgcattgctataaatgggtacctaagactgaataacttataaagaaaagagatatatttcataattctgcatgatgctgacatctgctcagcttctggtaaggcctcaggtagcttttactcataatggaaggcaaggggggctggtgtgtgttacatggtgagagaggggggtgagtgccagactcttttaaacaacagctctcgtgtgaaccaatacagtgagatctcacacattacttcaaggagggcaccaagccattcataagggatccactcccatgacccaaacacccccaccaggtcccacttccaacaatgggggtcacaattcaacatgagatttggaggtgacaaatatccaaactatataaactatgcttcttccaaacttgttttataccatattcgttcacatagcaacatcatctttataaatagctgcaaagaaaaaaagttgatttccagcactatttcagttaatataaatttccaagtgagtaggatatgaattagcaatgatctgtggtgtttgggaaatgccactaatttgtttctcagccttttcttctgcagattcaagtgtctccatcttttcttacggatccaatttcacatatctgtaatggtttgaatttgtaacctcaaaactcttggtattattaacgtatctgtcaaaagagattattataggccaggtttaaggaaacctgactttagttctaagttactctgaatattcagataaatgaagtgagaagactatatgcttcagagttggaaagactgagctcaaagacctgcttggctacctgcttgctgtgggacaacaagggctttttagaactattctgacttaaatagtcatagctcattttaaataagcctggcagagtgctcattataaagcagacactcaatatatttctataaccggttgtcagggagaagtgagggcccctgtaggtacataatacatatactatcatggaatccaagggaaaccaaattgtcatttgtgcaggtagtgttacactgcagcatctgggtacactttactcaacaactaccctgcttatttcccaaggagttaccttttggcaatcatttccctgggagtcagttcatcaaaagcattaatgaatgatgaatatgcaccaatgtacttgaggtagctgcaatctgcctcatgtagagaaaacagagagtctgtgtttttgagaaatctatgttggaggcagcaccttaaaaagctttttaaaaagcctatacaaatgatgtctgctgattctcccttgtttacagacttatgacattctcaagtaatagtcccagattactacaccatgattttcagtaacttacagcacatggatcctaaaagcttatacttccttctgtgcaacgatctacccacttacagatccaaacaaattatgctagtaatcacctttttcccctctgcaaccctcattcataaatcccacaaaaatagaaaactttgaaactcaaactttttcactttgaaaacttccacacagccataaaagtttcagccaaacatacaatgaggccccaacataattcagtcagaaagagtgactcatgggtgtttaatattcataccatcttattaattggcatgcattcctataatgcaagtggtcatgtaaataagtctttgtagaaggtctctccaggttcctaaacatctttaagctacatgtggtattggcagcagaaacttaaactacagatgggaaaacagatctctttatttgcacatccttctctttatctgaatggctgaaacaagcttaaaaaaaactaagtctgttgccaaagccacatcaattaaatgttagtgatccattctaagtttaccccatggttttctccaagtagtaaaaagtgattatactggttatttattcacaaccattgggtagcttttggctgtggcattaagatgaccttctggaagggtaaattcactctgatggctttggagttcatgagaatactcagcctctaagttcaaactggattttagcttcctgagatttgaaaaccaagcaggataatataaatgtgctttccaatctcttgtgctgtctttgggataatggaagaccagactttgggagtcttgcatagggaatgagttgcataggggatgaatatttttaaaatgtaggaaattaatatgacaaacaattaaaaaagaaaaaaaaatggaccatgaaattccttagtacaaatgaagaagttatttaaaccaatataaaagaagtggcatctcaggctaagttggtatccagtgactccaatattctttgtctgacagtagcatcatgtaaattactgtggtaggatgtagtttaaggatacaaattggaaatggttagaaatgtattccaaatgcccacacagaccatgcctttatagaagtctttcttgaatttattttcatatacagctgttatagcctctgaaaaaaaactccttcatgtgcttcttcttgtcactaatactgaaatggcctcttctaaagttttgggaatggttattggtctagtattccagaatatgttatgcaattttccaaacacttctagatttttgcaagtttttataattatcgctatactcttgtcactccagactgaaaaatcttgaagtcttcacataactgcttcacgtcttgctatgctaatatgcctctcttgaaaaacaatggctacacttgtacacagtacttactgtgatacgtaagagtgggctaatgtgaccactacagtttaatggccagcatttgtttgacaaggtcatctgacttaggaactcacagttggatcccagactcctaggtcctgttttaagagttatcacttccagttcaaagtccttgtttataagagtaggacacagaactctcccaactcctcacaaagcaatgattaccacttaaccacttctgtatccatacatcaagtcttgtcctccttggtttgacatttttctaactgaaaaaaacaaacttactttaattagcaaaaccttctagagtgccaaataaatgtagaatcacaatggctccagccctgatccttaattgccatttttctaattgaagaaatgccaacttatctatccaccttttcgcactgttatccttgcccattctctaacaaaattactctatgctcaacctttttcccccaatctaattacaatttagctatctgttggtatctccttttaacccacttctgggcttgtgcgtatgcaaggcattttaaacctaaacaaatgctctttacgcattctcctttgttcacagactcattacattcccagatcacatacccaaattagtgagtcatgattttcccttacagaaggtataacatatcaatcctaaaagattatctttgcttctgtacaacaatctactcatgcccataggttcactccatctctagctgtcatgccaaaatgaagtgaaaagttaaacaattatttggtgaatctgatagacacaggtggctattatgggtggttctgtctctttaaatctcttttacttcacatcaggtttggtgaattacatggacaactgcctctattcttaatttcacctgcctggataacatctgccttgataagacacatgagggaagagagtaaagaaaataacttggggtacaatgccgcaggaagagatttaaatcagctttatttgtcaagaaacatataaaaaccaggaagcatggggaaattcagatctatcaatttagcaactgatgaaaattttattaaagatatttacaggagcattggagccagatcaccctattcattattgctctaacttttttaaattaaaaatttgaagttagatactctaagagtataaataattttagcctgcctatattactgtaattacagatatttaatcaaagtcttcagaaagataagaatttaaagttcaaaaatgtttttctccatttgtctccatatttaatcagtattaattactttttcaattatatgcagaaaagaagaaagctcaagacttcacaaccttaagcttttaaaaaatattcattttaacatgttttacttgcttctaaggattttaattattataagataatctattttagctgaatatcaaggatcatttatttttcttttatgtgactgtagttgaaatgttgacgaagggaagactgaagttgagatgagtccatctttccatttcagtggctaccctccattcaccaatatcccatggctgtctctacaggaagataataaaagaagtaatgaaatccaacagaccaggggatatggatatgggtaaaaatatatatagatttttgcttccatccatgaagaattaaattgttacagaaacacatgtgcacatgcacacacacacacacacaattgcagtgttttctgacattgaaagataagcacagaatttgatctctgaatcaaggaaaacaaatgaagtgagccctacagttactccagccaactgcctggagatggtttctagactgaaacatagatggaatacaaacatagcctggaggtaaatataggtgttaaaggggacagatatgaggatcaaggcagctaaaatttgcagggcagatgtatattaaagaatggagaacactagaaatagtaatatatgatctatatatatattttgtttattgtgaggtttctaacatatatagaagtaaaatatataacagcacaaaggatgggagaggttatatgaaaatagcctgtaacatattatgtaaaatagattatgataaagtaacaatgtaataaaattacatttaaatgttaaaccactcactaaaacaggaaaatagagaggtatagctaataagttacaagaggaaataaagcagaatcaataaaaacattcaagtcaaaaaggtagaaaaggaggaaaatagaaagatgagacaatcagaaaataaataattatatggtagatttaaatccaaccatttagataattacataaaattaaaatagtctaaacactccaatgaataggctgagattgtcagattggataaaataaaaattggtatacaaaatatacctatttatatgctgtagataaaacattcattttaaatataaaaaacagataggtgaaaagtgggacagaaaaatatatagcatgcaaactctaataaaaagaaagctagagtcactatgctaatatcagaaaatgtaaactttagaaaggaaatattaccagggatcagaagaaatatgttatagttataacaaggtaaatttatcaagacattataatcctaaatatgtatatctataacaatagaactccaaaattatgaagcagaaaactgacagaacttaaaagagaaaatgtcagatctaaaattaaaatgaaaagtcttctctcagtaattaatacaacaagtagagagactatcacaaggcatagaagatctgaacaatataatttaaaactttgaccaatgtgaattgtgcagcacactctacccatcaagggcagaatgcatattctttttgggtacacatggattaagatagaccatatccttcattataaaagaagtcttagaaaatttaaaatcaccgaagccatggaaaatatgttctctgagcatcagagaattaaaagagaagtcaatagaagaaagatgtctagaaaaatttccaaacatttacaacttatacagtacactactaaatttcctgtgtattaaatggaaaataatattttgaaatgaatgaaaatacaatggaatgcagctaaacagtgccttaacaaaaatgtacagcacaaataagacaggcttaaaataagtgctctgagacttcattttaagaaactagaaaaataagaacatattaaacataaactaagcagaagacataaaaatgagagctgaaattaagaaaattaaaaaaaaaaacaatttaaaaatcaatgaaacaaagagctggttattttacatgactgatccaactgacaaacctccaactagattgaggaaacactgactaaaggagaaaagacaaaaattctcaatattatgaatgaataaggaggcatcactacagatcttccagtgaataacagataatatgtatgtatgaacaaacttaagccaacacattttacaattcagataaaatggaaatattttttgagaaatccaactaccagaactcactcaagaaaaaagataaaccaaatagtcctatatcaatttaggcaattgaatttggaattaaaaatattttcatgaaatattataggcctagatgtcttcactattgaattcttcagaatttataaggatgaaaaaaatgatcatttctttataaactcctttagaaaacaggagaagagcaaacactttccacatcattttataatgaccatattaccttgatatcaaactcaaagacatcatacatagaggaaaaatagagatcaatataactcatgaaaatggatgcaagaatgtttaataattgatttgctattaagcatttttgcataattaagcaaattactcaccaagtggcatttacccaaggaatgtaaaatttgtttagcatttaaaaataaatcaatattaaaagaaaaaccatatgattatctcaaaatacatagaaaaaatcatttaacaaaattcaacatcctttcatgacagacaaaaaaaaaacagacacagcaaactaggaatagaagagaactttctcactctgtacaagtgtaaaagggcatctacagaaaacctacagataacaccatatttgaaaaaaatagactgaatgttcccccactaagactgagagcatgttaagaatgttagctcttaccacttccatttaacattatagtggaggttatagccagtgcaacaaggtaaggaaaagaaataaaaggcatagagattagaaagaataaagtataactgtctttatttgaagacaatataattgtgtatgtagaatactctaagggatctcccaaaacactatgagaactaataagtggtttagcaaggttacatcatacaaggataatttagcaaaatcaattgtattagtatgtattataaataattggtaattaaacaatactatttctaacagcatcaaaatatgaaaaaaacacatcttataaaatggtgaaaccttgtacactaagaagtacaaaacattgtagagataaatttaaagaatactgacataaatggagagatctgccatattcatggatcagaagactcaaaattgttcggatatcaattctcttcaaattgatctacagattcaatgacattttaatcaaaacactatcaggtttttttttaaaaaaagacgttgacacattgattctaaaattatgtgaaaatggaaacattttcataaagtaaaacaaggtcagaggtctgacactgcctgaattctttataaggctacgttcattaagagagtgtggtattgggtaaggatttgcacataggtcagtggaacagaacagacattccggaaatagactcacacatatattttcaattgatttctgacaaagatgacaatgtaatttaacggaagaaagatagtgtttcaacaaaaggtattaaaaacaataaatactcatctgaagaaaagtaaacccttttctcacactgtatataaaaattaacacataaacccaaacacaagatctaataccacaaaacatccagaagaaaatatcggagtatctctgtggccttggattaggcatcaatttcttaaatagagcaagaaaacatgaaccataaaataaaagcatgataaattagatttaatcaaaattaaaaattttgtcttcaaagacacggttaagaaaataaaacgcaagcaacatatacccatcatgcaacacagctataatactcttactgttatatgtccccccaaagacttatacacaaatgtttatagcagctttacacataatagccccaaccggaaactatcaaattgtttatcagccagtggataaacaaattgtggtacattcatacaacaaaatactaatgggcaataaaaacataaacaaactaaaaaaccactgatacaacatggatgaccctcaaaagcattatgcttattaagagaggccaaacccccaatattatgtattttatcattgattccatttacatgaaattctagcaaaggcaaaactacactgatataaagcagaccagtggttccctgggagcagtggtattaggagagggtggggtgtaaaaggcgtgaaggagtattttggggtgatgaaagtgttgtaaatcttgattgtgatagtggttatacaactgtatacatttacaaaaacttactgaactatacacttcaaaaggatgaattttgttatatataaattatacctccatgaacctgcttttaaacattttatactcagcctgccaaaaaaaaaaaacaaaacaaagaaaaccaaaactgaaatcaaacagtgaactctggttgaacacagatgagcaaaggaactgtgctttccccagggtacacgcttgaataatcattagaggcatctgaaagtggtgttggcaagaaagcatcttcaagaatcaccagggaacaagactgatgctattccttaatcccagatctatgcaggtcacaaagggctttgtgaactcctttatcttttcaataatcgtgggaaatagctattattatcttcattttatgggggaggaaagcagaactctgagaagtgaaatggtcacttgaagaagtgccggcctgactctgaagctcaggatcttcttattcatcaacctctttccagtagggtggggatccctggtttccatagctgtgtgccccagacactcctctgcagagagggcatctaaggagcagagcctctgattcaggaccttacaggtagctgatatatgctctgtgcaaatgcatttgaccttcattacacctcacctttctgcagcataacaacatttgttgattatttactactgggcaggtgcttcacttgtattatgtcattatgcaatgtgtaatggacacatttttcctatgaggaaactgaagtttaaggaggtcaataacttgcccgtaggcctatagctataagtaggaaaaccaggatttggattggggcctgtgcaaacctcaaagcttcaggcttgattgctacatggttatagtaccttcttctgtattcagtttaccaagcattctgaatcagtaaggatgctcttggtggaaagtaacatgttaaatggtgaagaatggtattagctcacagtgcagaattagaacaagcttcagggctgccttaatccagggcctccgcctctatttgcctgcagttctcttcactgtgtccctgctatgtatcagttttatcttcaagctgttatcaggaggttttagtagctccatactagtcagccacacactcccatgtctaagggagagagaagttgactctctgtgtgcctttctctatacctccaaccacctgtcccttgaaaattaggcaaataaggtcataaactcattcccagacaaatttgtatctcttggaaaatgctgttcactgactggcccaggcctgaatttctgaaccaatcactggcagggaagattgccatgaccgccttcatcaggcttcactcctggagtggaaatgtctgctacattctttctgagtcattacttcagttgagtttatggcaacactttttctataaatggagtaattatttccattcttcagataaaacaaatgcatagagaacattatctcttagggacatgagcacatatgcagaagccggaattcaaagccaggtcttctaacaccaagtccagagctctttgcgctgctctgcaacaactatacccgtaccctactctccctgtttcaaagaaattccattatgttgctaggatatatttatattctagttccctcctttggtatttatttatttttctaattcaattactactcccttatggactctagtgaaccatttaaaaccaagtcaggatacttttttttttttgagacggattctcactctgtcactcaggctggagtgcaatggcgtgatcttggttcactgcaacctccgtctcctgggttcaagcaattctcctgtctcagcctcccaagtagctgggactacagttgcatgccaccacacccagctaatttttgtatttttagtagagatggggtttcagggtcttgaactcctgacctcaggtgatccacccctacggactcccaaagttgctgggattacaggcatgagccatcatgcccagccgaagtcgagactttttgtcagcacttcctttctaatgaggttttatagctattatttaaaataaatacatagtctgatataatttaaaacctatttggtgtgatatagttttttcttttttttcttcagtttcattttctttcttactttggagacagtgtcttgctctgttgcccaggctggagtgtagtggtactgtatctccactcactacaaccttcacctcccagactcaagccatcctcccacgtcagcctcctcagtagctggggctacaggtgcaagccaccatgcctggctaatttttgtattttttgtagagacaggattttgtcatattgcccaggctggtctcgaactcctgggctcaagccatccacccgccttggcctcccaaagtgctgggattacaggtgctgcacccaaccgaatctcacttcctaaaagaaaatctccagttgaaaaagatggtccttttaaaattatttttccacatttaccatcaacgcactaccaagccgtatccccaggccctttggctcgtcctacctgtattcactctctgtaacagacctaatgagaagaggttctggtctttggtctttgaaagcaagagtgttataaaggtagcatttttttttttacttaaaatacatataagacaaaatacatgggggaaaaaaaaccttcaaatgtctgcttagccacgcaggacagtgtttcaactagagttctgataggaacggaaatggttaactggctggcagatgactgtgacttcagtatctagcagagccctggaggctagtataaaggagtcccttgcactttgggctcactttacatttaaactatgatgccatgagcctcaccaccttttatcctcccaacaatcatgctccgagtaagggaaggcaaaaatcagtatatccagcttacagatacagaaactgacgcaaaggtttgtttagttaataagcggcaaaactataactgaaacttacgtatggttgtttcaggatcatttctgtttagggtgcattatcttgatttctgaaaagctagggaagttgtatgaaagatgtcaaggctcaggagtaagtttagcacctctgaccctgcattttaagtttgaaacatgcaaagttgttgtctttttttgtgttcaggaagcgtaaggaagacttgacagaaaatttgatgagaagatgcaacaatcattttgacataaggccaatatataaaaattcaaaagatggtatcaagaatatgtgttggtatcatcaagggtaactgccataacttggccttccaatagaatgagatcattatatgtcaaataatattgaatgtgcttttgtttctttagaaaatgcgtattttatggagacaagaagaaagagatgaaaaggcattgaagaagcttctcatttttccaaatgtgaagacttgggagtacagtcttgggggtgctcctaaaataaagagctgagttatagcatgggaaaagatcataataggagggtaaccatggtgaggagaaggcatgggagctgaacagaatagtgatgctggaggccacattagaaatatctagtgctaagcatgaacattttgtttgtgagcagagtttctaggaagtagaaaggaaaactacagtgagtaccattgctgaaggtgggattaagcagaaagccagggcagctaagagagcttcaggataaaaggctgaaaatgtctctgcaagctcaagcaagtcacaggacacttagggagcccaagcacacttggaaagaattaaggatagagccaaatgaggaggatgaggcagactgagcaggtctccctgtggggtcctgaggattgcagcagaacagaacatgctagggcttcaaaggtttgtgacagctacatctgcttaaatgtgcaggggaaggagaaacttcactctgaaagacacagctcagcccatttatttgtttcagaagaagtcctcttagcttcttgttatagtctcatgttgaaatttgatccccagtgaaatctgtcttggtgggaggcgtttggatcataggggtggatccctcatgaatagcttggtgccattctcacaggagggagtgggttctcacctttagttcctgagagagatttccctctatcccccaaaagctggttgttaaaaagagcctggcacctcttcctctcttctttcttctcttgccatgtggtgcctgcttccctttgccttccagcatgagtggaggcttcctgaggtctcaacagaagcagacactggcaccatgcttgtacggcctgcagaaccacaagccaaataaacctgttttcttcgataaattacccagcacagcctcaggtattcctttatatccatcacaaatggactgagatacttgtattccatatgcctgcagaactctattccagaagccaagtttattatctatgcttgtaaatataaactcactaatgggtatggtttattgtggagcaatgcacatgcctacagcctgttctcctatttcaaggcctccatcatcctgggacacttcattcaacttagcagggttccattgctggtcccaatatctgtctggattaaaagatccctgtgcaattactgaagtgaaagcaggtccctgcatgtgtctctagggtgttgctttctcaggcaggggttggtgaaaagtggggatttttcacaccgtgcatagtggattgcctttctacctggcagtttcataccaccatccaatacaacttagatgtacaaaggaagacctagtgcaaattcagcacagcagcctgcccactgtggaatctggacacactggttcaagggggaaaagaccatttcatctgagttccctggcagaccagtcttcttgtagaacagggcaatgtgtaaaatgcagtgcattaattgtcatcctctattctgtccagtcagcacaattatctacaagaagagcaactctcactgattttagcaggagcatctgatgcatccctgaagtcatcattttttgcccatagagaaagtttgctctaaaacccaaatttctctaataggtacccataactgcatactgaataaatatgccatttgcaggcatgcaggttttaggggccttgggcccttcccccgtgcacaggcctctggcatctttggttcccttacggtgaggggaacaaacatctctgcagaaggcatactcctctgtgaggaagttcacatcttacagacatcaaaatgagttttgaattcagactcagtctaaaaagtaaaagcattgagctttgttccacatgaactcagagggctaaacggaaaggcttttaataaagcctcttcactagggcccctgtaccactgttttacataaaggatgatgattcaggctggctggtgtctgaatcttggcatctgtagtctctacccaccccctgcccagtttgtagaataagtttattggcttagttttctttggcctggatgaagcaaacatggaaagatgacagcaattcaacttcctctagttgatattctaattatcctgttaaaatctaattatatgccattgcgtaagtcagggttctccagagaaacagaaccaatagaagatgtgtgtataaaataaagaattggctcacatgataccaaagcggacaattcccaagatcttcagggtaagccagcaagctggagacccaggagagccgatttgttattctagtgcaaaggcccagcaagctcaagacccatgaagagctgatgtttcagttcaagcacaaagacaggaaaaagaaatgtcccagttgaaaggtagtcaggcaggaaaaataattccctcttacttgggagaggattagcctttttgttctacttgggccttcaactgattggataaggcccaccacataagaaggcaccatctgatttactcagtttaccaatttaaaagttaatctcatccaaacacacctttatgaaaacacccaggatcatgtttgaccaaatatctgggcacccgatggcccagtcaacatatgaaattaaccatcacagtacttaaggagatagcgtttgtggcacacagcaatgattaaagagccaaaatgaagggagaacattttctaattcaaacacaatttttatacctccttcgaataaacacatgatgaaagatggcttatttaagataaagtcaagaaagccaccttgctactaatcccccacctcaagcttgaagagacattattattacttagaaatgaatctggtgtttcaaaatggctttcccaatatgtttctgatgtaaactcctcaaatcttatggaaatggtctgagaacaattctaaatccatttcccagatgaggcaaaggaggctcagggggtggagagggaaagtagcttgtctagggtcatactctttggaaaacaaatgtgcctgcatttttaagaactcaggagaatgcctttaatgccccctctccccacattcttattatatggtgtaccttccacctgtagaaatgatggacatcctggttgattaaagagttgactcagcagcagggagaaagcaagggttttgagggaatgtttttcaaggggggacttcagcaggtgtgccctcattgaggtagcccatttctagacatttggccctggctctggatcctgggagattccttgatatttgggtggcatgcagggcactgtgggtgacccatccccttccacggggctttactacttgagcatgtccaactgccggcagccatatctctttgcccaaaggtaacagctccagaagcagctcaggaataatcagtgatgggaggtggagatggatacccagctccctcattcctcaggtgagaaaactcttgagactcgcattctatactccagcatttcccacaggctaagctaaagttgtagccaggctgaagacatgtgtctgtggcatgcacagttaaacagggctttgtgacctgctgctgctgtcttgaaattctaacagcttttgagcaagatattctgcattttattttgcaaattatgtatctggtcctggtggtagctggcacgataacatgtttttattggctggtttctcttctctgtctgacttcccctatcgatctttcctgtacttgctgataacttacttgcccttgaatttttgttacagcaagtacttctggaagaccccaaactagactgttgtaaatgtcattataatcctgaataacactgtaaataatcaaacaaagccacctactatttattcaagcaagacaataatgcacatgggttgactagtcacccaaaatagtcatgtttatatcttctgtcattaccatacctcattttaatatccaaggggtttattaggaagtaataaccaactaagcttcccaactcctctgcactgcagaccaaatgctcaggggaatccaacatgcaaatcactccctgaagaagtagggcaataaacagcagcagagttgacatttcaacaatggctctgcatgccatctgttttaaagaaattatttgtctttgccagcatgtcaagaagagtaagttcacataatttgggaactactaaggcacgtaaattcttgattatttacaatgacaggattatctatagacatcaagtctttttggtaatgtccaaagaatgtttttaaaaaacaggccagggaaatatgaactttttgtagagtccaatattgaggcaagatattagagtgattcagtcttcaactaaagtttcagaaaatgatgtaaagaagaattctagttcagaatcagattggataagctcatcaaatggaaagcccatgtattctccatttttatagccctagggttcagcacaatgcctggaatgaagtcaatgcctaataaatatttagtaactgaagtgaacttggtttatggctgtgccttgaggtttgagtaccagaaaatgaaactgactcactcctacctgtggagcagctagcatttttcccattagctccttcttactggctggaacctaactattgggcaaagccccaggccatgaggacaatctgggaggaagaggatgaaggcactgaatgggtagcaagttgaagtgagatattgcatgtgcctggtggttgtggtttaggcacctgtagtaagagggcatcccctgcttgagagttggctggagaaacagaaggtcatcttaggcctttctcatcatgtgtgaggctcatggccaggaacttttaagactaagttcatccatccttaaggcagtctattcgtcaatatgaaccctgttaccaactcatggtgaattacgggcaaggcacaatgcttttttatgccatgacttctgcatcattcagaaagattatatctagctacttttacctcagacaaccctttttaataataactataggccgggcatggtggctcgtgcctgtaatcccagcactttggaaggccaaggcgggcagatcatgaggtcaagagttcaagaccagcctgaccaacatggtgaaaccccgtctcaactaaaaatacaaaaattagctgggcatggtggcgcgcgcctgtaatcccagctactcaggaggctaaggcaggagaatcgcttgaacctgggaggtggagggtgtgcagtgagccgagatcgtgccgctacactccagcctgggtgacagagcgagattctgtctcagaaaaaaaaatgctaaatggcaaaataataataataataataataataataactataataataatgaagatcgatgcttgagttcctgctagcacctggaatggtatcaaacactcagatgcaaaagcacatttaatgctctccataatgctttaactatcattagtagtattatctccatttggcagatgaggaattggggctcaaagaggttcaggaacttgctcagttccttggcaaagggagaactggaggaggcctgtgtgaccatagcacccaggctgtgagactgttgcaggaatcaatgaaaacacactcaaaaatgcaaaacttgaggcaaatacatgctggtaacattaccaacaaggtctaagttctgtccagaaatagctggataagctttgcaaattttctagtgtacttaggtccgatgactgaaacattgtctccccacagagccttaggaaatgggaacttgaaaagggcagacattatgaagttcaggtagtacacctacctccctcaaaaagttgcagaaacttgggccagggaaaagcattagagtgtatctagaataacctctctctgtggttgaggagagttagacacgcagagagacagagatgaagcattttgacagaacccaaaactatgcttttgattcctccctgccccaccaccaacattcattaccatattaccctgtctctccaacagttttaaatctccttagaaaaacctgactcaattaaaacccagaaaataagttcttttaaaaaaaaatttaggttgtataggaaagggactgatttatttaaacatgttttgaagcagaattatagataaatactttgagaccaggaaaacattttgactgggtcaatggtgaggggaaatgacatctttggaaatgcgacacattcatttggaagcagggcggccaatgcccactccaaatatgttcttgtacacttaggattccttccaaatggcctctgaaggtagaactcaggcctgagttttcaaatgggcagaaactcactttaaaatatatttcccctctgtttgggagctgacacaatggagttacaggcagagacggtttatcaccacggcatgaaagtctctcttcaaattcctccagcttttataatcaaacaataacatcgccagagtataggttttagctacataagaaacatattggaaattgattcaatgctcctggcttggctgtaacaatgtttcataacctagtaacctctcagcttgctcttcccccttcctgaaaagctttcagctgcaagaaagtggcaaagcaaagataaagaaaacatcatccttttatctgatcctgtgcaaaatgagtggagcagacactgtaccagcgataagatgattgctaaatgactcttctcacattctatcgatgggctgatgaaagaaattaagactgacattgataagttatttttccagacactaccgttttcaaaaaatgaggatttctctttagaagcagtaagccttggttgcatgtctatgactcattaaaaagtacccagatcagctctaccttgtaacagattaactggaaacatacatagttttcctttccctatatcccattttctatttctctggcacatcctctttgaattcattcaagccaagaacaccctgttctcaagatccctttcctacctacttttctcagtcacacatttcattaaacaactcaattttcatctccacaatttgccacagtcctcacccaatttatcattctagcattttacatctctctcaagctaatgtatttctcaaacatgccagatttaatggacatatcattgggaatccaggtgaaactgtggattaaagaaactggtgactaacaggaattcttgatgttgttttccaggatggcagataaggaaacagcttgttgaaatccccttggcttgctaaatggcaaaacgggctgaaactgtttggaaccaatatagctgactagaatctgcacagaatagacttgcttgctggatgagtgaccttttgacatcatagctggaatttccaccatatgtttcagaccaactccccctgcatttgcacatgtgactcatgaagaggcatgaagagacaactgcatacaccctagggattttacaaacttccccctttcctccaccaaatcactcgccaatcccgaaatcctcctcccaaaatttctcccctcagtatactgcttttaggctggcatgggagatagatttgagttagcctcctgtctcctcattcggttgctttgcagtaaacctttctctgcaagagactggtgctgtgatgttgggctttcctttgtgtgggggcaaatgaaccctatttggtttggtcgcactggtggaatgagtgtgtggatcattttcatggctgcggtttttcattaagtacctgtgactgagttcttacaatagggacagtgacttccaagctagattatagggtttttgtaaatctacaagtcatttgttgccagcctttttaaaaaataaatacatgaatcactgctgcttttcagtcgctgattttttattcccttcaggcataagaaatcctagttttcacagcacctaaaccacagacagttcaacctatctataatgtctagtaaactcggaatcatctgtgggagaacagaggaaaaaagatgagaattcaagggttgcccacaacctctgtttttagctcctcctctgacacctgatatgcttcagaatgataacctgaaactttatagttgtgttagggacatgtccctttctttccctctctctctcctcttggcatctctcttgtgatgccaaagagctgctccaaaggtagacaggaagaggactgggatgggggatgaatggcacagatcagacgagcaaaccaaaggcaggctgatgtggcacatagacgtgttgcgttttgttttggatggtgtttttaacttaaaaaaattacaaaatacacttcaaatacaagaatgcatattatcaaattattaaatttaaatcatcagcataacccatcctaacaactttaaccatgtttttaaattactcatgtgctcctctctgattacatccttcaatcaccactacccgttgataaagtaactatcttgttaatttcatgttattcattaatttgctgtttgttccttcttaccatattgtttagttttgctcactaaacaaatagaatcatcctgtaagtgttctgctacaattggcttttttttttccaatcaacattgcttttcaaatgaatctatcatggtacttgcagctgaagttcattaattttcactgctgtatagtattccatagtataggtatttcaaaatttgtctgtcctttccactgtcaatgaacatttgggttattttctaatttttgctatgatgacaatgttaccacaatcactgtgctatatatttcctgatatacttgttaagggtttttctagggccatgcctttcaaactttttagactactatccacagtaatacattattttttatatcataaaccagtacacctttgtatgtgtaccgatttataaatgtgaccaaaatgtcacaatatttttccttaatacttgtatgacactccaatattttcactgggaaaaaagaaataaaaacaaaacaaaagcaaatgccaaacttaactcccaaatcgatttcatgactcacagatgagtacagttcaaaaagtctttgtttaaaatatatttttttctgttattaatacagctataccaggtttcttttctttaagattgtgtggtatttatttttctgtccttttactttcaattttcctgtgttgatgtttagatttattatatctaaacagctatatagctgcttgataatctttgccttttaactagagattttagtctatgtacatttattacaaatcctctatgttcagatttctaccttttattttatgctttctagttgtccagcttttctgtatttttcttttttttcatgttttcttttggtttgtgtttctcctccttactatttaactttccccctactttttctactagatgggaaattttatattttatttctacccttaaatttgttaacctagaatttttcacatgcaaatataacttaccaaactaatatattaatcattttccttaacaatataaggacattacttgcttaatgcctcttcccactcatttccagttctattattgctcaggatttatttctcctttgacatatttagtaatgtacttttattgttatatagagagtgtttaccactttctctacttaacagttcttgcatttcagatcttcctgagatcattcttctcctgtctgatgtaaactctctagaaattggtttaatgaggatctactggtagaaaatttattattatttttttctagccttggaaaatgtctttgttcttgaagcatagtttcactgagtattcacttctaggccaataattattttgtctcagatacaaattatatcttcaagcacactgaagatataattctaatgttttctggttttcattgttttcagaaagaagttcactgacattttaattgtcagcccttactaggtaatctgtattatattctatattggataattctcagttctgcagtctttggaggactcattctgtgtattattgcttttttctgactctcactaatgagtcattttttccccctcatggtttcattgagtttctattgtgagttaattttacctggaacttcatttgtaagtaaagtttagagtgagtgccttgagagaggatttgagatgggttctgccagattccaaggagtactgttaacctgagtctgcattgttttttaacttttcattatggaaaatgtcaaatgtactcaaacagtgtaatatatcctcatatacctattgcccaaatcttagaaaatactaaccttctgccattcttattacatcagttccctctttcagtttcttctctggagtattagaaacacaactgggacccttttgtaatttgaagctgggggatttatgggacacaaaaagagtgaattaggtccctgagccacatgagtgcaaactaatgattcacaatcttcagaggaaacattttcctcctcttttttccccctcttttttccccagctattgttaagacagcgttaaggctgagtcaggaatttattcccaaaatcttcctctacaggtcagctttgaagttactgccctttggagtccagctttatgccggggaggggcttgtgagtctttgatctaacatttcaccctagtcaggcccttggctttcattatgtcaacaatttagctccttaaaaccaggttctgggtagggtgaatggtggggatttgaggaacgttaaagaacatggtttacaaagtctgaagagtttcccaggatatgagacttccggtgttgaaaccaagaaagtcccagcacactgggaccactggtcaccctagctccaggccactagagactagcgcatgccccatgggcaaatgctggctagggcattctcttgctcctatggattctggctttcttgctgttcctagcctgtgatgaattctttgcctgcagctcagccatacctttaagaaaatacgtataattttatattatatcctatactttagtagatgtggcattctgtgagaggattttgaaattctaatttggcatattgccagataaaagaaagtccctgaagattcattcttttgaactgagcccacatttaaacatatatcatatgtcacataagaaatctaggattttggcttctggtgaaaaatgggaagacttgctacatagggctagcattcttctatgctgacaactggagctgcttccctagaacaggtcatgttccctatatacctcaaatccccatcatcactcatgtaatatatgcatgtacatgtcaagcccagcctgcaccactcattgacctgggagctttttttgagtttgtaactcctggccaagcatctacaaaagggacccttggactctggtgcctgagaggtgatccaagaaacatctggtcatcatttagaattcttggggggttatttaactttatttcacagctacagagtatagtcttggtttggatgatgattccactccatcctcgtcacgctgctgagcaaggcagtagctttgagaacatccatttcctcatcttcaaatagcgaccatcacacttaacttgcagggctgatgtgaggacaaaacaaggcaacttacataaaacacccaggccagtgcccagcatatagagagctcttaataaggagtagatagtaatgtaatatgcatgattgtcttactttattcataattttctgtcacattggacagctttcaggtttttgcgctgaggcatactgctatctgactttgttttgaccctcacctactccttactatgccataagttacaaacacaggcttatacttactttaagtgacttaactgccttttgggaagttgaaggaactgcacaaaatcgggtctctgtatagctagttcagtttccccaactttgtactttagagcaataggccttggaaatgggtggggaaagggcaaaacttacttaatatgtctcactgttgcctgttcagtggggcctttccccttcaggtacctgggttaattcacgccacctcgtagggctgcaggtctgcctctggctctggcagctcagcttcccgatctgtagcacattactcttctctttcttaaacatcaaatccttccttctaccacttctcagttccatggcaagaaaagataccagccccatggctcattcttttagggtctgggggtactaatctgagaaacacacggctgctatcagccagtgatgctcactgtgtgcctttccggagatcacctgtatcataacaaaccactggggactttcactcaaaggaattgccagtgggtgggaaattcagacatattctggtaggctggtatgagagctttttttggtagggagtcctttggcaatccttaaatattcttggttgtctatcctttcatatgaatacatgattctatttatcacagcacaccattgatcagggaagagtgtttcatgaggaggaaggtgactggtgcgtttggttggcttaaagataagtgagagaaaatgaagaagtattttactgtaaaagtctaaatatgagcatcatagtgatcaaaagtgacgtcttaacacataggtcttgttttgaaaatctccatagtctatatattgtctgtagggctaagttcaaatatctaagctcggctttcaaggtctctaccatctggtcccatcctacaaatccaactgtatctgcatcttctcctgtgctctagctaaactggtctttgcagactcccctaccctccagtgtgccatgcgccttccaatctctagacctttgctcatgtggtttctcttgacttcaaggacatctttccttttctgatgagattctatcccttaggacactctgctgcacatcagaatcacctgcggatcttcaagaactacaaatgctgggcttccatccccagacactgtcatttaattaatatggggtgtgattttggtatcagtatttttagaggcttcccaggtgattctgatgtactgcaaagtttgggaaacattggactaaatggcaaatgctcttaaacttcactgtattacttacttgcacttgcctttttccgacagacaaaagccaatgctcccagttccactaaagcggggctctgcactctgctctgtgccatcagatgtatatagaacacacgtttctcttatcagtgatcacaatgcatttgaattgtctatttgcttctctgcatccttgctagactggagttcacagagggcagatactatgtcttattcctctttgtatgccccgaagctgatacagggcatagtttgcagacaatgctcgatataggcttgttgaactaaatagaatttagctccctggtgcaatcgataggagtaaacattttacaggagtgaaaaaaatattttacaggagtgaaaaagccatacttttaacactgtaagtccataattctctctctagtgaaaaaacagaggaaaggagtcatagactaggattcagtatgctcataaatacagaaacatccaccaaagctttatttggtgattgtccctgctggtgagaagaaagcactcacaaggagcaagctgacagtaaaaccagagaaccagccaggagggaatgaaaaacatggagggtgatatgtaattttataagcacagggcttgggttgtagtaggcagtcaatgaataaatatgaatattattattttcagtccttggtcagaagatatcacatggtcctgttttcatgggcctaacttcatgacaaacagagtttacatttcaggttgcctttgctggttgcaatctctcccttttgagtttatcacttatagttagttataagtgggtgaactcagtgcagccacagtggacatttccttgcccaagctactaatctacagtacctcttaaatgttattttgtatgtctgaaaatgcagaagtaaaattatcctggcaagtattactacaggatctgaaccatacaaaatcacaccatcctattccccatccaaccataggcatgattatctaagtagtttggtgccagtctgatagtagccaataaaacagtatctatcaaagttattgagaacatttgcacttcccacccacattttgttttgattatcaatagctcttcctgcctacaattaagcctaaatgtgttagcacactattcaaaatgtgacattcgacttaagcagccttccgctcaaaaagctgtgacaatctggtcaactttctaagatacacttttattttaaatatgaatgccatttcttctacattaaatttctaaattttcttcaaatcttcttggtgaggaaattggtaatattcttgaaatgagacagataattatcgggactttaattgattggcagctacagtactagaagacctaatgtcctatttaattttagggaaaagataattctagatgcattgtattccacaaaatatttatttgaacatctacgtagcttgttggtgaccaattacgtatttattcatacatatggtagtggcaaattaatccaagttcaacatattttctcaaaaagttactcaaggttaactgcacatagagcagtgatcgttcaaattatgcaaaataggaactatgcataaatcactgaaatcaattacatcttttctaacaactcttcaaatttgttttcctatggatttctttctttctttttttttttttttttttttgagacggagtttcgctctgtccctaggctggaatgcagtgagtggcatgatctcggcttactgcaatctctgcctccggggttgaagtgattctcctgtctcagcctgccaagtagctgtgactacaggcgcgtggcaccacgcgcagctaatttttgtatttttggtagagatggggtttcatcatgttggccaggatggtctccatctcttgaccttgtgacctgcccgcctcagcacaggcatgagccaccgtgcccggcctttcctatgcatttcttaaatgatagtaagaatttgcatgtgttctcttagcacagatcaactgaagttagaaggagataaccttggtagggggctggctgcaggctgagatgctagatgtccctaatacccattaactccttctttcagagttaagagaacctctattttttgctggacatatggctaccttcctcaaataatgtttcctatcctatgtgaccaagcactggccaatgggatgttagcagaaaggatggggcaactgctaggaagtgttcttaaaacgataagccatgtccttcatcatcctcccactttttggaaagtggacataaggggtggtttttcaacaatcatcctagaccatgaggtaacttcgggaatgaaaatcatgaggaatgtaggctgggcacggtggcttacgcctgtaatcccggcactttgggaggccaaagtgggtggatcacgaggtaaggagatcaaaaccatcctagccaacatggtgaaaccccgtctctactaaaaatataaaaattagctgggcatggtggtgcgtgtctgcaatcccagctactcgggaggctgaggcaggagaattgcttgaaccagggtgttggaggttgcagtgagctgagatcgcaccactaccctccagcctggcgaaacagtgagattctgtctcaaaaaaaaaaaaaaaaaaaaaaaaaaagagaaaatcataaggaatgtaaaccatatgaggcagaaggacaagataggagagtctggcactgctctattagcttggaccacctccctctgggctttcatgtgtgacagcaagaaatttctattcttatttaaaccatggcactttacagtttcttctagtcccatctgaaccttattctactggtagtaatggttagaaaaatccagtcgtggatttaaaaatcaatgtggtttggagaattcagatggttggatccacatatggataactaccactagacatgttctattagggctttgatacaatgaagcaggtcccagagttcctttcattttgataagcacctagatcttgggtcttgttctctatagaagtgaagcacttgattcaagagcctttgagatcttcccctctttcctgaccaaagaaacaaccacagccatcaacattctggcattgggccaggcattctctcctctgctgggtgaagaagctgctctatttgctgactttcatttgactgtggtgtagagattccttgataataacaactgtacatcatatgactattttattctttctgtctctacctaactgcagatgggcacattaccactgtggattagatactttatggttggatgataaacgcttataagaacaacgtctgtgttaccagaatggccattatacatgatgctccaaacctcctctgtttggcttaacatagctttgtctcaattcctagccttaatgcaggctacttttcaaaagtagggttctaccacaaaacaactcttttttccccggcaatgattcttgtgcagttcactgaagtaggcttgatcctgtcttttcttccgcaacccaaatttgctcaaaccagtaccaagtgtcccaaacttatagatcccaagagttcttattcttctttttttctttttttttcttttttgagacagagctttgctcttgttgcccaggctggagtgcaatggtgcaatctcggctcaccgcaacctccgcctcccagattcaagcgactctcctgcctcagcttccagagtacctggaattacaggcatgcaccaccacgcctggctaattttgtatttttagtagagatggggtttctccctgttggtcaggctggtctcgaactcctgaccttaggttatccacccgccttggcctcctagtgctgggattacaggcgtgagccaccgcgcctggcctgagtttttcttaactatgaataaaactttgcctgagttcttgttacaatacaaatatgtggccgaaaaaggtacctgtataatccgtaactacacagatgtgagttggtttaccacattagctagctaaagtctaggagaggataaggaataaagaaatgaaacaccctggaaaaatggaaatatactggtttatggtgttaagttactcaaaggtatttactgagcacctattgtccctctgcatgatacattagctgcagacaggagagccccctccggggaagaatggaggaaggacaatagattggggtggcaggatgctttggaggcagtatcagtttctcaagtagggagaagagcacctcacagacaacttctcagagctatccaaggaaagttagagcatcagggttagaccatgtcctctgtcatgctacagtctggcagtaggaacacttctggctcctgcagaagagactaggagtacacccagacaatgggggagggtaattagctctcattgaaccagggggcactgtggcctatgccctttagactactgggaagatcgttgttttcaactcttttaagttggtggtaaataacatgtatctttcacttcatgaacacctaccacacaatcctaataggattcaattttttgtgtgaatcctattgggttctgcttcaataatattcttccccaaattcctcgaaggacattttctcctctttataagattttacaaatcccctgtttccttgtagggaattaatttttattatcactggctgatgtttccagtacaagacaatgaatggtatttgaattcctactaattgttaactctagtagacaattagtacaatacatagggtaaatgcattatagttagatagcaggaaagaataattagaaatacagcatttgtgatcgttggtgttaatacttctattaagctaggctagccatttgctttgtttagtctgacatttatgggggcaattttaaagaaaaaaatgcagttgctttattttacttaagcatgaatcttcaatttcaatatagagcaggtttagttaataatatcttttttttttttttttttttgagacggagtctcgctctgtcacccaggctggagtgcagtggcgcgatctcggctcaccacaagctccgcctcccaggttcacgccattctcctgcctcagcctcccgagtagctgggactacaggcgcccgccaccacgcccggctaattttttgtatttttagtagagacggggtttcactgtgttagccaggatggtctggatctcctgacctcgtgatctgcctgcctcaacctcccaaagtgctgggattacaggtgtgagccaccacacctggccctttttttttttttttttttttatgaggcagggtcttgctctgtcgcctgggctggagtgcagtggtgtgatcatggcttactgcaccctggacctcctaagctcaagcaattctactgcttcagcatcccgagtagctgggactatagacacatgccaccatgcctgactaattttttaaaaatttttagtggagatgggatctcactatgttgctcaggctggtcttgaactcctgggttcaagcaattctgctgcctcagcctcccaaagtgctgggattacagagatcagccactacgccgggccaagttaacaatgtcttctcttgtaatcaactcataacattttgattaaactaacatgattacccttaaccacagaaatgcaaacattcagattcacaactttcttgattgttctctgtcaaagacattagttaatattggttaaaagaacaatacatttagatttgcacagttgctgttattggaaacatattatggttataaaatattgcaagaatatgtgacaacacttaggttagacaacatgaagaacagtggtattatcagggtgaaaatatatatattctcagccattcttgtggaattaagataaacaaccatttgactttgttgagtctcattcagtcttaaaatggagggactttttagaaggtctgtggagaacctattgactggctagcctgggagacatgctcagtcctcttttcccagctacttcatgcaatggaggctggaaagcaacatgctaactttcccagcatcctttgcagctaggattggctgtatgattcatttctcatcaatgttgcataagatgtagtctatgggggaactctagtgatgtttttagccttccttatacttttgtcttaaaggtaaatgactagagtgctgggagtcaatttgcaaccagaggccacaagcatgaggacaaaaagctagcatggtaatcacggccaagtaaatagatacaatgagccaatattggctcctctatttggcttaacatagctttgtctcaattcttagccttaatgcaggctacttttcaaaagtagggttctaccacaaaacaacctttttgcccctggcaatgattcttgtgcagtttactgaagtaggcttgatcctgtcctttcttctccaacccaaatttgctcaaaccagtattgagtgccccaaacttatagatcccaagagttcttcttaactatggataaaactttgcctgagttcttgttacaatacaaatatgtggccgaaaaaggtacctgtatataaagggcttttgatgacattgttgatctgctacacatctctttcatgtttgccttcctccagtcttttaattctataagatgattttattaataattaatatgaatacaacatatattatatattgtatatattatatattataaattgtatatattataacatatataataatatagtatatatataatatatggtatatatactatatataatattataacataataactttattatttatgtaatggattgtcaggcttttttgttgtcatttacttgtggccagcagtagcttattcatatggttctccaccactttgaagagatacatctgcaatgatctgaacaccaagtcaattatctatcaaaaacatggttcaaatgtacttccattggagtaatctaatgcagcaccatccaacagaacactgatgagggaaacattcataaagaacacatatgtttgtgtgatgaaggaatatatgtgatctatttacgatatagaacatacagtcatgtacaacaaaatgaagtgttggccaatgacgaactgcatacacaatggtgatcccttaagattataatgaagctgaaaaattcctattgcctagtgacgtcgtagttaaaccattgtaatgtcatagtgtaacccactactcatgtgttgtggtgatgctggtgtataaaaagctatgtgcttccagtcagagaaaaatctagcacatataatgatgtatagtacagaatatttgataatgataataagtgactattactagtttatgtatgtactactatactatactttttactgttattttagactgtaccccttccatttaataaaaaaagttaacagcctcagggaaattcttcaggaggtatccagaagaagacactgttatcacaggaaatgacagtcctaggtgtgttattgcttctgaagatcttccagtgggagaagatgtggaagtggaagacagtgatattgatgattctgaccctgcggaggcctagctaatatgtgtgtttgtgtcttcgtttttaacaaaaaatttaaaatgggaaaaaaaatttttaatagaaaaatcttacagaataaggatataaaaattatatttttgtgcagctctacaatgtgtttgttttaagctaagtattatcacaaagtcaaaacgttaaaaattaattgaaaagtttataaagtaaaaaagtgacagtaagctgaagttaatttattattgaagaaattttttccaataaatttagtgtagcctaagtgtacagtgtttatgaattctacagtagtgtaaggtgatgtcctgggccctccattcactcaccactcactaactaacccacccagagcaacctccagttctataagtgccctatacaggtatattgttgtttatctttgatgctaattgttttttttttttgagacagagtctcgctctgtcacccaggctagagtgcattggcatgatctcggctcactgcaatctctgcctcccgggttcacaccgttctcctgcctcagcctcctgagtagctgggactacaggcacccacaaccacgcccggctaatttttttttttttttttttttttttgtatttttagtagagacagggtttcaccgtgttagccagaatggtctcaatctcctgacctcgtgatccacctgccttggcctcccaaagtgctgggattacaggtgtgagccactgcaccaggccgatactcgtattttttttaaccttaccttttctatgtttagctctgggtagatagacaaatacttaccattgtgttttaattgcctgcaatattcagtacagtaacatgctgtacaggctcgtagcctaggaccaacaggctatatcatatagcctaggtatgtagtaggctataccatctaggtttgtgtaagtacactctttgatacttgcacaaccttgaaattgccgaatgacacatttctcaggacatattcctgtcaccaagcaacccatgactgtacagaagacagggccactgaaaattcaaaatgtggctactgttattgaggaagtaaatttttaattttatcttgcttcattaatttaaattgaaacagccaacatgtggctggtggttatggcatcaagcagcacagatacaaagaattgctacctactaaaaaatatttgaagagattcctgtagttctcttaggaaaaattcagcttgtaactttatatatattatttcacaggcccaagaacacctcgttatagaaaaatgatgactcagcagggctttgcacaatgtcatgtttgaaggctgttaaacaatatttaactcgaatattagctaactaggcagaactgataccaatttaagcattttacattgacaactataataaaggatgtccttttggaataataatcttattcagactacactctttcagctgtttgttaagacttttgtgttcccaattacgaatgaaaagaataataatggcatgccagtctcattaagccacgggggtaaaacaactctctcagacaaactataaattatcatttgcacaagaccgctgagtatgctagaaaatcagccacaaagtgtgccaacatggcgccgaatagtgggagactgagagtaggcagctaaagatgctcccagtgaaaggagaggagaaatggatactgattatactggacactggggatctgtggggccgtcatatactggagcatggtattcagtactgtctcctacacccaaatgtgacttgcggaagtgattccatgatgcctcagtgtcttgtgtcgagctaaatagtcagcacactcacattcatggctatatttagagcctgaggaacaaccacttcttcaagtgtccagggtggcctggaggagctaaaggtgccacttcttctatctcttgacaaggaatgcagtcacaggcaagttctccatcactggttacctccaagctgctgtaaagaggtcagcaaagttcctgcgtgctgggaacttgagttccttcaaggttatgtacaattttaagacgtggctgacaagctgaacttatttcagagacaggactatctatattctgagttttaacagaaatgatgtaaaaagagagttgagagttttggcaaaccgtattttcttattctatatttgctactacgtgtaaaacattcaatttataaaatatttcatttaagaaagccaccacctacacttctaaccactaggtgttcttgagataattatagaaactggattactcagtatcactttcatttcatattgacaaatacttctcatcagtttgctttgcattcttttggaaatacctgttttcctcataggtgctgctttgacccacttattttatggtaacgtccaatgtctaaggagataatggcaaccatgtgtgaatagttaacactcagtcttgatagagggacatggtctctaggaatgtaccatatctggaagaaggatacatttagaataagtctccataaaagacatatgaatatgtgaatttttacctatgatgtggctctgaaatacagaatctgcaactgcatcgtcttcatcctcttgcaagttttcatttgcctcttttacctgcaggaagaagaaaatgatgcaagttcttatttgttttattaaaaagatccttttgcaatcctcagagtaatggtacattctataacaaatatgtgggcataggtgtgagtgtttgcatgtatatacatgtgtgagtatgtatgtatacatataaaatacatttttttcgttctacttttccgcactccatcatttggctttattacaagttttaattataagagcttattttcagacatataacctcatttctgaaggagagaatttacagggtatctaattctacacaaaattttagagataacagcttagcttgttaataattaatgaaatcagtaacacagggctgttaggaaacgttaaagtctaacgaggtataattcctccagagtcagtgacttccactgcaagttattttaataggaataaaaatatatactttaaatatacttaggtctgctggctctttcctggaatgtaacttaagaagataattttttttcattctttccataatcaaaggagatgacaatgatgtatgtatgatcagtgaaccagagcagtgagtcatttatctagatatttttttttgagccaaaaacattccctcttatatttcagttggaaggcccaggcactagattgggcagcatcagatggaactctacacagaatttaatgaagttccagtattttacagatgagaattctgaggtctaggaagtctccttaaagttggcacaaatgcagtaagtggcaacactggcatgaaagcccaggccccctacttcccaatccagtagcaggagaagtaatagcatcatcagcaataccaaccacaatagaaacagtgaacacttacatactgggcaggtgctgtttgcacgtaagatctcaaaatccttacaacagtgctatgaagcaggtgctatggttagctttattttagagatgaagacccatcccaaagcaatagagaaggtaattgtcaaaatggtggcactgggatttaaacgcaacaaatctgactccggatttgtgtttactggggggacctttggtattctcaaattttccacttgaatatgcctgtgtagacttggactcagtatcaagacaacttagggttctagaggtaatggcgctacatagctcttttaaaatacattccagacagccacctaggcagccaatgataataacgtgcaatgcaatgggtgtcccgcttaggcacgtacgttagaggttgccagtggatttgctacagggcttgagttgaatgccaagaaattattattttatactgtcaatgtgaaagtcatatggctgaatactgaccttgagctggatttagctttctactttttgcctcctatttttcatacttaatggaataagaccaattatttacattttatgactgcagtttcaatattagaatgtaattggtgcttaatctgtaccatgctgatagccagagatggcaaactcaagagagtatgtaaatggctaactcaacactggcaaggacagatcgttaagcgttcagtatcaagaggccatgcttcatcactttctttccccttcagctgtctaatctgtgggcatttccctgtttgttagcagctccacagaaagaaagtcagagaatgaaagaaagcaggaaaaaagggtttcattaactgaccgtgttctagcagcacatatttacagatggcagggaggaaacacactgtgagtatgagaaagaccaaagtactacttatttgccttccaaggttctctttgctcagggatctgtttgtaacaaggtgacccaaaggcccccaaacacctcagtttccattaataatccactgggagccttttatcctcttttatagaacaacaaggaaatcatattttcagtttcatatcagctcttatggcaatatgtcccatatttcttgcacctgttaatgtaaaatagtatttcctttgggtttttccaaatttatacattttaaactcgcaggggtgccctcgaaacctgttggactgtcagtaaatcatcatctctgctggcctgtgaaattctagatgaaagaatcaaataattagaacaaagttttcatcttacagataaagaaaaaggagcttcagagagggttaataatttattcaaagtcatacagaatttcagttatagaacaggcactcctgattcctattcattgctataattcaatttttcagagtgccctgtcctgttacagctatcctttccagaccttccaaagaactactctttcttagtgtctaccatttagatatgaaggcaatattccaagtatccataaactatattttaagagtagtaaacatttttcatgcatgtgtgtgtgtataattctctgcttcccttccctactgttccttacctgttccgtgccccttctccacctcctttctctaattatcatatttaagaaagaaaacaaaagcgactgcacagtcctacctgtcagctccttgccagaggcattccagggccttatgtgcttaaccgcaaacactaaatgtggcctctggggacttatgagaagaactgagatggtgaacaagccccctggctctttcagctctcctgggctggatgacccatgaggggcagatgactcactgggggaaattgtgaacttgatgggaatggatgaagaagcagcaagaaaatggaaagtgggagagtgctttagagtgccatacttgtcaattctaattatccatacaaatagatttcaatgcaaagtggtgagtaattaaaaaaaatccatttgcctatggaaatgaggggcataatttattttggcagcagattccccttgctaattatatttttcataggatgaaatttaaattaattttcattcttgatcccataggagctggatgttggtgggaagttgtgggagttttcccgggagtaagagggctgccaggtcaagcatttgccaaaaataggcacaagtgggacagtctccatgtgggaaagcactgcaaagaatgggagagtgaacacaaaaccaagaagtctgccaaacgtttggttcagaaaagatgtagaaatgtagaaatgtcccagtcactgttgccatcccaggaacagaaacaagtccatgtcagttatgtcctatttggtaaaaagtagaaggtgactcacaagcaacaaccatgggccatttttggtttaagttacttgtcagtgctttgggtgtcttctaatgatttatctctaactcttgtccatcttttggggctctgcagttctagttaggaactactccaaacaccagtctgcaacaggcaacaattaaatatcactgcacttctattttattcacccctgtttctaggaagggcaggaagaaatgtgcctacaagagacacagggggaaaaggggagaaaataattcaccattgacataattgatataatttcataattaaacccaattttatatcaattcaccattgatataatttcataattaaacccaaatttgagaacatccttcatttggagttctatatatatttcttccctgaatcatcctaacactaacggcttcccaagaaaccaacattttgatgtcaaagctcatttgaaaaggaaaagaacataagtgagacaggaaataatcctgggagagaaagttcctggaaagcataacctttggaaaagttactaatttagaaaactttgcaggcggagggcaaaatatgcatgtttcttattagcaccaaaataccatttagaatagaatttttcaattaaggatgttaaaattgtaacatttcgcagaacttaataagatgataacaatttgtgtaattattgtactattttctgccattttatcaccgtggtaccattttaatgggatagtatttgatgcttttttattagcagacatgattttttttttagactatgtgacactgggtaaagagaatacccataatttaaattaaaatacccatactaaaatggtcatattaaaatggttcacgatgaaggtatatgatctcattaattttgttaatgatttttatttttgtccagtgatagttaaataggagcctagagctgtctttctttgagacttttcatttcagaaaattatctaaatctacaggaaagaagaacttgaaacatgtagcaagtatagtgtacctctttctgacttactgacttaataccaaagcagtctttctaggagatgccttttccctattttataatgattttatataatttaaataaaagtaccaagtaacatggcccttgtctaaattacacaaaaattagagctaagtggtctataaacaatggcagaaatggggatataagcttctaattaaggctctgaaataagaaaaaatttaattcagacaaacattaataggactttgaaacatattttagaatgtttctagcaatactaaaaatgaatatgcagttactagtgaactaagcggaggtttgctacacatgtggatttgttatatgtatggaaataatctattattattatatattagaatactaaaaatgccttaggactctcataactatatataatcttagtttgtaaagaacaaaagatggtggtatagtacgtcataaggtttcaaacagtggttttatttagaaaaagagtgtgatacgtagtgcattgcatatatacattgttttcatccaaaataacttctatgaaaacaattctttgcaacacagtttaaaataagcagacagtgaatttaccttgagccctagtggggggaaattctcttcaactctgaattttaaaaggttcatgggtattcacatcaatgtgctgtggtgttaaaatacatctcattttgcatctaatctccttcctatataggctgataacatataataaatgagttttccctcctattcttgtaccagtcacaaaggagtctatagcaacgtcctttgtgaaattagtaattttagcccaatccatgctgatgattatggagatgaaacaaaaagcactgcattttacatttaaaaaaatgactagctggtcaactacccaggttaataacatttctctgtatggaaaagcttctcagcatgactaatttgtctttcagctaactggaaaaatcatcatatggattatgtatatgtggggtcgttagggaatctttgtacttcacagaaaataattagagtgtttcttgcagatattctggaaagaccaaaggaccctgtgaaagactgcagatgagagaggaaaagcatggcaaataaccttagcattaggaagtaataagaaaataaaaatgaaattgtgaaagccaaacataaagtctttttgtttttttggtacttctgtacagtgaagatataccctaggctgtcaggaccatattaaatgggtcatagttaaattgagtgcctctgataaggggctctgccaggctatcaaagttttccatcagctggattgaatttccagcatattgcacattttcacacattcattctctcttcctcctttcagtgacaccacaagggcagccttagatatgcttacaatttgtggttttataatgcaggggacatctgtgttttcaaagaagggatgataccatggaagccaagagcagaaatgggatgagggaaagaaaaaaaaaaaaaaaacttttgcaacgaacataatctgcatataattttggagagtttgtaaaaaagaccttatggctctgtagagtcaagagctatttgaataaaaaaatttaaacatccatttctctcaaattaaagtctgtgaaacttgaaggaaatctaaacatcaataagtatttatagctaataattaataactaataatgtcaaccatggtcactttaaaatctcctctactcttgaatgaccccagaaaataatgcagggaaatatttcaagttttccctcagaaaattgtagtatgtcctatattttaataatctctttattagagtacaaaaagatatggatatagtaattccataaagagaatattttgtgtttaagtgctctggaacttgccaaaagcaacaatgaatactattaaattatttacacaagtacatgaagaatgtacagagagtaagtgcaatttaaggtaattttaaaacaaaaatattaactgaaactagtacaccccaggaaaatataaaaaatactctttcatttattttttatttatttttttgagaaggagtttcgctctgtcgcccaggctggagtgcagtggcacaatctcggctcgctgcaagctctgcctcctgggttcatgccattctcctgcctcagcctcccaagtcgctgggactgcaggcgcccaccaccatgcctggctaattttttgtattttaatagagacggggtttcaccgtgttagccaggatggtctcgatctcctgaccttgtgatccgcccgcctcagcctcccaaagtgctgggattacaggcgtgagccaccgcacccggccttattttttaatttttaaaaagaaggctactccctgagttctggacctcacaatagactaaatgatagggagccaagttccaaaaaagatttcttagtcttaatagcctctgtctaagttgcatgaattggacatacaactttcataaaacatgaacaatgcttaaatcaaatcatcaaaataggcaatactctcttaaattgtttagcacttttatttttaaaatcatgttcattcctttttggtggcaggtgatgttagaaataatcatcaaaacaaatttccagcccagtggtgtaatttgaagatgataccagtagcatcatttgcctggactcactgcgattatactcaacgttctgaaaacagctgggaaaagcagcatttcctgagagccaggcccactcgaggtccagctgccagctctctgctgcagttgtcaccaggatttcgctctctttttacaaatcctttttcactgaccttttctttcccccagttgcaatctcttacccatacattttcattagcaaacggtagaaagaccccagccagaacatctcagattgtagcacttgataccaggatggtggagcacttaccagggagtcttttggtacttccatatcggctttgattttcatgtttttcttgtggtttccttgagtactgatagagctgccgatgagacaggagccctgagaactgccctttaacacattcctgcaggaagcattacttgatccactttctgtctgtggagctgctttcttatcaactctgcaggtagaaagtgattcctctgataagttaccttgctccttcttcaatcactctccttttcccaatctttttaatatttaaagtaacctctttgtagctctttgtctttaaacctttgacggataagggtttctcatgggccttgatcaaatcttcaaatattctagtagcatgtcaatttagatttgacaatatcataatgtattttttatttttgtgatttcttgtggagaggggcaaaataaaaaccactgaagagtgattattaactacatttttagcttaagagcagcaagaaatataattatttctggaaagtttccaagtatatgtttgctaggtataatcaacgaaatcggcatgctttaaaacgtatgtgtaattttcttccatttcacgccatctgggtacattcatagctcctagtgtaggtggaattgctatcaaccctgataaaacttaccattctttaatttcaaaggccattggtttggttaacaaagtaacatggactaaatgatcattttattgctaacttttatttcattgcttaaattctggctaatgtataaaagactgctactattcatttctgcctgtatgaaaaaacatgcttgactggcctttaatgcacaggaagcaaacaactcttttaaaggtggtggagggacccctctacattgctacctgcttttccagtgagttacctgttcaagagttccgtcatgaaggtgtctttcgttgaacatgcaacagggctgtgtctattccttggttcaatcttcagttggttgtaaatgtcttgtggtgttctccgattatttttgctttgtaaaccgccatctggattatctgctgacttggtgtccttgataagctcattttctgtctcacactgtagttcaggcttctttttctctttttttctttctgattttagttgtctgtttccaaaccccaagacttttgcatctttcttttctactttggttttggagatgtccattttcctgctactcagagctggaagtctactcttccgaaaaccaaaccagctggcaaaagaaggcccaggcttctgctttgcttccacagaggtgggctttgtttgcacttggcccttttccacattttcctgaatgcacaacatgaccttttcttcgattgtgggtgagaggggggcttctgaactcacagcatcagtcgcggttgcagaggcatctggatgccttccagaagtttctagcttggatgtactgcttgtttcaaaagtgcttggatgctgagtcctccctgggctctgcagggcttcagggcagtctgttggggtgggtgggcaactgcggcggtcactgcctggttccccaagtacagccacattggcactggggcactctccctgggtgaaggcctgctggtcttcctttccaggtgggatgaggagtccctcagactttggagggatcctcaaaggcaacttacttgggctcccatgctgactgctgaagctgcctgagctccccagggagcccttcccggaggaggggtgccccgagggcctcccaacactggggagactctccaacatgggagcagaaggggccttgttgggagagctttccgtggaagagttctgccgggtaagagaattgcctctctcggcggtattggtaatgatctgagtgcggactttgcctgacccttcgatggggggcgtagaaggcttgtctcctgagtgtgtactgaagctgtggctgcgggctttggcgccattcatacccagagctggttttaggtgtggtttgctggaggaaagggatcttctcatggatctattatctaccccatcccttccatcactcccagggatgctactttccaatggctcttgtagtgctgtttccaggggaagcccatcagctaaactgccctgtgcttgtgaatccggtagggtcacatttctttcacccgctgtgatctccatgcttgctggattcttggagtcctctggcttagacttgttcacagccacggaacttttggaggcttcatttaaactgtctttttcatgtttccctggcacggtggaacttttcctgagcagctggggagacttcatgagcactttgagtcccactggaaggcgagttttcagtcctttctcatgagcactttgacaaccatgagggctgttatggcttttggcgggtgatgaggatgatgaggaactgctgacctgagatgatggtgactcatttacccctaagaaggaaggcttggggggtgtggaggcgctatcattcaattgtccttttctccctggagatacacttttggaggacgtcatttccagtggctcatgggttgaaggagagatcctgggagtctgtaatcctatgtccctttgtggggtcccaagtgtttggcgaggagaggttttggggacacctctcttcggagagacctttggaggccccagagccattacggtgaaggagctggagggggcatgagcagggcatcgggtttgaatgactgcttctggggagggcatagggtgagtgaagataggctttttgaaggccacagaaggtttcttcctctgcacttctgtcgtggccggattagaagaaataactggagcagaaattcctttcagcagcggggatttgaatggggtccttgctgtttcactggggaccctggtttcggacttggtggatgaaggtgctggtgaatagtcatagctgggcctggccagcagggagacggacctgcctggagggggcggaggggaaggggatttcacccctgcctccggcccagagccacagtgttcatccctcgtggggggctctccactgtcactagactcaatggcaggccttgaccgtgaccctggagtctgactcttggggcactggacccagtccctcctgctgggcatcctggagctgtgcggaagttgggcggaatgttttggaatgtgtggatctgatcgtaattcaaagaggggccctgagctctcagtcttcatgaatcgtgagagtttcccaggagctaaggctggtgatttttcaagagtcaccaggccagatgaagggagtagtgtggtggcttcgggctccattagttttgatttctgaggtgaagacttgcccctgggaggtatttttgtcagattttgcttttgatagatgcccatgggtgccgaagacctggaattactctggcatgatatattgtgtgttggtttgaccagcttttgctgctgaggattttgtgtcactgtcctggagctgaaagattcagtggacaccctgggaacattatctacattatcttttggaatgtttttctcagtgtcctcttcagaccttttaaagaaagtatagtctcttgcagcagctcttggctgtaaacaagcaattccctgaggtaaaagctcagtatgttctgccttgggtccagcaggagttgaattgatggaaatctcatttctggtaacagtgacaaccccagtctggtgagagctgaattcaatgggctcaccgtcttccgcatcaaatatcacagtcacacattcttctgaagaagtcctttttacaactctttgctgcttaatgaaactaaaagtctttggcctagtctctgaagggatgggcacttgtttttcctcctcttcaggagacccacatagagattttccaaaccccacaaggacatccaggttctccacggacttatcggtgtcggcagccaatgacacgtctgaaggacttttctcatcactgctctctatgtgcagctcatcaaacgtttcattgtcatcagtgtctgaaagctggaggttgagagccatgcggccatggccttggccctgtgggcccctctccctctgtacctgaggcgtctgcacacttgggcacagcttcatctctaagggacagctgctggcgcaacttgtcagcttttcaggcctttccttgggataaactgaggatgtgccttccagaaagtgttttctgtttgtctcccagccaaacagactgtcggaaacactgtgggttaatttactgccatgtggcctgcagctctggtttggaactgcttggagcaatgctaaggtggaagggtcatcgtccgcatcaacgtgggaatctagatcataaacaaatgtcttgtggggttccttgcaggggctccccaggtcagctgttttgcaggggggatactccttgaggctgctacttttaattccaggagaatatattccttcattcgagttcatgcaatctttataaccccatttggttatcactgatgggggttcaagtaacacttttcgcttctgtagctttcttagcccttccaaaatgtggctttccttgatacgagttggaggtagttcatttgtaggactagcaaagccacttgggagcgaagaatcaatacttagccttttatcccagttttgtgatgattgctaggaaagaaaagtagacatcagaaatgattgaaccatgtagatcacaaagatataaaaggaaaagtacatcatgggacttaatttgtgctagtggttggtaactattcacatataaatgcctacattaattagctaattaatttattcacaaactatgcagcaaacattgattttgccaggtcctgtgctaagaagcacagcgatctaaagaaacagaaggtaaaggccctgtcttcatgggaggaatcccagtggggagaggagaattggccacaactaactgtatgtcaagggagaaaatgggaagtgcaaatgttgtaagtactctggagattcagaggagggaggccacagacaggtctatttggagaaaggcatataggaaaggtatatatatttttttcttttaaacttacctagctcttgaaagacacataggtttgccgtaggttaaaagtgggggaaatgttttccaggtgggagaaatggggtgggcaaagacctaagtcagaaagtacattcaaggtacattgagggaatgactagaagatgatatggccttattgcagagtgtctacgagaggtgcagagggtaaagctggaaaagtaagttggttgatatctttatgctcacatttgatagttctgtgacttcataactttatttggtagacaatagatatctatgaaaattttcttaagttactacactcatacatatacacatacacacatacacagcagctgggcattcgctgttagaacctgacagtaattattcacctaccaaatttagaaaggtcaatttcctgcccatcacccttcccaaatgccagcctcagctttggaaaagtgtatgggaaatgacatagagaaaaggctgtgctctacatattcatatttttttcatagtattgctaataagaaatggaagggggaaaaaaaaaagctaacatttactgagcctctgctgtacaccagccatttacagggtgctttcactccatcttcagaacagacaactgagactcattgttgggtctgttggagatcacatagaaagagctggagcaaaggtatgacctctggtttctcaggctctttctatagtacgtcggttttgactcagttcaaaagtggcagtgaggggacatgaacccaggcagtctggccccagagcttgcagtcctaactgatgctatatataaagccaagcttagcccctcttctcccctttaccttagtcagtgtcataatagagatcacaggttaccccacactatttcttaaatggtacttgcagagtttagggggctgacctaatgatttcttaagaaggctatatgggccaggcgcagtggctcacacctgtaatcccaggactttgggagaccaaggcaggtggatcaaaaggtcaggagttcgagactagtctgacccatatggtaaaacgccatctctactaaaaatacaagaattagctgtgcatgttggcgggtgcctgtaatcccagctactcaggaggctaaggcaggagaatcgcttgaacctgggaggcggacattgcagtgagctgagattgcaccattgcactccctcccaggtgacagagcgagactccgtttcaaaaaaaaaaaaaaaaaagggctatatgattaatggtaaagagcttcaagagaaggctctgggtttcagaaatgcactctataccagttttggctacatcagtctcctccctgccccacacgcttatgtgcagtggttgaaaaacatgtcagaaacttccatttgaatctgggcttcttagtacactgtaaacatttgctcacatctatggcattttcatgaaaattactcttgctatcaacaacgcacacatttatttgtttttaaatcaaattataaattttctttaggaaattctccaccgtcagaagttgctggcagtagatgctattcagtgatgctgccccacttcctcttccctgtaccattacaaactcctttagaaatcagaagaaatcccattagtgaatctgggtattatagctccaccagaaaggagctgccacagtgtaagtttctaagaatttccatgatcctgatagtcatgttgacaataaataagagaaaccaagccaaagtaccccacaagagcttgaaaaatgtggatctgtttgacccccaagaagacatgctcaacctctgtcttgcctcctttctgccattctggagcctgccaggtgctgcactgcgacttgccccagagccagtggctgcaaacctcccagggcccaggctctctgcctggtgagattagccacattcctccttcagtcctctataggaggttatagtatctaacaactggagaaaagtctaggccaatcttgaagcttgggggtaggagacacacgaatgccccgtgggagtgatggtggggaggagctggcatttctcacaggcagatccatcctttgctgcgaaagttggaagagagttgctcttgggaagcagtgtggttgactaaaagatgctgttgctgaggtgcaggcctgtgtttaatgtccacagtcctcttccatttcttgactggacaagaatcttatatatatatatttttctaaagggtcttaatgggagcaaactgatctcaataattgaagcaacctcaccacgtttcaggctgattcaacaaggccagtataaaagaacaattaagaatgtgggttctggagccttctggcgcctggctctgccatgtactgcctgtggcatcttggttcagttatttaacttcttagcacctcagtgtcctcttctgtgaaatggggagaataggagagcctacttaataggcgactgggagcattacatgatctaaggcttctgaagtccttaaaaggctgtgctgcatatggtaatttctcatcgactagagccacattcctctgtagggcaggctagtgcatttcatgcaggcttcctttctgtttgtacacaagtaaaacatacttgtgagctcaaaaagcacaatcaataatatattaattgttatataattaatattcaaattcaaattcatatgatacaagtttattatgtaagttaatactacatgagtacccagcacaaagtaagaaactgcagaaagtttcttaagtaatacacatttcaaatgtcttcatgaatctgggtctggcttgttaggtccctgagaaacaagacagttcactgtgagatatgacaggtgtactggtactccatgaccatgacagagccctattaaggatccagagaagagccacctgagtgtccatgaagtgccttaagaaccttctttctcctcattcaggggagagattgccttagaacatcaaaagctactgtaattggaagaattccagccaaaaattaaaagaaagtgaaaagcctttgagaaggagagagacaaagaggtgtgaaagtgaaaagagcagagcgaggggctctgggagccagggatattcacaaagcgaggaaacatccctgaccatctgtccagtctgttccaaaccaggctcagagcagtcattattcagagcacctaacaactccttagagggagcaattttgataatgcagcaggctctgtactttgcattggaagtctgagtcccagggaataagccctaaatgcaaccttgagatcttctgagttcttgttcagaggatgacaaagctactccctcatcaatatctcctgggagttctggatttttcttggtttctacactgctaaaaccatgaactaaatttatacaaatggtagaaaaatgacctccaaatactctgatccggggtttctattcttgtgtgctctttccttttctccaacattagggaatggataaaacagctatttcaaatatttcccttacatcagtgtacaaagacgtctgctcaaagcacaaaggtatctccagctttgcgagtccactgtgcagatgggagtcattctagtagtagtaattattaaaaatcctggtaaaggaaatcttggcatgtatataagtagaaatatgcctacctacactgaagttgtggtctctgtcatctcaccacgctgccctccaatttatagtcaaatagtgttttatgaggctatagcattgatgaaaggatgtcagtataatacatgagcaggtgctcagcaaatggtggcttccttcttacccctcccacctgcccttcatctccatgaccaaatcctaccagaagaggattcttttctggttcattccgatgccacagtgccttacccttttcctgaggttcttcccatcgtgccacgtgtaggaggagccactggagtactcgctgcaggtgcttgaaagagacagttcactgctgctactgtagctgtttcgaggacagagatgaccagggatgacagcccccaagccagggcatttcaaggccgattttgtatttagttggtgttcctgaaaaagcaggacagctctgagcaagggctttgctcagaggagagtaaatatcaacacaaccttatggtgaggtagatgggaatacagatgctcctcaacttatggcaggagtacatcctgataaacccatggtaactggaaaatcagctgaaaatgtactcagtacacctaacgcacagaacatcacagctcagcccagcctacacttacattagcctacggttgggcaaagtcatctaacacaaagcctattttataataaactgttgaatatctcatgtaatttattgaatactgtgctgaaaatgaacatcagaatggttgtatgggtgctcacagtacagtatctactgaatgtgtattttggctccatcacaaagttaaaaaatcctgtcgaactaccctaagctgcagattgtctgtatggtatggtatgataattacgggcagactttggagtcaaatttgggctcagatcctggctctgcctcttcctgtgtggctatggggaaactatttactctctttcttcaaaggaaatcatgatactattgcttatcttatagggttattgcaagcactaaacgagggtctagttgtgaagcacatcacagcatctggcctctagtaggtgctcaattattataagctgccatcattattaggcaaaagtaccacaagggtggtcttattttatctagccatactggtgagaatatcaaatcagtatcaaaacatgactcgaatgctacaaaaggacgaagatagagtcacatctttgactacaggcttcaaaagcatgtaaactggctgtgagtctagtggtctggatcccgggctacccactgccactaagcatgcactcttgagcaaggaagacttctaacttctgtggtctttaatgtcctctttatagagggtgccgctgtctgagatttctgctacactttcctctggttctgatggcatcatactaagtccacaaccagatgcccattgcctatctgtgctacctcacaggaagccaagcacagcagacacgaaactcaggtataatgagcctccactgtaaatataatagtgcttttcatatccagtccttgttaccatttggctatccacatggtaataaccctcacatcaggtaggtctgggtttttagtggaaggttcaagctgttagaattctagtggttcttcataaggcaagggtgacaaataaagctgtaaacctccaaacacatcttgacagccacattataggcccctcgtgtaacagatgaagctctacaaactggacaggctaaattaatttacatcccaaccactgagaacagaatctctctattgccgtctaattccagtctcctttttatataaagctttgtctcagaaactctttgatggtaagccatctgtctttgtgtcacttgcagagtggcaaagccttttacttatacaatttattgacactttgtgggtgcctttcagtacctgagtacttatcaccattctccaaatgcaattccaactgacggtgactaaacaccagcttgggaaaggaaggtaatgatgatcctacagtacttgtggtaaatattaaactcctacatcagtacacagggcatgtttaatttactctctaatcaatacctataatgctcaattcccagttctcttttaatgaataagcagccctgcccactcatgtccatgtgtatacctcctgtatagatgttggggtaagatgacaggaaagtaggactcagaagatgggctggagtgagaaggaattgctgcttctcccttggccttgaacttgagatgctctgttttgttttgttttgttttgttttgtttttcagatggagtttcactcttgttgcccaggctggagtgcaatggcatgatctcagctcttaataacattagattttcagtattaggcatctgccttactatcaatacttcatttttgctgcatagcaatctctttaagtgatctaaaaatgccaagaaattttactatcctatttcttccccctgaaatttggctctacatattattgaaaggagaaacttgtcttaaaatcaggctttcagcaatatctactgatttatgaacttgtttattgccggacgtaacttagttaaggggagttcatatttgtatctccacagatgcctacaacaaatggttgtgtcgcagagcagcaactgccatttcagcctcagccactgttggcacctggaatgtgcactgaacaaactttcagaaatatctcatcaggcttcacttctactgtgtgctttctgttttctcctgtctgtcctctcatattttgttgtttaaatacgcagtgtggtggttgttatttaggactgcctctgctctgacagatgtgtctactctacagagagagagagagactgtgtctattgtcccaccaggctgtccagatccaaactccaatgacctttctgcactctgcctggctattggttacagtttacattctaccttctcccaaggtattgagggaggcttgcatgcaattctctgtccttcccgcctgttcttcctactacttctattaaaattatacctatttttacaactcaattcccaggtctcttttaatgaataagcagccctgcccactcatgtccatgtgtttacctcctgtatagatgttgggttaagatgacaggaaagtaggactcagaagatgggctggagtgagaaggaattgctgcttctcccttggccttgaacttgagatgctctgttttgttttgttttgttttgtttttcagacggagtttcactcttgttgcccaggctggagtgcaatggcatgatctcagctcactgcaacctctgccttgcctcccaggttcaagtgattctcctgcctcagccttccaagtagctggcattacaggcatgtgccaccacacctggctaattttgtatttttagtagagatggggtttctccatgttggtcaggctggtctcaaaccctcaactgaggcaggtgatccaccttagtttcccaaagtgctgggattacaggtgtgagccaccgtgcccagccgagatgccctgatgtgatggcagatacttgagggaggtggagaaggcctgtgaatgtcatgtgggagcaggcaggggcaaagatggttaagcagagaggtgtcctctaagacaggcttttcacactttaacgtgaactgaatcaccaagggatcttgttaaaatgcagattctgattcggtaattctgaggtaggacctgagatgtatgtagtatttttaacaagttcccaggtgcttcaatgctgctattctgtgacccatgctttgcgcagcaagcctctaggagaagctattaaagaagtcagtctcttatgtgagttccctagcagcacgttgtggtacctcactgtctgacatgggctgtgctaagccaggcaaagggaatggctgagcctgcctgccagcaggcacgtaagttaaggagagtgtctgtgtaggtgtacgtgtagcggtagttacagagtaattccttgcaaagaagaggaggcggccactcttttctactgggaaattctcccacttcccccaccttggaaaatcaatgtttgaatttaataagggatgcggaatccctgacatcctggctgcaaagtgagctttttttcccctacagtttccttcgtcagcatgtgattatcacataggattatctactgcagtaaataactgttctgtggttgagcacttgaactccaaggccatttatgaggtttaaactctggctttcacttgctagctctgtgagcttgggaaaattactgaacccctctgtgactcagtttctttctttgtaaatggagatcatgaaagtagttactatgtgggatcattgtgaagactgaacagcccctgacaaacgctggtgcttagggacttttacctgggtgttgctactattattaaaaatgtttatacatatatatatatatatatatatatatatatatatatatatagagagagagagagagagagagagagagagagagagagagagagggtggcgggaagagagagagaaagagagagagacagagacagaggccaggcacagtggctcacacctgtaatcccagcactttgggaggccaaggtgggtggattgactgaggtcaggagtttgagaccagtcaggccaacatggtgaaaccccgtctctactaaaaaatacaaaaaatttagccaggcatggtggtgtgcacctgtaatcccagctacctgggaggctgaggcaggggaattgcttgaatcagggaggtggaggttgcagtgagccgagatcatgccactgtactccagcctgggcaacagagtgagacttcatctcaacaacaacaaatacacacacacacacacacacacacacacacacacatacacatgtgtcttggctcttcaactaagccatcagttagttcatggtctccctacgggaccctgttttacacttcctgatatcctataattccctgatgcctggtacctaagtagtaactacattaggcaatagccaaaagtggatggactttgttaccagggatcactgatgtgagcttctggcttctggagagacatattagtagagccctttctcagtgatcatttctacctttgctgtggtttgctgtgggtgcagcatggtaccacatattaagagaactgaagggggccaaaggaacagagatcttatgattgttccaatattgttagcaggcactgtgtatgcacatttcctgtgttatctcatttaatcctcaccacaactctctgaaatagaaaagaaatatcattatcctcattttctaaaagggaagactgaggcattgaggttttaataccttgcccaagttgccctatcaatataacattctgatgcccggcccaagtccaagccactatgccataatgccaagtcagccctgtgacaatgagcagagctcccagagatacacagaaccccatgaatcccagtgagttgtcattggtaataatgattattcttaaaattcttcatcaaaaatgtgtattagcttctattgcaacattatcttaattatgttgatttaacagggaaaaatacaacctgtcttctgcactatccaaagtatattttcctcattgtttattttagattactaccctgaatgattcatatactttaaacattcttactgtgagaaatgcagtataaaatctacaattttagttaaaaaatagagataatgaagctggcccagtgcagtggctcatgcctgtaatcccaacactttgggaggccgaggcaggcagatcacaaggtcaggagttcgagaccagcctgactaacatggtgaaaccccttttgtaataaaaatataaaaattagctgggtgtggcggcgggcgcctataatcccagctacttgggaggctgaggcaggagagtcatttgaacccaggaggtggaggttgcagtgagctgagatcgcgccattgcactccagccagggcaacaggatgagaccccgtatcagaaaaaaaaaaaaaaaaaacaaaaaaaacaaaagagaatgaagcccagagtttcattcttcccatttttaaataaaaactccatacttaaaaaaaaaaaactcctgactttacggctatattatagattggatgccattaggtctttatgaatgtttaaagtgacaatattccactgaaattcaattcaaatctaacttgagaatatttacatttaatggtctatctacactgatggaattattcagtaaaataaaaaaacagttatccacaaatgttcatgtcattgttttaagcctcacgtttttcattatatatttatttggcaattgtgttttttcaagttactctttttatgtcaacgagagttaaaaagccatgctggttaaagttttgccagataagcacaaagctaaccccagctagagaaaaaaaatgcagagcccatgaatttttaaaagttcatacataatatatcataaaagtaggatgaataatatgggacgtgggttttaataaaaagctccttgaccatttctcagagactctgagatgtaatcaatatccaaaaaaggtatcttggggacaaagccaagatttatgatatttttgccaagaatgacactttctgcttactatatcagctgggggacatgatattgaatttcagagaacacaagaaaggaaggtatttttatctgcctgacaatgcttcaaggatgcactttatggttcgcttgtgacatcatatttgatggaaggaaaataaccaccaaaacaagtgttctgaaggcaactgggaaactcacgtgcacctcagcatcagttcgtgactgtgtcagacttcggtttctttccacctctgaaagcaaatctccagatgaaagatccaagagacgtgagtgaagtttctaggtaaaaccaagcagaaacattgaatagcgataatttaattatttgtctcaaaatcctgccttggacagttaaatctcaaaagacttgacatttccagattagataatacatgtcctaattaaaaaaagtttattctagtttatcagtgttcccatacatgtatatgtacgtgtatgtgcaaattacattttgtaaacaatagtgatgcttttacagtctgtcagtctgccttggaagatatgtagtagaaaaatataagtagtagttaaaaaaataagcagtaggaaaagtatgaatactctgatatatttattgggtagtatgaaaattaacatttgatattcacattaagaaaaccaatcaccaagttcaccttactatgttgagcagtggttaaaatctgagcagataattataaaagtgaccttatttctaaacagcattgatcttgtgaaatcttcccttggacacgttttaactcaaagtcattaatgtcatctgttaggaacaattaatgtgaatagaaaataattgctttggggacctggggactctgaggattttgtacattaatattcacgtgctgttcaattatatactgaattctttatttcagttttgtttgggaggactgctaagccagagacatttcactgtattaatcttgatactaattactaaggcttttctgtggacattaaatttgatctgtttaattgcaaatacaataaaagtcgtgatttatgcttaatgtttctgctaggctgatgacattttgaaaatggcacttatagcctggtttgtcttggttacaacttttgtggctccagatgctaaaaaaaaatctaattgagtaagtaaataatgcagctaagcgtgcctctctcgcttccgaaaagttttttctactcctttttctccctggagaggccctgctgcacactgatgctgatctaagaaatgcctttgcttctttgccactgagcaatgttagaatcatcttagagggcagggctatcccactggtcactctgtcccagcatatctaccatgaagtcagcagggactacaaactccactaaaatgagtcacattctctgtgttccccattcaactctctttaggctgaacttctgtgagagccctgagtacttggttaggtgattattcaacaaacatttatacagcacctcctgaaggatggcactgtggcagggctgtattctatcctcctgcaagggtaaaggtatttttttgctgttgtgggttggccagttctccttctcagtggaccttcaaattgtgtgtctgtggaagtcctttcacaaaaaagaaaataatttctaaactgattgcctgttgctttgaaaatccaaatttctccagcagagctaagacctccataggtaaccagaaccaatgcattgtttctggacagtttttataatcctaattctataatcctaattcaagattcaagctctagaatctgactttcctgggggcaaagatacaatttatctcatcttgcaatctccggaacccgacaaaatacatcatacttagtaagcagcccattagtgcttgttgtagtctttaaacaaaaagatgtctttatattttactcacccatatgtaagttttaaagattgagagagtgccaaaagaattacaatgttgtgagacctaagaatacatttatcaatatgcaaacaggacaagaagttatgggaaatgacattcaacaaaagaaatgattttgagtggtatatcatctgatttgagagaagaggcctcaatggattagctatctaaatgactcagttcatgaatgcacttcattattatttctcagatatatgatgtcacactttcacctactgcatgaatatatgcatctaaaaacctgccctcctcaaggctgtttcagtggcttttatccaaatgggtcccttcccttcattgaaatagggaaggtctgcatgggagaaaggagaggtcctggggcaagggccaggagacctgagttctagccctgttgaaggtacacgttctacaggatctcaggaatgtaactgaacctcttagtctcaaatccctcatctgcaaaaagaaagatggaaaaacttaaaccagagctaccatttgacccatcagtccattactaggtgtgtacccaaaggaaaatccatcattctaccaaaaagatacaagcacacacatgttcattgccaggctatttacagtagcaaagacacggaatcaacctaggtgcaaataagtagtggaatggataaagaaatatggtacatatataccatagaatacagccataaaaaagaatgaaatcatgtcctttgcagcaacacgaatccagctagaggaggccataatcctatgtgaattaattcagaaatagaaaaccaaatactgcatgttctcacttataagtggaagctagatactgagcacacatggacataaacatgggaacaacagaccctgcagactactagatggggaaaaagaaaggggggaatgggttgaaaaactacttagtgggtactatgctcactacctcggtgatgggacctgcatccaaaacccagcatcatgcgatatacccacggaacaaaactgcagaagtaccccctgaatctaaaataaaaggtgaagttaaataaaattcctaacaaagtcacaacatccaatgacagaattataggcatcagtaagtgtaaattttcagaaaaaagaaagacagaagtggctatttaatctactaccacaggtatagagaggcactatcatattaagaagggaaaacaaacaggataatatgctgaaattcacataggccaatttattgttatacctgacagttggtggtaggtaacttcttagataataaggcacgaatgaatcattcattgttatagctttcatacatataaggcaaataaaaattgacttagaataaaataaaatctgtttagttttaaaaaaataatttaaacatttattattatttttcaaaatttttaattattatgggtacataatagttgtttatatttatgggggtgcatgtgatgttttgatacaggtatacaatgtataatgatccaatcagggtaactggattacctatcatctcaagcacaataaaatctacttttgtgttaaggctataggcaaggaaatgataggttaatatcacacaacttcccttaaataactgtgaaagcacacaaccccaaagaaactacatttcttatgacaagaatttttataataggctcatattttcatcatatacataatatacaggcatgtgtgtgtatagcatcactttttatactgatactatattacctgtgcttcagtgaaaaataggtagaatgtatacattagaaatttaagtcactgtcaaaaagagcataactgacttaagaaggccatgacctcttaagaggagccccccagcttagggggcaaattctctatcatatacccatgtatagttcatatttactgttagtgttcatctgaataaaatctcatctgaaatactttaaacttcctgtctttaacctgcaaatcccaatgaattctggagttagacatacttgttttattttagacatgaaaagtagcaggactactcagtataggtttgaaataggccttgtgtcatctgtcacactgtctcagtaactgagattcaactgggtttcagaaatagagactcctaatttcacacattttcaaaccagaggtaagtgagggatctttttactcatatgcttcctttgacggtgacagtctaaccctccctgtcaggctggcttcgctgtctctggaatgtgcccctctcctgtctgagttgatcttttgtccatttttccatggcacactttcctcctcctgcccctagatcctgttcagtattcaggatgacactgaaaccctccctgtaaagtcatctatcctctctaacccacagtggattccctgccttgaggaattggactgcctctcattttggtcctttatccaaagtgtactcttactgagttgttctctgtgtaggttctatcttcctaacaggacaatcaactccatgaaaatgcaggtcaatcccttaatttctacattgtcccagtggcagggactagctgggtgtcacgaaacctcgggaaccttggccctcttctttctgggggcacggctggcctgcatttcccagcctcctttacagtcaggtgtgcccacatgacacgtttagttctagtcatggagcctgagcaaaagtgacatctgccctttcttgcctggcccaggaatacctccctcatatagtcttccatgctctttatccttccactggcttcatgcagacaactcagcacagcaaccttggaagccacttgttgaagatgaagccaaccaggtataaggagtttggcttctttaattctcaattggaagaaagccactctgggaaaagaaacgacttttctggatttgacacaaggaagataccaacttatactgaatttgggccatgattcgtttggagtttgttattattgctgacattgacctggctgacacagttctcttggcagcctacagggtagccactcaagaaacatgcatgtttctatgtatatatgtcatatgtgtacataggtgcacacacatgttcatatatacgggtatttacacatgtatatgtagtggctatgtcaacagcgcaaggtgacaaccccactgaagattctagcttcataggaaagagacctgctttctgtcactatacacaagggcaggggttaggggattgtgtgaagagctaagatgtatcacaatttataacagaacgcatgcctcatacaggtgtaaaataccaagctaagctttggggacctggcaatgccagggtagtcagtgcctggactatacattgggtcggtaatatttggtgggttcacttgccttcattcagtcagttttatgttctctgtgcagttctgcatctgtaattcaaggcagagaaatgtccccctcaacagactgtgccagggactgactgtcctttatctggcaggatgaaggtggagtggacccttcagggtggtagtgactgactctgcagctctctagttaatgatggcagcagagactggagactgaggtgcatttgagcctttggctatttagtagagacggggtttcaccatgttggccaggctggtctcaaactgctgacttcaggttatccacctgccgtagactcccgaagtgctaggattacaggcatgagccactgcacccagcccctccaactattaaaagccaaatatcggcacaaaagagaagttttaaccgttcagcacctgatctgagagaagggatgccaacagctgccctggctgctccccgtcttggtgagtcctagtctgctctagcccactgtctctctgggttctgccacactctgtcaccttggctagctgcttatttggacctggccatgtttagggatcaccctccctcaaatctagtggactggatgttgggctgatttctcagaaaaagaacttactgctttttcagctttagttttgttttcaaatcatctccactttggagagctgttctcacctcacagcttctagaaagcttcctagagccccatttctgctccctcaactctgtcttaggcgggccctgggcccagggtttgattccctttgagcccaacacaagggaagcaaacctggagtgagttattatgaaatctcctgagtatcttttgatattgctcacttcctctgattgcctgtaagttcacctttctagaggatttggtgcatgtttaagagaagcattttaaatatgaccctgaatagacataatcaggtgaataagctttgttccttctgttgggtaacaaggcaatttcacaggtacgcataaggatctccaaaaggaaggtgcaggaaattttctaaaacagcttggagcctgatgaaaacaatttttctgtagaagccaaatgatcttccataaaaaccccaaagttttgccttattcacatactagaattacatttttgccacactgagaagtgtgatttttcatcagcccctccagaatcccatcaagagagattgtggcagatccctgggttcacatttcacaagtttcattctattccattaagaatttattataaaactgaatattatataactgcatattacataactgagtattatatggtcatttcttagattcacaaaaatttgagaccaggacaaaatctttttggataaaagctgatgtttaattgattatgccattatttccattttgggctacaaagataaaacataatatctgcattcagccttcctgctgatgtgacagtgtgccttccaaatgttctcctagagaccctttaaaaaaatatgtccatcataatttgatctcacttcagtgtctgaaatttttacagctaattttttaagccatctgcaacagtccttgttgcaattattattttccctgacaacttttagacttgccttgcacatcaatgtttagctgccctgagtgcattctgttttgctctggatggtgccttggcaaatgacatggctctgtctcttttctacttctccaggacccaaggttataaaatacttttgaaacaattattccacagctatattcaaaaccttcttcaagggtccccacttccatgacagcctgattatccagtggctacctaagggagcagcatttggtttggtgattagaaagtttattcgtggtctctgcagcttagactgatgaccagagcacctcttacctgtccttatctgctgcaattccattaacagtgccccaaggcccacagggtgagcaccagtgggtagatggatgaggatgaaaacagcagaccttgccctaaagagcctcagctctaattagtctaacactgatttacgctttatgctttatgaagcatctactatgtgcagaatcatgactatgagctatgagagactcaaggaagctcattaacagagctgacaatatccctgagcagaccaagcacacaaaggagaaaaaaatacaagaattcttaaggcagaacatgcaaacaagatcacagtagagtaagggtgccatgtagctagagatggtggaggccagtgtattaaccacacagttaaatgtatgtaagagaatattctgtgcaaagggaacttagctcttcctgcagagctcccaaatctcttgaagtctttacaaaacaaacaaacaaacaaacaaacaaacaaaattcggaaatatttcagacctaacagcaaagtgacagaatgttgagaaaaaggacagaaggttaaggctcccatggcaggccagtcagacgtgtgggcaggaggacagctgaagagtgactcgcatttgcttgccaagcctgactctctgaagcttcccttttgtcttcttctgtaaatatgatctaagggaggaagtgattcagcacagcctgagcctattctgggatctaagagacacagaagtgccctgaaatttccattttcatcactaattactttaacaggtactttaataagtgctttccaattgcccccgctgttttgtaaaattatctacactgcattttacatttttaatcaagctttatttttgaaaagttctgactttctgaagattttgccttttacatgtgggggaacacattttttccctctgatttcaccaaactaaaaggattagttagtggagaaaaaaaaacccaaaacttgacctatttttaccagacctattggaagctccattgatggtcactagaattcaatgtaccacttattaggaagaaatgaattaccacttgctctgtggggggaagagacactctgtgaagtcctttccctaatcttatctcatgaatcttcatactactgtgtggaagaagctgtcatcttagtttttagagatgaagaacccaagatgacagaagcgaaggaaggcatctgaagtcacaatgctacatatatttcaggaagcaggagagccaggattctgtcccagacctgcttccttctaagtccaagctcttcctaccatattctgcttgctttttctatgaagggagggacgtgataacatcattgctatcttttacaaggcaaatcctatggaagtagcttatttctgcctaaatgttaagcccacaatttgagcagctcccatcaaattaattatgttgccttggtgattttccttcccaggttctgctttagaggcagataattgggaaggaaataataataataacagcaacaataatagctgtgaacacttatcgagctctttttagcactaagtgtgtgtttcacatatgttatccttttaaatcctcattacaacctacagtaagaactatcatacctgtcttgcaagtgaaaaaactgacatacagagctaaaaaaatcttgcctaatgtcacataaatagtatctgaaccctggacagtctgactgcagagttcatgctcttaattctacccaattaaatctggttaatgatgatttgttatagacaacttattaaaataacaataaaaattaatcagtaaaatgaactgcatagaattaaaaaataattacctctaaatacaatgtgatatctgtttgctagacacaaacatcattcattcatttacttaaaatcatgctttccttattattattccatggttatcactattggtatttgattggtattgttaatttcatttgctttttagatcactacattctttccatggaagcataattccatatgtaaatttggacctaactgaaaaaataaaactatgcaaaaaaaaaaaaatgaacatttatagagtgctcacttgcaggctaggtcttgtgctaagtgtttacattattattatttttaaaaaatttaatttaatttaattcaatattttattttatttttatttttccagaagttattgaggtacaggcggtatttggttacaagagtacattctttagtggtgatttctgagaatttggtggactcatcacccgagcagtatacactgcaccatatttgtcatcttttatccctcgcccccttcccactcttcctgccaggtcttcaaactccattctatcatttttatgactttgcgtcctcatagcttagctctcacatatcagtgagaacataggatatttggttttccatttgtgagttacttcatttataataacagtctccaatctcatccaggtcactgcaaatgctgttaattcgttcctttttatggctgtgtagtattccattgtgtatatataccacagtttctttctccactcattgactgatgggcatgtgggttggttacacaattttgcaattgcgaactgtgctgctataaatgtgtgtgcaagtatctttttcgaataatgatttgttttcctctgggtagatacccagtagtggcattgctggatcaaatggtagttatatttttagttctttaaggaatcttcacactgttttccatagtggttgtactagtttacattcccagcggcagtgtagaagtgttccctgttcaccatatccactctgacatctcctgtttttttttcattatggccattcttgcaggagtaaggtggtattgcattgtggttttgatttgcatttccctgatcattagagatattgagcattttttcatatgtttggtagccatttgtatattttcttttgagaattgtctattcacgtccttagcccactttttgatgggattgtttgtttttttcttactgatttatttgagttcattgtagattcaggatattagtcctctgtcagatgtacagattgtgaagatttcctcccactctgtgggctgtctgtttactgtgctgactgttccttttgctgtgcaaatttctttagtttaattaggtcccagctatttatctttgttgttattgcatttgcttttgggttcttggtcatgaaatccttgcctaagccaatgtctagaagggtttttccaatgttatcttctagaaattttatagtttcaggtccttaatccatcttgagttgatttttgtatgaggcgagaggtaaggatctagtttcattctcctacatgcggctagccaattatcctagcaccatttgttgaaaagggtgtcttctccccactttatgtttttgtttgctttgtctaagatcagttggctgttaagtatttgggtttatttctgggttctctgttctgttcctttggtctatgtgcctatttttataccagtgccatgctgttttggtgactatggccttatagtatagtttgaaattggttagtgtgatgcctccagatttgttatttttgtttagtcttgctttggctatgtggctcttttatggttccatatgaattttagaattgtttttttctaattctgtgaagaatgatggtggtatttttatggggattgcattgaatttgtagattgtttttggtagtatggtcattttcacaatattgattctactcatccatgagcatgggatgtgtttccatttgtttgtgtcatctatgatttctttcaacagtgttttgtagttttccttgtagaggccttttgaccccttggttaggtatattcctaagtatttaatttttttgcagctattgtaaaaggggttgagctcttggtttgattctccacttggttgctgttggtatataaaagaacaactgatttgtgtacattaatcttgtatccggaaactttgctgaattcttttatcagttctaggagctttctagaggagtccttagggttttcaatgtaaatgatcatattgtcagccaacagtgacagtttgacttcattttaaccaatttggatgccctttatttctttctcttgtctgattgctctggctaggatttccagtactatgctgaaggagtggtgagagtgggcatccttgtcttgtgtcagttcttagagggaatgatttcaacttttccccatttagtattatgttggctgtgggatggtcatagatggcttttataacataaaggtatgtcccttatatgctgattttgctaagagttttaatcataaagggatgctggattttgttgaatgttttttctgcatctattgagatgatcatgtgatttttgtttttaattctgtttatgtgctgtatcacatttattgacttgtgtaggttaaaccatccctgcactcctggtatgaaacccacttgatcatggtggtttatcttttctatatgttgttggattcggttagctagtattttgttaaaaattttagcatatctatgttcatcaaggatattggtctgtagttttcttttttggttgtatcctttcctggttttggtattagggtgatgctggcttcatataatgaattagggaaggttccttctttctgtttcttgtggaatagtgtcaaaaggattggcaacaattcttctttgaatgtcaggtagaattctgctatgaatccatctggtcctgaactttttttgttgttggtaatttttaaattaccagttcaatctcactgcttgttaatggtctgttcagggtatctaattctttctggtttaagctaagagggatgtatttttccaagaatttatccatctcttctaggttttctagtttatgtgcgtaaatgtgtttacagcagccttaattgatcttttgtatttcagtggcgtcagttgtaatatctcctgtttcgtttcttagtgaggttgtttggattttctctcttcttttcttggttaatcttgctaatggtcaatcaattttatttatcttttcaatgaaccagttttttgtttcatttatcttttcatcttttgtattttttttggtttcaatttcatttagttctgctgtgatcttggttatttcctttctactgctgggtttgagtttggcttgttcttgtttctctagttccttgaggtgtgaccttagagtatcagtttgtgccctttcagtctttttgatataggcatttagggctctgaaatttcctcttagcactgcctttgctgtatcccagaggttttgatagattgtgtcattattgtcattctgttcaaagaattttttatttccatcttgatttggtttttgacccagtgctcattcaggagcaggctatatcatttccacgtatttgcatggttttgaaggttccttttggagttgatttccagttttattccactgtggtctgagagagtgcttgatataatttcaattttcttaaatttattgagactcgttttatggcctatcatatggtctatcttggagaaagttccacatactattgaatagaatgtgtattctgcggttgttgaatgaaatattctgtataaatctgttaagtccatttgttccaaggtatagtttacatccattgtttctttgttgactttctgtcttgatgacctgtctagtgctgtcagtggagtattgaagtccctcactattattgggttgccgtccatctcatttcttaggtctattagtaattgttttatgaatttgggagttccagggttatgcatatatttttaggattgtgatattttcctgtcggacaaggcctttaccattatataatgtctctctttgtctcttttaactgccgatgctttaaagcttgttttgcctgatctaagaatagctactcctgctggcttttggtgtccatttgtacgaaatgcccttttccatccctttaagtttatgtgagttcttatgtgttaggtgagtctcctgaaggcagcagatggttggttcatgagttcttatccattctgtggttctgtatcttttaagtggagcatttaggccatttacattgaatgttagtattgagatgtgacgtaccattgcatttattgggctcgttgttgcctgtgtacttcagtttttggtttgttgtttttgctttttaacttgtatttttgtgttataggtcctgtgtgatttatgctttcaagaggttctgttttgatgagtttccaggatttgtttcaagatttagagctctttttagcagctcttgtagtggtggcttactgatggcaaattatctcagcatttgtttgtctgaaaaagactgtatctttccttcatatacgattcttagtttcactgtatacaaaattcttggctgataattgttttgtttgaagaggctgaagatagggccccaatcccttctagcttgtagggtttctgctgagaaatctgctgttaatcttataggctttcctttctaggttacctggtgcctcttaggattcttaccttcatcttaagaatggatagcctgatgacaatgtgcctaggcaaagatcattttgtgatgaatttcacaggtgttctttgtgcttcttgtatttggatgtttaggtctctagtgaggccaggaaagttttcctggattattcccccaaatatgttttccaagcttttagaattctcttcttcctcaggaacaccgattattcttatgtttggttgtttaacataatcccagacttcttggaggctttgttcatattttcttattctttttttcattgtctttgttggattgggttaatttgaagacattgtctttgagctctgaatttctttcttctacttgttcaattctattgctgagacttccagagcattttatatttctaaaagtgtgtccaaagtttcctgaatttttcgttgttttttaagctatctatttccttgaatatttctccattcacttcttgtattaatttttggatttccttgcagtggacttcgccttctctgatccctccctgattagcttggtaactaacctcctaaattctttttcacataaatcaaggatttcttcttggtttggatccattgctggtgaactaatgtgatttttttggagagtgttaaagagccttgttttgtcatattaccagggttggttttctggttccttttcatttgggtgggctctgtcagagggaaggtacagggttgaaggctgttgttcagatctttttgtcctatgggtattcccttgatgtagtactctcccccttttcctatggatgtggcttcctgtaagccaaaagtgattgttgtctcttttccagatctagccacccagtgagtctactcgactccagacaggtactgggggttgtctgcacagagtcctgtgagatgaaacgtctatgggtctctcagccatggataccagcaactgttctggtggaggcgacaggggaatgcagtggactccatgagggtccttggctttggtggcttaatgttctatttttgtgttggttggcctcctgctaggaggtggcgctttccagaaagcatcagctgtattagtgtggaaagggaccagctgtgggcggggccctagagctcccaggattacatgccctttgtcttctgctacaggggtggatagggaaagaccatcaagtgggggtggggctaggcatgtctgagctcaggctctccttgggtacatcttgctgctgctgctgtaggagatgggggtgagattcccaggtcactggagttgtgtgcctaggcttagtcatgcaggttgtcagggaagtgggggaaagccggcagtcacaggcctcacccagctcccatgcaaacctaagggccggtctcactactaccatgctccccccaaccctgccccctgccccctcaacagccctgagtctgtttccaggcggaaggtgagataggcttgaaaacttgccccaggctacccaccacccagctgagaaagaaaaaaggcttggttcttcccctgcctgtggagtctgcaaaccagatttgtgccctcctctgagttctggctaggaagcgtctggccctgttcaaattgttacaaagttcagcgggagatttccttcttcctgtggagttttaccccccgctcctctggccaccttcctgatggatccctgtggtgccaggcaggaaggggctgctaggggacacagcaagctcccagggcctttctgctgcttcttctacccatgtatttcactcagctctctaaattgactcagctccaggtaaagtcagaaacttctcccacaaacagaacttcagcttctccagtggtggtgtgtgtttgggagaggaaggtctccctttcccacttccgcagttggggcactcacagtatttggggcatctcctgggtcctgcaggagcggtcgcttcctttgcagggtctgtgagtcctctcgggattgctggtttgttcttgcagttgatctggagctaaaattcataatgcaagcctccgcatgctgccttgtctggagctgcaatctagtcctgcctccggtcctccgtgatgaaggtgatatgcattatttttccttatttaatccttatggtcactttatgaggtagaaactattatcaactccatttttcaaatgagaaaactgagggacaagagaggctaagtaactgttaagtcaaggatttgaacctggacataaacttaaggactgcccctatggcacctcattctctgccactatattgtcttatccgtgcttgaatgttggggtacaatgatgaacaagcacactccctgcatcaaggtgctcatcagacaggcggagcaggcacctgcaacatagtatgctgtgggaactctcggcagaggggttctgggggctttcctagggaagctgtagctaagttttagcacagctaagagatgttactgagaaacgattactcaggagaggggggctgtcttagtcttttcaattgctaaaacaaaataccacaatattgtggctcataaacaatagaaatgtatttctcgcagttttggaggctgtgaagtccaagatcaaggtgccagcagatccagtgtctgcggagggcctattttctggttcatagatggtgccttctcactgtatcctcaagtggtagaaaggacaaggcagctttctgaggactcttttataagggcactgtcccattcataagagctctcatgctcgtgatctaatcacttcccaacgttcctgccttctaatgccatcaccttgggggttaagacttcaacatatgaatttgggggaagagacaaacattcaggccaaagcaggggtcaaaaaagaaagaaaggtctttctgagaagagcatatgaaaatgtccagagacgagagagaatgtgccattttctgcaaaaagttcagcaagaccacagaggcaagttcaagaggggaatggtgagagagatgtgtcagcaatcaggaacttgggtcaagtcacacagtgagcaagtaagtagctgagttaggatctcattccatcactttctgcaaaatacatgctttcctctactcctttgtctaccttattcttttcccagtgctggacttggctgtgggcctccattactcttacctatgcacagaaaggaaaggtctagaggaagggactgcagatgggtctctgggaagaaatgtagacacagtggacattcacacagcttttatgccttctcagtatgcttcttcctaaaaggggtggctggggaagtagggggtcagtctagggccctcaattatgctgcatgctagaaaagagccaccagcactccagtgatccgtaattgctaatcctgaagacatgcagtgactcctcctgtgacaccaaagggttccatatgttatccagatggtcagcaagaaaccatacgtgggccctgctcttgcaactacaatgaggagacattaaaatcaaactattatcacttaactttggaagataacctccaaagaagggaaaatgcaatgtcagtgttttggagaaccaaaaaaaattatgtagaattatttataagatgggtgcttccttacattattaaaggaaagattagaacaaatgaaattcagagtttgagagattacataaccactgggaccttcacagcctgcaatattgactctcacagtattccactgcatgggggctgggataagaaagagatcagagtgttgatgaaaatgactttcgtgatgtgcactcatctgcattttacagctcaatgtcctggttttactaggacaagttgctggagtcccattcattttacaacatttgtgaagatgtattacataaatgcaatctctggctgaatgttcaatgaaagcccactgtctcacttcccttgatagttaatactaagttgtgcattatcagggtttcagacttattacttcagtttgccttatgggctttgttgctacagatctgcatcacggtttccctgtagctttatccccaaagcagttttttaaatccactgttactttaccccatggtaagaaatgcctcatggtattataaacaagcagttgaaaattgttatttatgtggcttcctaatagcaatttgaaatatagggcataaaattactagcttacaacattgttcaatattaacagtgggaagggtaatatgtaaaacagacattaaaggattagctgcaaaatacatttcactaagctaaatcatttcttggcaaatggcagtttccagctaatacacaggattcatcaagtcaagtggatttatttttatttttctattagtttgttaaatatattctatatttaaacttcaattttgcaggtttctgtttcaggcatattagaggaagcttctggaaacagaatccgagatagaagtgatctcaagactttcaactcaaagctgctcgtcgatttccccagcaaatcttctgagttgactaaagatgagactgtaacatctcagagaaaagtgcatggctatgacattgcaaacatttgtatgacagattaggaagttacaagtgcatcagaaatttcactaaaaaggcatatcttccccaagacataaaacaatgtttccattgtttttgcttcagactctacagacacacaacactctgttctaatcaagcatgtctggagttccgtaaacaatgtgaatctgtgaagcaggcacccagaaggaaggtaaagagaaattcctaatctcctagggtggaaattgtgaagtattaagcagatattcaatgcataaatataaataccataatctctctgagacagtctgtagttaccataatcctaaaattattccgtcttctcaaatccctaaagatttatcaattttcataaagtactttgatggaaacttttttcaagatgcaaagttatctttctctgagctttcctttcatattataccatgtgcagtatttgcaacctcggagaataccaaaaatgagttcttatttttcagagaaattggttatggatctataaataactattacaaagaaatgagcattatagagagaagaagctgctcttagactcatttgagaaactatggggaagttcagattcccaagactaattattattgtaaaattaagggtttgctttgaacacttgttagtattcagccgattttaaagacaacaatttttttcttagactgtgggttggagactacaaatattgctcctcaaataccccatgttaataattccaggggtttaaaaacatttattacatataaatctatagtgttttatttagctatttggtgtgggatggtaaatttatttcataaaccctttcctaatggtagaaaactaaggaaataagatgccctttaacttgaatgtacaaaaatttagtcattgtgtaacatgtgaattacttattcaaaaagccaatggttgagtcacagaagacgtcaccaagcccagtgcatcatcaagctctacattggagcaaagcccaggtccacacgctgtggttaatgttaactgccttatcaaaatagctcaattgattggaatccaatagaccaaaattctccattacagccaacatatttgaaacaaagaggataataactatacaactagcttttcaacatgcaggagaaatcctgggctcagcctcaccaatgagcttccctctccatggctacatccataaccagggaggcaggaaagcaggtggccaaaggtgtcatcataatcttgggtttaaatcctggctttgtgtgactagggcaagccacttcatcttttgagtcttcatttcctttagggataataataccaatactagctcacaggggcttaccggaaatttcaaattcaagagatggagctcttggattcgtaaggttgtggtgaggatttaattaaatgcttgaagactgctagctgtttttaggatctggggcacaatttgtggggcccagagaatcacctccactgaagaatcaccctttcggcagcaagctaaaaaaagtgcaaagtcaatagcagagtgttcagctgaggtagaacaaacacaagtagcaagcggaagaggggataggtaaatgcttcagtaggttcgttttgccaatgctgagtcacagttgctttacagtcagaatgtcgggagcggcttgctggaagcccctgcttgtttcaatggatttcctttcctttctccacaggagggctgtccatgccctgaaaggcactcctcccttgacaggaagtacgggaggacttccctgctgaggcggaacactggctccctcacaagatggcctcctgtgatggtgagcagagctagtgtcttcatattcttccctctctgctcacccacctgacatttctgccttgtctcacttgcctgaacactcctcagttttcctgatctggaagctaactggatgacacttgtcctgttactacccatggtccctaatatgacacggagctatggaccagctcttagcaaaacccctgagcagacaatcaatgaaggtatataaaatggcaaatgaagacttgagaattctactccatataatccttcctgacgaatctccaggaactgacagtttcctttgccatagcactatctagacatgacctctcaaagatacaaataaataagagcattccatttctcctattcccttccttgaactgcaaatgtctatctataattactaagtataattacaactgttattatactgtcaccacgtggtactggtaacacatatcttacaatatgaaaatccttaaacaacttctttcttactgattttaccgaggaccaagatagactatgccacatggcaccaaagtaccatgtagcctgctgctggtccactgagtgactgtgagagttttaaattccttttcacatttacttcttgaatctgtcactagactccagaatcatctgaaggaatcaggcagttctcaataccatctcattattgacatttatgttgatcgatgttggctcttacagaattggaatctacagatgaatttccttattagattctttctcacggctgccataatcattttatcacacaggctgatgctatcaaatgctggtttatcactacgtaatgggacaagctaaattagttcctctaatatgttacaagaaataaaaaaaaaaattcctggttttaaatctcatttttctcaaatcttaagaaattccctgatgtttttgtgtataaagaggttaatttgaacttattctcccttaaaactgtgctccatgggagaccaatggtgaattctaagagcaactcacaattctcctggaaaccatttttcctttcctttcagagagcttcagatgtcagattaaccttggccaactggataagcaggggttcatgtcagtgcctctggtagggttcccagcgcctggccaggtagctctacataaaggaggagtaacaaagcctccaacactgcttcacccacaactgaccatacaatggccaagaaaataccagtgtggtttgtgtccacagaacccagccctactcttaggaagacaactcagagtgtatgcttcactaagaaatggtcgggaatgacatcaaatataaatcaaatttatccaaatattttctaaaggttaatgttaaattctttatttatttatttattttttaagacagggtctcaccccattgcccaggctgcagtgccgcggcatgatcatggctcactgcggcctccacctctcgagctcaaacaatccccatgcctcagccttctgagtagttgggactacaggcacacgccagcatgcctggctaatttttgtgttttttgtagagatgcggtttcgccatgttgcccaggctggtttccaactactgggctcaagctatccacctgcctcggcagagtggatatcttgaatcccaaagtgctaggattaccggtgtgacaccatacccagccctaatgctaaattctgtataggaagaataatctaagcaattgtcctgtctctacagacttataatttttaggatatggataatgcagattctcaggagtttctgaaatgagacctcaggaatccatgaatagggccgggtgcactggctcatgcctgtaattccagcactttgggaggccaaggcaggcagatcaactgaggtcaggggtttgagaccaacctggccaacatggtgaaatcccatctccaccaaaaacacaaaaacaaaaacaaaaattagctgggcatggtggcgtgcgcctgtagtcccagctactggggagtgtgaggtgggaggatcacttgaacccgggaggtggtggttgcagtgagccgagattgtgccactgcactccagcctgggtgacagagtgtgacctagaattcaagatatttataaatttggatggaaaaaaaatgcatctttagtttcattaaacttgaaccaaaattcagtatttccttcagttatgaatggaggcatcaaactacagtgctataaacttgtgactttgtctccaacagaaattacagacattttatcatattatagctgttgaaaatatctctaaatattgtgtatgtgtatcactatttaaaaatcaagttgaacttgcctcttgcgcttgctatttcatgctttagaaaggaagcacacgtattaccatctcatatatgtttttccaatattttggcaactgtatttcaatgtaattgcctttctttataatcttatgtcttttatgcattaaaagcattattctgagaaagaaccataggcttccttgatctgaaaaaaaaatggtctatggttaaaaattggttatgaacctcactgctccccaaccctctgtcttatgttgcatatggcatggagcccttctgttgtggctctgacttcccacatgtgtgaacaggaatgggtgaatttcagggattctgagtcctgccatttacctctagaacctggagtcactggtcctggttgggggaggaacttacgttaattcaaatctccactaaaataaattagctttcttctcattgccaagcagagcgctacagctatgactgttatgtattgttgcaatctagaccttaatggcattttagccctgtggtgagctcaagagaaactattttcaaacttcaaaaggccattaaaacatgtgcagatgtctggaaaattaatactattatctaactctcaccctttgcctgtaggaggcaaagaagaaacaaggctcaagaaagatactagagatcaatacacggtcataaagcaaagagctgtccttctagggagcacggatgaggatgagtgagaaatcccacagtgcttctgaagaggctttttcattagatttttttttttttggttgaagtcattcacttaatctgttaaaaatttaaagagggaatgaggatgggatggaaagtggaaggagagagaaaaagataaagataattttctgccaccctacttcaatttggatgttcaaggtccagaattctcaagagtggaagtattcattcattcacacgacaaaacctgaatttgtcaaggttaatgttgaacaagctccagtctgttttaaagcaaaagcgttttgcatcttgaaagatttgagctgcattctgtaaaattctcagtgtagggaggtattctcataggtagtttcaaggcttttataaagttttcagaaccacaggatattctcttcccttccttcattttattcccaacaaatgttatgctataggtgtcctaggtattcccaaaaacctagaaaaccagacttaattttttaaaatcagaggatgaaagctttatattttattaaaacatggagaaagtttttcaattttgaaagaggacagagaaatgggatagcaggtatttttagtaagttttttgttttgttttgtttttgttttttttttaagagacagagtctcactctgtggcccaggctggagtgtggtggtgcaatctcagctcactgcaaactctgccttccgggttcacgccattctcctgcctcagccacccgagtagctgggactacaggtgcccgccaccacgcccagctaatttttgtatttttagtagagacggggtttcattgtgttagccaggatggtctcgatctcctgaacttgtgatctgcccgccttggcctcccaaagtgctgggattacaggcgtgagccaccgagcccagccagtgttttttttgttttttgttttttgttttttttaaatataggtaaagctgaacattggaaatacattgagaatcctttacagaatattacatggattttcctctctgcatagccctttgtaagaaaacctgaaaacattcacagactgtgggtaacacatccttttaaatgggaagttttccttttaaattcaagaataagcaagatgggctgtgttaatcaggattacacctagctttcagggacagaagaaaagattttggtggcataaacatacaagggtttattttccttaagctagaaatccagagataggttgtcataaagattttggaggttgttactgcataattatttgggcttatcctgcgtgataagtgaggcaacataaaatgtgccagcaggaccaagtggcaaatatagtctgaaacagggtcatctatcagaaatctctggaccacattttaattttattgaggtgagtgagatggtggagaggagacagggtgaatgtggagcttcaaaatggatggatataacagtgtgtggactcacaccatgatcttttgctccaagaaccaccatgaaacataccggaaaaaccaaaagaattcacagatcctttgaaaggagtactccactgcaaattccatgaaacaggtgaaaaactgtgagttcccaaagcgtgagggggagaaactacctctgaacacacatccccactggggaatctgaaaactccagatcacccacgggagaaggatttaaccttacctagggatgaaacaggtttagggagttgtgagaaatatagaagtacaagtagcagtgagaagtgccttgaacgcactcccagcttctagcttaagccccaggaagccatccctgattatacctcatgggggccctctgggaagacagccagaggaattgtggaggggttgctgggtaaaggaaactctcaactgaaattggtagtggtttcaactgggcacaaattctcttgagtggagtccaggggaccagcaggagctgttgtggataggagtgagctagcgaaggagctactgcggacagagtggacagacaggaaggggagaggtctgaaagccatgcttgctttctcagctgggtagctcacagtctggggcaaagtgtgagtggggaactgcaggagtgagacccacctcaccaactgcctgggagctgggtgaggctatcccccacttccctggtgaactatataacacagcagagacagccaacatcccctctggaacataaccccattggcctgagaatcactcccccatgccccacagtggccgtggcaagctccacccaaggagagtctgagcccacacctgcctaaccctgccctgactgggtagtacttccttacctgccctggtagctgaacacaaaacatagaaactcttgggagctttatggccccacccattacctgaaaaaccaaaatactctggccatcttagggcaagcttagagtcccctactagcatcttggctgctgctctcttgaaagtgccacctcctggctggaggccaacaaactcaggccattacagcaactcaggacagaatcaccttgatcccaggaagaagacaaaacttgattccactgcctgcaacaccttggctaaccagaggtcctgagggtgtccatgtgacaacttcactgctagcataaccagtattcaagaaagccagcacattgaacatacgtataaccatggacacttacagagtccacttcactcccctgccacctctaccagggcaggtactggtttccatggctgagagacctgaagatggaccgcatcacaggactttttggagacattccacagcaccagcctggagcctgatagccctgctgcatggatagacccagaagagcaacaacagtcactgcagtccagctctcaggaagccccattcccaggggtaaggggagagcacatcaagggagcaccccgtgggacaagagaatctgaacagcaggcttggccagtaggtctggcctctccattgaattagtctacccaaatgagaaagaaccagaaaagtaattctggtaatatgacaaaacagggttctataacaagcccaaaagatcacaccagctccccagcaatggatccaaactaagaagaaatctctgaattgccagataaagaattcagaaggttgattattaagctactcaaggagatacaagagaaaggtgaaaatcaacttcaagaaataaaaaaaatgggaaatggatacaaaattatccagagaaatagatatcataaagaaaaacaatcacaacttctggaaatgaaagacatgcttagagaaatgcaacatgcagggagagtttcaacaatagactaggataagtagaagaaagagcttcagaacttgaagtcaaggcttttgaattaacccaatcagacaaagacaatgaaaaaataatttaaaaaaatgaacaaaacctctaagaaatttgtgattttgttaaatggccaaacctaagaataattgatgtccctgaggaagagaaatctaaaagtttggaaaacttatttgtgggaataattgaggaagacttggccttgctatagagatctagacattcaaatagaagaagctcaaataacacctagggaattcattgcaaaaagatcatcacctaggcacatagtcatcagattatctaaagtcaaaacaagggaaagtatcttaagagctgtgagacaaaaccataagataatctatacatgaaaacctatcaaattaacagcagacttctcagcagaaatcttataagccagaagggattggggtccaatcttcagcctcctgaaacaaaataattgtcagccaaggaatgtgtattcagtgaaactaagcttcataaatgaaggagagataaagtctttttcagataaataaataccgagagaattcatcacaactcagtcagcactatataaaatgctaaaaggagtttaaaatcttcaaagaaaacctcagaatacaccacaatagaactcccttaaagcataaatctcacagggcctataaaacaataacacaatggaaaaaaaacccaaggtattaaggcgacaactaacatgatgaatagaacaatacctcacatctcaatactaatgttgaatgtaaatagcctaaatgctctacttaaaagatacagaatggcagaatggataaaaatccatcaaccatgtatctgctgtctttaagagactcacctaacacataaggactcacataaacctaagggatggggtggaaaaatatactccatgcagatggaaaccaaaagcaagctgacaaaacatactttaaagcaacaacagtaaaaaagacaaaagagggacattatataatgataaaaggaataatccaacaggaaaatatcagaatcctaaatatatatgcacctaacactggagctcccaaatgtattggggtgactgtgggtaatacatctttttggatgtgaatgttttcctcttgaagttcagaataaataaggaatatctcaggatttcattcagctgcaaaaacaaacaaacaaaaaacagaaagcctcacttaacagttacttcagcttatagggatttatatttcttacatagccaaatgtccagaggtaggcagtccagggcttgtgtaacagttcattgatcttgtcaaggaactaaactcttcccatctttctgctctgctctgccctcttttactaggggctcatgccaagatgactgctgcacatcctggcattgcttccaccttccagatagagagaagggttaagaggggatgaagaacatctagagccatatctgtccctcctttatcaggtaacataagttttgtcataaatctctatggcagatttccttttaggtctcataggccagaactaggagaaaaggaggctgagaaatagcatatttggctttctaatctctgaagtagaagaaagaagggagaagaatattgattgtgtatggtggtcacaagtgctgcctatcacataaatctagctctctttccttttgggagtatgttcatcagttgtgcttcctgacccctctgtggttgggtggggccctgtgactagttctggctaatgaattgtggatggaatgcttcaagcaagagcattttaaatacagatgtgaaaccccctcagagctttcatcttgctggcctagtgactggcaatgtttgagatggtggctggtccatcagcaaggtctcctgagtgtttaacatgtgcacagcaagactgatgactcataaaagacatgtggcatgagaaagaaatagacttttgtatttgaagccatggagattttatggttgtttgttaccacagcatgacctatcctattctaactgattcagtgagtcaacttgaaatgtcagcagccataagaacaagttggagaggcaaaaatagtttcagtttcagacaaggcccatgtattagagatccctgaaaaccaacatagatctcagtgggacaatatcctgaagccaactttctctacttcaagagcagttaagtggactttaattcataatgttacacagctatcctcgtactgcccacaggacaccgacaaataatctccctctccggtgtctctacataggtgagtggctaatgaaacatagcatgttcaaggtaagccaccacatttaatatgaacttccaggatgaccatccacaaaaatttaatgcatgataatgagggatggcacagtttatgaccagccttgttaacgatatagttcacatctccacccctaagaggaagacaaaaatctggagggggaagggaggtgactaagagttaaaacgttaatggcctcttcagttacactgagtgtctgatttttatctctaaatacagtatttcacatcctcagcaaaatcaataggaatgtattcaataggacaggacttttccataaggactgaaagctaccaatatcaagccattttaacagagggcaagtcatattatgggagaggaaagagaacattagcagaattcagtacaaaggaggtgattgcttgactagtgatttcatgtttcactgttgctcacgctccattttaactactatccctggtcttactgtgagatgggaggagctagccatatggatttatgctggcaaaactgttgtttccacagcagatggtaacaaaaaatcttacacaacatacttatgtgctaaaaatcacttaacgtaattgtagttaggttaatctggcttgaaatgcatagtgtaatgtatgcagcaaagagaacattaaatggtgacaagtgtaattactgatgtagtcccttccaggcagtcatgctacagtgctcacttgcaaagggcaaaggctagtttggaaacagcaagggaagaacagaaagccgttgttgcacgatgctttacttctgtggagttttcaattgcttatttaaaaggaggtaagagataactaatcctttgcttttgtaaaatctatgtatgaactgctttgctctccatgaatgtgtacacaccttgtttctgtggttgtcatctttggagtgtaaatttttaaagccaaaataaacattacatatttaggtacattaataattattatactaaatagttatggtcccttttaaagatttcagtggattcccactctatcacaaaggcataaaccctttaaatctttgaatcatttaattttatgtattcttttggtattccatttgggagttatggggtgtgaaatatgcatcatgatgagaaaacaattaaacagcacacctgttgtttatgcatattgtactcaggaagggccttctggaaccattatttaattccccagtatggtgtcaaccaaggggctattagaggtgacctgacaacaccaaattatacttttatttgtattatgtgacttgtgctttgccctcctgttagaatgatatttacttctcaagtcaaaatcatgtttgtgacccataataacaattagtgagactttcatgtttaatagaaaaatattagctcacatttgctacagaaggagtgagtagtgatagaattataagagcagcagaggcagtcaccatttaatgagtgcctcccatgcctaggtaaatcaagcagtttatagatagattaaggagaaaaataggacatcctgggtttattcacaatacaggagaagaaatgttctttttgctacattttcattaacagaccattgatagtagaagttcactgtaagtttaacaaaccctctgcaagcatctgcagtgcgatgggtgctgggcaaggcatgaaagacaaggcgagagcagaggtgggggaagagaaagtattggtacttagaggcaaactgacactctaggtatcgacagaggcactgatacgtgaaaagggaagaaaagaggctgcttttcatggggagcagaagactgcatggtggtaaatgtcatgagtgtctgtcattcagatggagatggagtgtatagatatagtcatggaaaaaattacaactgcaacagttaaaatgactgagcatttactgtatgacaggcctgacctcactccttagatgtgatatatatttttttaatttaaaaaagagcattatttttttcttgtgacaaaatatatgtacaacacaaaatttaccatttccatcccttttaaatggataatccagtggcattaagcatctttttatgtgtttgttggccatttgtagatcctttttggagaaatgtctattcaagtctttgcccacttttaattgtattttttagttaagaaataataattgtacatattcatggggtacatagtgatgctgttacacatataatgtacagtgatcatatcagggtaattagcatatccatcatctcaaacatttatctttccttatgtgatactttaatcctcgcaacttccctatggggtggatagcattattagccacattttacagatgaggaaatggtagtagagggataaaataccttgtccaagttaaaaacctagacagtctggctccagagtgtgtgtgcttttcatctatgtgctataaaaaaattactcaacaagacattgttgtgatcacactaaaaagttcataggattctcggtctgtgctttctcatggccttgatttcctttatactgattcttatttttgaataagggcctctaagatagacaggtttaaatgtatttcagctgagttgctgagatttaatggagctgccacttgggtttttcaaagcccttacaaggccaatggttgaccctatacctgctggtagtccttaggggaagcagtacgatataataggtaaaactttggctttgaagtcagattgaagcacaaacccaagctgaggtcacaccagatgtgtgatcttgtttattcatctgtaaaagagagagattatttccttattgtattttcatgaaaaatggagacacttcaggtaaggtactgcagtaagaacagtcctcgccagactgaatctgctggtgccttgatcttgaactgtccagcctctagaactgtgagaaaatacagttctattgttcataaatggtccaatctgtgctattttgttatagcaacaggaacagactaaggcactgatatggtttggatttgtgtccctgcccaaacctcatgttgaagtgtaatccctagtgttggaggaggggcctggtgggaggtgattggatcaagggggtggattttccccttgctgttctcatgatagtgagtagttacagcgagatctggttgtttaaaaatgtgtagcacctcccccttctctctcttgctcctgctccagccatgtaggacatgcctgcttcccttttaccttttgccatgattggaagcttcctgaggcctccccagaaacagatgccactatacttcctgtacagcctgtggaactgtgagccaattaaacctcttttctttataaattacccagtctcaggtatttctttatagcagtgcaagaacagactaatacaggcacttaatgtaatgtgtggaccacaaggagtgtacaacaaatagtctttattatcatgggtcacttcagagtgcgtgtgcttggtctaatcccagaaggcaattatctctctcaagcttccacaggtagctcagcacacaacactgagaagcaggtgtttcctgctggcattttcctatccaaccttcctcaggagtcctgccctagatgcccaatacacccattgccttcctagagcccaagcctgaggcctgtggaggcttgctctggttgttagtatcctctcaccttggtttccagcaatatggtgatgtcagctcaactgtcggctaggagactcagcatcttacaaagaaaatggggatgggagactgacataaccagtaacgggagaaaggtgctcatgaatattcttttacaataataaaaacaacgacaatgtcagctcatcagatgaagaaaatgtcagtcgtgttgtatttattgaatattagtaataatgagtataatacaataagtttaaatatttatttaagcatcaaagtaaacagcatggcttttacagtaaactaagggttgatttataggcttattaagtgtatgctttgtggaaagtttgaagctcatttcgttatctgtaagatgggagcagcaacgcctaccttatggaatgctgggggaaatgaatgagatgattcctaaaaagccccacaggagatactcaataagtggtagctgttgttattatctagaacacggatttgcacaccacaacctatggacaaaatccctgcttttgtaaatataattttattgaaatacagtcacactcattcatttacatattatctacatgagcttttgcctaccactgcagagtgagcatgcctgacaagaggccttacagccagctctttgctaaaatatttactatatgaccctttacagaaataaatgcttcccgacccctgatctggaataggggttctcaagctgtagcgtgcatcaggattacctggagggcttgaaaaagtcagattactggacacctacacccagatgttctgaatcaggaggtgtagggtgggcccgagaacttgcatttctaaaaggttcccaggtgatgctgctgctgttggtggtggtgcagggacctcagttgagaaccactgattctgagaaacttttcaaatttctcttttctatgacttcaataggatacatacacatcattaggtttgtttgtggctgttgaaatacacataagaggcatttatttactctgtctggtgctctggtaaattttcagggcctttccagatttcgtctagtgatgttgactttccccctcttagatcctgccacagtctgaaacacaactgataaaacacaagctttctgctcctcttacacaaacttattctgggtcccatctaccaaccgaagcagaggaacatttctaaagtctgggcattactttctttctacttcctttctccatcctctaaggccttattgaaaacaaatcattctcatgctagtctttccagctcctttccaattttcaaaaattattttcaacaggatacagagcagtaaaagttatccaaaaagttcttgtaaataggactctcaattattttagtttttaatgtggagggggatgggagggggctggagtagtaaactggctcactggtgtttctggtgattatgctcagagtctaaggacagactgttgcttgcaacagtctaaggacagtctgtttccccccttgcagtgctgagagaaagtcaggagggtaaacagtatctcactcccgaagaacaaagggctgaggtggaatgggagctccgtgaccaccagcagaagaggtattttgggcctataaggcacttcccaaatcacaccacagagataagagcacagatgagcctgttcttcccatctattgcatacttgcatatcctgaatattgcttccagcagaatggtaaataatgcatagctgctttctctcactgggagtgacaagggtcccttctgaccgatcacttcctgcagttgttaaatgttagaacaacaaaaggcagtaattttcaaaagaatatgacaaggatcagtagcatttcatggtcttttaatttttaaaaactatacaatatgtgaaactattcttataataaaatatcagataatgtaaaagtgtatatagtaaaagtggaagtcttttttacaatgcttccctccccatctcaccccccttcagtcctgttgtctcctgccagaagtaaccattgtttatatttgatgtggatccttccagaacacttccaatgtatgcaaatttgctaacacatatttaggttttaaaaaacataaataaatggcacagtatgatgcacattgttccgcaacttcttttatgtaatagaatattttgggattctttctgtcagtacacggagatcagttttactcacttttcccaccgcatggtgctccatcacacggaagaaccattcttggcttaaccttttccccactaaactttattttggttatttctgattctttgttgttatgaacaatggggcaataaccattctaaaacttaaatatctacttgtgtacaagcatttctgcagaagagatatcaagaactggcatttctggggctgatatgcatacttaaatttttgttataaagagccaaattacctttcaacaaaagtgtagcacccacttatcacactctaaatactggatatcaatttttaaaatatttgtcaaccaacaatgttgtttgattgctgttttatttttatttctctgttcattgcaactgtacttgaatgtttattggatatctgctattttctctgtgaattgcttctacatagtttttgatcatttttcttttggtttgtttgtccttattgactggtaggggctctttatatattaatagtatggatattaatattggaatttttccctctctgtttcttgtcttttaactttatttacgatgtcttttgcaatagggtttttgtttatttggttaattggcttggttttgtatttaaatatatcatttttttcctttgtagcttctggattttgtatcttgcttaggaataccttacctaccaaaaaattataaacatactctgatattttatatgtaatatattaatccatcagggaatttacttgtgcttatcttgttacagctataatgaattttttagaaatacattgatgaatccctattgtttcatctattgatttaaaataatatctctatcataaacaaaactcccatttaaacattgtgaagatattttccttctttcatttattgttctactattgagccatatcatactgtgttggttgtagctttataatttgttttgaaatttggtaggcaagtcccccttcatgctttcttttgcaaaaattttcttccagttcttgtcaaaatctgtaaaatagcatgatgggattttgatttaatatttttaatttttggaatattatctttaaattattgagtcttcccatgcatggacattgtatcattctatagtaaagctctcaagtagatttgttaataggcatttcatagagtgcttgttactattaatgtctttcactaattacattttctaattaatcattgctggcatgtagaaatgctgtggtttggttttatatatgttttgcatgtatatatggggtacaagtgcaactttgttacatggatagattgcataatggtcccattagagcttttaaggtattcatcagccaaataatgtaccttgtacccattaattaatttctcatcatccaccccccagccacaccccatccaagtctctactgtctataattccattctctacaaccatgtgtacatatattttaacacccacttatgagtgacaatgtgtgatttgactttctgtgtctggcttgcttcacttaagaaaatgacctccagttccattcctgttgctggagaagacatgatttcattcttttttatgtctgaacagtgttacattatgtatatataccacatttctttatccaataatctgttgttggacacttaggttgattacttatctttgctattgtgaacagtgctgtgataaacatatgagtgcaggtttcttttttgtatacggatttattttcctttgggtagatagccagtagtgggattgctggatcaaatgatagctttatggtagctttatttttagtttttagagtgatctccattctattttccataaaggttgcactaatttacattctcaccaacagtatacaagcattcctttttctctgcatccttcacaacatccattcttttgccttattaataatagtaactagggtaagatgatatctcattgtagttttaatttgcacttctctgatgatgtgtgatgtttagcttttttcatatacctgttggtcatttgtatgccctcttttgaaaaatgtctattcatgtcctttaccccatttttaatgggattatttcattgttgttgctgaattgtttgagtttcttgtatattcgggatgttagtcccttgtcagatcaatagtttgcaaatgtattctcccattctgcaggttctgttcactctgtcgattatttcatttgctgtgcagaagctttttagctttatatggtttctttgtctattttttgttgttgttgcctgtgcttttgaagtcttatccataaaaatctttgcctagatcagtgtcctgaaatgtttcccctatgttttcttctagtagttttgggtcttatgtttaagactttaatccatcctgagttgatttttgtacatggtgagcgatgtggcttcagcttaattcttctgcaaatggcaatccaattttcccagaatcatttattcaaaagagtgttctttatccaatgcatgctcttgtcagctttgtcaaagatctgttggctgtaaataatgtgtgtttatttctgagttctctattctgttccattgaacagaatattttaataccaataccatgccattttgattactataggcttgtaatataatttgaagtcaggtaatgtgatgcttccagctttgttctttttgcttaggattactttgactatttggggtcttttttcattccatatgaatgttaggaatgtttctctaattctgcgaaacagtgacattggcattttgatagggattgcattgaatctctagattagggtagtatggttattttaatgatattaattctgcttatccctgagaattagatgattttctacttgtttgtgtcattttcaatttctttcatcaatgtttgattttggatattgcttttatatcctgaaactttactgaattcatttaacaaatctaagagctttttgtagagtctttttgtttttctaggtataagatcatatcatcaacaaacagagataatttgacttcctttttttccaattttgttgccctttatttcattttttagatacagggtctgacttctgtcaccaaaactgaagtgcagtggtgtaatcatagctcactgtagccttgaactcttaggctcaagcaatcctcctacctcagcctcccgagtaatttttctttatttatctctttgtttgtttgtttttgagatggagtcttgctctgtcgcccaggctggagagcagtggcgcgatctcggctcactgcaagctccgcctcccgggttcatgccattctcctgcctcagcctcccgagtacctgggactacaggcacccaccaccatgcctggctattttttttgtatttttagtagagacggggtttcactgtgttagccaggatggtcttgatctcctgaccttgtgatctaccgacctcggcctcccaaagtgctgggattacaggcgtgagccaccgcacccagccaactttttttaaattttaaatttttgtagagacaaggtcttgctatgttgcccaggctagtcttgaactgctggcctcaagtgacccttctgcctcagcttcccaaaggctgggattactatagatgtgaactaccacacccggtctgaatgtcttttgtttctttctcttgtctaattgctctggttaggacttccagtactatgttgaataggagttatgaaagtgggtatctttgtctcattccagttcttagagaaaacgcttttaactttcccctgttcagtaggatgctggctgtgtgtttgttgtatatggcctttattatgttgaggtatgttcctttaatgcctactttgttgagggtttttatcataaagaaatgctgaattttatccattttttttctgcatctattgagatgaccatatgttttttgtccttaactctgtgtatgtgatatatcacatttattgttatgtgtatgttgaaccatccttgcatccctggtataaaacctatttaattgtggtatatcatccctttgatgtgctgttggattctgtttgcttgtattttgttgaggatttttgcatctatattcatcaggaatgttggtctatagttctctctttttttgttgttgtcttctcgtctggttttggtatcaggatgatacaagcctcatagaatgagttagaattcagccgctttgtttaggggttgatctttgccctctcagcgtcttctgtgatccctggttggctaaggtttcctgccttctcctgagatgatttttgtcttttatcttccttagaacactaagcattcaatttcattagtataaagctttcgccatttgtaattcacaccattttgtaatttctaatgtcatttatctgaatttttactttttttttttcctttacatcaggcttgttcaatttgctttctttgttggggaggtgtgttgatttttttcactttcctgcctttaatgaactaacttttcttttttccagttttcattcaaattttacccatcatagcactattctcaattttcctccaaatcttttactgccagttaattttatgtcaattaattttattttatccaagtaaaatatataaaattttaaaagttagatatgactaagcagcttgaaacaaaaaatagaagtgtctcacccacccttctctaccttgggggcctaccttctacccccaggcttctccctgatacttggctccaacttttgaaataataatcatagctaaggcttgcaaagtgattactgcatattaggtactcttctaaaaatatacttggattatttcattcttgctatcctgttttattgatgggacaactgaggtatagaaatattgtgaaacttcctcaaggtcacatagcaagtgagtagcagaaccaggatttaaatctaggtagttgtactcttaaccatttttacaattttctgctgctcaaaaatgctcttgtaacatgtttcactgttatttcttgatttatcaattgcagacatcttccactgacttcccaacatggtaaatacagactaagctctcccatcacatgcctttatttcttgtttccctttcctaactttaacacagtaatttataattcattgatgtttaaactcatagcaactacagcattatcatgaccactgattgcacggctgactaaatggcgcactccatgacctctttcatgaacaatctcttattttcctaggagtattttttttttgtttgttattgttattggtgttttttttttctgaaaatgtgatttttttccttgaaaacctgtatgtttccctcaactctccaactgctcatcagtaacacgttccatattctcagatataaagtttattattttattttccataagttattggggtacaggtggtatttggttacgtaagttctttagcggtgatttgtgagatcctggtgcacccatcacccaagcagtatacactgcaccatatatattgtcttttattcttcactcccctactactcttccccccaagtccccaaagtccattgtatcattcttatgccatactataaagcttattttccaccccctagagccttgcctgggctattgctcttaaggctgctgtacagctgtttattttgttcatgagactgcctagtcatcattctgagtcttattttgctgctttcttgtatcaaatcctgtattaggccaaatacgtcttcccactccgtttcttaaagcacactctgtggtagcttcctaagaaaagggacatgggtgattcttttgttggttatgagtgcttgtaagctggaacatatctttagtctatccccatgcttaattaacatttggttggtcgtagtaggttgagcatttcattccactgtgatcgtgacagtgatgctactgagaaatcagacatcgttcagtttgtagttcctatttcatgacctgtaattgtccctggctgtcctgtagctgtccccacccttgggtagcttctctttcccccatgtgttctaaagcttcataatatacctgctgtggatgtgtcctcaggggctcacaggctttttcaacctgaatgcttccttgcttggaaattgtcttacttatttcgcaattatcttccctctatttttttcctattgtttctttctggtattactattattcttatggctacactgatcctttaatttctttagttttgaactcaaattttttatctctaaacttttttaacttactgggaaattacctatactttaccttccagcccttctactgcgtctttttcattgtggttatcatatttttaattcctaagaactctaaagttttctctgatctctttgtatagtacaattttttttttgcatttttcttatgttttttcaattttcttctgttcactgagttgtttcagatgacctctgggttccttttctccatttgttggttttgatgtcttcctttttaaaatttatcctcaagtgtctggtaacttttgactatccattaacacaggagaatgcatttcaaaaaactgatgattagaaggcctccgtgcatggacagggcttgttcctggctggacttcattgagaatgtggggagctgacttcccactggggagacctccaaatgccaggaactggaggctgtttagctcctgctgagacgagtgatccaatccccacaggctgagagcagggtggtgtacatctgggtggtggtgttctggcagctggacagaagaggtggaggtggggaggggccccctacagggcagcatgaatacttaagcttaactccctcttgtgatccctgttactctggccttcagctgtactggcatctctgagcatggagccctcctctttcaacttattcacaagtcaaaccctttgtttctttgtatactgctgtgagtagtggaagaagtgaatctacatggtcatagactttccaccctcctgctctctccgtggcacctggggtctcccagtggaacccctcatgggttctacagggagatttccttccctttgctatttgctcaatgccaatacttaggttgtagcttcttctgtttaattaattcagttcccactactccatctgctccccctcttctaaaaacttaatgaaatcggggccgggcgcggtggttcacgcctgtaatcagagcactttgggaggccgaggtgggtggatcacgaggtcaggagattgagaccatcctggctaacgtggtgaaaccccgtctctactaaaaacacaaaaaaattagccgggcgtggtggcaggcacctgtagtcccagctactcgggaggctgaggaaggagaatggtgtgaacccagcaagcagagcttgcagtgagctgagattacaccactgcactccaggctgggcgacagagagagactctgtctctaaaaacaacaacaacaacaaaaataaataaaatcactcatctgcttttgctttttctcctgtactgtttctctcttgtgggctaattagcttttatttctatggcacaaagtcccggaagtggggttgctgtgggaagagagtaagtacttttaatttgaatagctattgccagctgccatttcaaaaagtctaacatttacatatatgggagtaccctctccttggtatccgtaacagtaataagcattatttctctccttgattattgctaatataattaaggagatatttagttgttacataaacttgccttttcctgaatactagtgacatggagaaccttttgacatgtttgtgggccatttggatttgcacttctatcaactgccttctcatatatttgttccattttctagcgccttacatgtctttttcttgtccatttgtaagagctctttgtatattatagatgtttgtcctcttaattcaaatactgccccgtaaaatctattgtttgtctactgcttatgttaggattttcaaaaatcatacaaagttttaatttttatagaatcaaataagttcacctttcttttatagcttctggattttatttgattttatgtatggtctctcatattattttgtaatatctactatttcttctacattaaaatcttatatatatctacatttgtttttcatgtggtacaagataaccagttatacctgttttctgtatatgtattttttccaggtagatagctagtagtataagtaccgttgactcttggtgtcaacaacgtgagggttaggagtttttagcagtcaaaaatgtgcaaatggtggagtgcaacagctcatgcctgtaatcccaacacttcaggaggctgaggcgggcagattgcttaagcgcaggagttcaagaccagcctgggcaacatggtgaaaacccatctctacaaacaatacaaaaatcagctgggcatgttggcatttgcctgtcccagatactcaggaggctgaggtaggaggattgcttgggcccaagaggttgaggctatagtgaactttgatcatggcactgctctccagcctgcgtgatggagtgagaccttgtctcaaaaaaaaaaaaaaaaaaaaaaaggcgcaaataactactaatagcctactgttgaccaaaagccttatcaataacataaagactgaacacatattttgtatattatacattttctatactgtattcttacaataaagtaagctaaagaaaatattactaagaaaatcataaggaaaagaaaatatatttacagtagcgtactgtatttatctatactatgactctataccatctgtttacaagatgaattgtttgtctgacatgtggcagttgcagctggagacctcaaactatggtccatatgtagcagttcaatggtttcttataatgtcttgacttttctctggttcttagagcacttccagaatcactagttgacatggggttttggtattgcactaaatacaatgacaaatacatgagaaccaagagagatcactttttgccatgatatgcaattgcagtaaaaagattggagagatgaaatgctcacacagagatgattggcattgcacagcatttttttttttttttttgagatagagtctcgctctgttgaccaggttggagtgcattggtgtgatctcagctcactgcaacctccacctcccgggttcaagcaatgctcctgcctcattctcccaagtagctgagattacagttgcccaccaccatgcccgactaattttttgtatttttagtagaaatgggatttcgtcatgttggtcagactggtctcaaactcctgacctcaggtgatccacctgccttggcatcccaaagtgctgggattacaggtgtaagccactgtgcatggcttcatacagcattttaagtggatactaggaatacttgagctcaccacaatagcagcaggaagtggctgtttaattattacaatagtacagtatgtatacagttaattttacagttaatactgcatctttacacttgtttgcatttttcttgactgccaatggcaccatgtatggtctgtgtttgtgtgcgtatgttttgatacattttacctttttataataggtttgtgtatatttattttaaaaaatatttctaggctttgtggttcacctgtgagttttttcaaattgtcacaaatctccaaaaaatttcactgtatatttattgaaaaaaaatctgtgtataattggacccatgcatttcaagcccatattgttcaaggttatctgtataatctttcaaataatccatctctcttctgcagaactgaaatactgactttgtcatatattagattttcatacatagtaagatctatttctgtacttggttctcttgatattttttctattgccattccaacaccatattgattttaaatataatagctttatagttcagtctgatatctagcaaagcagattctcctgacttttcttctcagacatgtattcttccaaaaccatgttaaaataatttaatacaattccatttttttgtgtgtgagttttaccatgtggctaaatttatttctaaatatattataattttagtccttaccttgaaaggaaataatttgctatttccatttctaggtgcttattgaataaagagattacagctattaatttttattatatttactttcaatccaatgagttaaccatatttaaactagcagattttttattagagattatttctaagaatgtagctatgaaatgtgtaaaggaatacagttttcattctacttttccagtatttatagttgccatttcattttcacgtcttattacctttactagaaccttcaacatattgtaggataataatagtggcattattatttccagaatttaattgcaaggatttctgtgttttgtttgccagcacatttgctgtttttttctgttgttatatatactctattatacttaattggtttccatctattctgttgtacatagagtttttattgaaaatgagtattgaacttttcaagcacaaatgcaagatcttttgctttggccatgtgacttttctactttaatttgaagttatgtcacactgtattatgttgatatatttcctgatattgaactactctggcacttcagaaattgcctcatttagtataatgtatctttaaagacatttctttattctatttgttaatattttctttagaatgtatcttaactcataaatgatatttgtctatagttttcctaggtctagtatttttataagattttggtattaaagttatgctggcttaaccttttgtatggtatgacataatctaaataatattggcattacacacattttttaggattacataaagcttagctgtattcttgtctgtttttaggacctttttcaatggtaggtctttaattgtctttccaatctcttacatcatacacttcattttacagtttacattttgctaggcaataatttatttccaatttgttaggacagacatgatgattattttcttataaacttttattcactgacatctatggctatgatttttctccctcattcttatatagcttagctctcttttattagtcaaatgagagatttgactatttttattggtattttaataaactttttgggaatatacatacatatatatacacacacatataaatctctggttaattttagccttcattgttacttatttccttttgtattttccttttcccaatttctaaaataaattttgctactttattatatttattttctaatactaaagatatttgaggatatccaacttccattttttcttttcttttttttaaatcctttctgagacagggtctcaccctgtcacccaggctggagtacaatggcaccatcatggctcactgcctcaacctcctgggctccaatcctcccacttcagcctcccaagtagcttggattacaagtgtgtgccaccatgcccggatgatttttctttttcatttttttttcactttgttgcctaggttgatcttgaactcctgggatcaagcaatccttctgcctcggcctcccaagtgctaagattataggcgtgagctaccatgccccacccaatttccattttttctgtctcatgtaaattttctatttttgctgtgtcccacaggttttgatatgaagtatatttctctacatagttttcaagatggtttataatgtcacatttgctatcttctttgatacaagaattttctggagtgtattttataatttccaagcagtaaacattttcatttttgtatttataattttattagcttattatcagatagttggcctgtataatctacatgtttttaaattttgctagggtttcctatggagctaaggcataatttatctttctaaatgtttcacagatatataagtacaatgaatataccttattgaagcaaagcagtggtttgtatatggctattatatcaagattagtgattgtattctttatatctttacgttcctattatttatcagaattgctcaattctgaaagaatctttgtgttctgaggtctttttctataatagtattgttttattaagttcaccttacatttaagtttttgctttgtatgtttaactgctttggtttttggtgtatacaattttatgacttaaatttttatttatgacttgtaaattttttttattacccaatgtccctcttcatctgtttaaggcttctaaacttaaattccactgtatctgttgtaatttctccacagttgttttctttatattagcatttttcaagtatctttactcatccattcatttttcccttttttgtcactgtaagtttttctttttttttaataaaaaaactcctattctctaacccaatatggcaatctccaatggcttttgactactttctaatcctatttctctttttaccatacattttagtgtcaagttggtatacttaattttatttcttatatcttactttagatctcttattttatattgttatttcatcactatcctatttagtatttttactaatttaagttgctattctttcccttgttaatttaaaagttctccagtgctttggccctaaataatacacatatccctcacacattttgagaaaatgtgataccaactatttcccctgctgagacatactttttcctttatctctgcctttccccaatctggtaggttgtgaccttaagaatactttcatcttctttcctcttcctcctttccccttccagaaatctctggaacacttttacccttctcctccactcctcccagcttcagggttttactgaggatagtttggcagtttaggatttagactaacagaatctaccatgaaattatctgcaaaacaaaaataagaatatgtaatacgttttctttaaagagcctatcattataaaggtacatgtgttctcacatgtatgcatatattttttctcaatatttataaacttttcctacccttgatattatcttgatttgcttttaatttaaataatactttttaactgtgtaagtaacatctgaataaattcttactgtaaagaattcaaataagaattctacaagaaagataaactcttacttggccacccctcatcctattcccttccttaaagatactcccttaaagccactgtattagtatgacatacattttttccagactattttccatgtgcttacgtatacaggtatatttataaattattcattgttttgcttttctgtgtgagtgtgtatttactataaattgtatcacataacctgtattgctttgcaactttactttttcacttaatatatttttaagatatgtttctaggtcatgaaatatggtttaacttgatacttttaaacttctaacttgataatactggatagcacggatacagcataggttttttgatggccatttaggctgtttctattaatttgctacttgaaaacagtgcacagtgtctcacatgtcaccctctgcacatgaatgacggtttctataaatatggatatgtggaattgctaagtcaaagagtagatgcttttactactaaactgccacccaagaattgctgtacttatttataaccttgccagaaacgcatgcggtttacattttcaacatttgtgtatgagattgtttttctccacctttgagtagagggtacttcaaaatgtattataaagtcttatatattatcatcacacttttatttatgccagtctatttggtgaaaaaaggttatcttgtgttttaatatgctaactggctggtagtgaggtgagtgtctttcataagttcatcagccatttgtgtttcctctcctgttaactgttaactgttaactgtttctactcttgtcttacttcattttaactcataagaaattctaattcatggaattacatgcttcctgtttcagtcctttatttgtatgtcaaaaaccttttctcctagtctattgcctattttgcctaggtatatagaatatttgatcaaccaaaattttaaaattttgatttagtcaaacagtcctttcctgtatgacttcttggttttatgccttgcttgagaaaatatccaatacactaaaattaaaacaaaaagtcttcagtgttttcttcagtatttacataatttcttgtacatttagggtattaacccatgtaaaatttatatttccttatgtgagatagggctccaattattatcattttcaaatgaattatcaaatgcaccacaaccatttatgcatatgtcatcattccttactgctactattattgtaaaataaattctcatataaaaatgggccttttagacttctcctccctcaatctatttatttcttcttggtccaaacccatactgttctaatagctacaactttatagaatattttgaagtaccacagggtaatttttccaccccatacttctgtgtagttctttattttcaacgcttacttggctactggagaacatttctaacttcccaggtgtattttacaatcagcttgacaagtcccataaaaaattgtgttgtattttgattgaaaatgcatttaattttggattggctctggggaattaacatttttataacattgacttttctcatctcgtggagatatatttccacttattcatttcttccattcttttcttattatgttttcctgtttcattcatttagatcttacatatttcttattaggtttattgctatgtagttcatattttttatttatattatgaatgaaatcttttctcaattacattttccaattggttgttactgatatataagaaatatatcggctcttgcgtgtttttctaatatcagcgtaccttggtgaacttactagctttcaaattttcagaaattcttcacggtttctttcttgctgatgaaaaccttcttattcatcagtaataagtatttaatttgatataatgaatttagaggtaaagtttcagaactgggacataaatctaggtgaacagtataacttcctttcttcatattatttcatggtgactctttttttttgagatacagtctcactctgtcaccttggcatgatttcggctcattgcagcctccgtctcctgggttcaaacgattcttgtgcctcagcttcccgagtagctggggtcacaggcatgacccaccacgcccggctaatttttgtatttttagtagagatggggtcttgcgatgttggccaggttggtctcaaactcctaacctcaggtgatccacctgcctcggcctcccaaagtgctggcattacaggtgtgactcactatgcctggcctttcatggtgacttttaacattcaatgacttcttcctccatccctccatccattatcctttttcctcagcacaaatcaagctataatagaaaaaaggatccctggttcttgccaaatccttcattttacctactgagacctaaagaatttaaatgacttgtttaaagtcacacaacttagcactcagaaagtggcagaattggattagcttcaggaatggctttagagtctctaacatgtaagcagaaataacagtggcttaactaaggctcttttataaattgcatatgcttgtatacactacccattttattattccagagaatgatttgtgtatttcattaattaagtaaattcaattataaattaaatattcgtgtattttatgaatgtgaatgaaataggcaaattttcatgccatgcaaatattgtatgctttcaactgtatacttttaaaaagtaggaaatgggccatatttatattataaaaatctacaagtacatacaaagtggctaaaggaaattatcaaaatacttcagactatagggcaatgaaaagtaaaccccaaaagtgcattcagcattgtgacagattaaagagatgtgggaaatatggggtaaaataatgataaaggaataatataattaaatagttattattggtagtgcaatacattgtactaagtaccttacatatgctaactcacttaactctaaaatatacacacacaacaaccaagaagttagtattgtttttctcctttcaaagaggagataactgaaatttacagagatgaaattacttggcaaggtcatgatattaatgatcagcaaagactgaatttgatcccaggttatttcactccaaagcccttgttctgccttttctatatatattgttttccttagaatccaactagacagatatacacatatcatcgcttttggcaatgctgcattagtacgccaaatcccaggataatatttttaagtattaactgagccacaaatgaatctactgccaaaaagctggtcatgtaacttactgaacattttccgtgaacaccttcaaggacatattatcatcaccagtcaaaaaatcaaaagtcattgtggaagaactcctgatacaagcagctacatggctgatatcaaacatatgtgaagcaaaatgagccagatacaaaagagtatatcttacatgattttgtttaaactcttgaaaagataaagctaacccacggtgacagaaagcagatctgtggttgcctggggctgaggactgagaaggattgattgggaagagaaattagagaatccttttggggtggataaaggaggatgtaaatattcttcagaaacaggtcacaactatatgtagaatgtgtttaatggttcctcttaaccagggtaaagactcagattcattaggaacctgctttggagaagttaatttaatatatgttatgtggatcttcagtgtttcagcagtctggtcagagaccagaagcaaaatttagctactgaaaagaacagtatgatagcttagtgaacaatcaattgtggtaatccacccagatgcaaaaagggtacccaagaacatctcacatgtcctgtcctgatatagaattaagtcagcgagttatttttttccttttagaagtggacataacattgtaatgagaagacagttttccatctgaggcatcagcttgcagattacctctttcatttcagcttttcttgtttttatggcaaattctgctgcaacattaatgataacggctttttgcactcatatcattatgagatctttacgttaattcaaggatctcaatgcctgtcttgaacaatgtcaaatgtaacaatgaaatatgagcaaggcttattggaacacatctgtatgcatctcatgtccgaaagtgtataatgtgttctattttgaaattctgatttcttcacaacataaatatatctattataaaatatgattttgaagacatgattcttatcctcttccattcactagttagctatttgggagggaaaagcaatcataaaaaggaaaagcctgctgtgcgtggtgtgcatgtctgtagtcccagctactcaggaagctgaggcagaagggtcacttgagcctaggagtttgagtctgtggtgtggtatgatcacacctttgaatagttgctgcactccagcctgggcaacatagtgagaccttgtctccaaaagatacaataaaataaaacttaaaaagtgaacagaaaaagctaaaaacaactgttttttttaaagatttgcactttgaatttacaaagatgggtattcaggatctgtcatacttggtaaagatttaaaaacaggcctgaagcaaagaaacaatatgaaatagaaagtgtccgatgcaatgtgaatgaataaagggtaaaagggcagttatgatgcagatgatcatcgtggattaaattttaatttgggattttgtaattaagggattaatttcttaattaatagacaggcttcgcagggtccctgaatatcttgaagttacaagctaatttctctctgtatatagggagaaaacctactgtctttctcagatactcaaaggattctgtgatccagccatggctccccctctttttgaaagttaaccacaagattaaatagatagcttaatccagggcatttccaactcctgcttatctcagacactattcttgctgaaacattcactctgagtcacttggttaaaagcccataaggatctacttagagctaaatatccctagagaatccccagaaatacaaattcccaggaaaatccaacaagtcaataatagaaaatagaaactgatttaatacagtatatttttgggccaatatctcattcactcagaccacagtttctcagaaatcagtgctgagcaaacagatcatttgttgcacctccctgttcccctgccacagagatgcaggtcacaaatctcacaagacgagaaaggaaagaacttctgcatttgttagcttctaacattaaggtactagacatttcaagaatggcccgaggtcacctagtcagcatgtggtgcagaggggatgtgaatctcagcctgcgtggatcttagtggcctttcacttctctcctacctctttggtccacccgacatgcctccttggagttcaatgatttagtcagtccactccatctgaaccatttcccaaagctgctcgttagactgagggcacatttctcatgccaagctctttctattccttaattcgggtacatttccaatttattacccccatggcgtagtagaaagggtacaatgctgataatcaggactcctggaatcgagccgctactcttctctaaacagaatgtgcaaccttgcaaaaggcaagtatcaatctgagtgtccaataaccagggaggggggtagattatatgatcttgaaagttgagatataataatatatgattctattattccttggcataaacatgtttctagggcaaatgatttgatcatgttactaggttattagatccatgtccttattcagggaaatatctattatgcccacaacagtgttgtctataactctgattatttggacaccacccaaatgtattgaatttgatttttccaaggtgtagcacattgtcaagtccaaacagaccattaaatgtcttttaattggctgattcattgaacaccactgcaatatcctttccttatgtaggcctgggaaaagtcatgaagtgacatttggaagtgagggcctaagcgggcagtgggtaatttaaggcaggaagctttggaccggagagaaccctggctaagaagaagccgcagcctctaggggctcatctccctgtttgtaaaacagcactaataccctgggcctattgtaaagatgcagtgagatgccttctgcttgctaaaaaggtatagaacaatctcaaagctttatcaatgtaactacaaggtatctgtttgggaaatggcatatttgaccacactggccttcagccaacccagtttcatagaaacactttgctaccttagtacagcacatgttaacctgctagaactgcagggactacttctcctaatgagacactcttgcaaagattctcaggctccttttaattatgttattttacagaaactctgctgatccttctgctttcctacttctgaggtaggaaagggcagagatttatcaaccacagagtatggctggaggcagtggtgacatgtttgtgtggcctttctccggtcaccagtgagtcacagtggcatcggcttcctatcagggtctgtgacatacagggcaatgtccgtcattccagtgagactccttgcaggtgaatggccttccaaatttttcagaaaagcattttttttcaagcatttttttttctgttcttgattttgagatgttaggccgacagtgattgacagaaactgacccaggtaagacatacaaactgctttaaaggcggaaaagtttgctagaaagctattgcatgaagatggttttatgaacaggagacttggtaacatttcctcggtctctcaagtttcacaaaagtgcactatcatctcatctgtctggagatttctattaggatttttgaaaacttgacctgagcttgtgtgtgcttgtatatgaggtagtagatggaagtggggtgtgtctttttgcctttgaatctggcccaactgttctagtgcagccaggtgtaagctataaaccagtggcattaggatatgagagtatcttgccctgagaatctttatcttcatccccctgatcacactgggggctactgtgagcccagtcccagtgtatttctgagcagctgcagcaggccaggcacaactgaaggttaaccccgcttgcctctagggtctggccatcccgggctgcacggggcttcagtggccttcctgcagttctcttcccaaggaggctcagcctgttctggttttgctaagagaccctggatgcgtctatttgcctcgttggtatctaccctcccctcccttccttgacccatgcagccaagattcaggacttcaaagacatccttccttcctgcagcccgacaggttaaagatttgttcccaagtctcctgaagagctgcgtcagattgcaaatcactggccagttccagaaagctgctcccaagtgtttcagggcagctcttagaccagtgcaccctcgtggtaagagaggtgacagaacaaagccagaattgcttttcatttctggaaacactagtctttcatgtcagagtttaggttacttaatcttttcgtgccgggaataagatttccctagtgtgacatctgctgatagcaatggacagtccatgatttccagcgccaagaaattaatactctaatctgcataatcaaatccccaggtaagcatcaccattcctttctcagtactttctgtcccttgcatttccaaatccttctatttatccaaaactcagaatgaaaatgtagtgcttaataacaatttttactaggggagtttttaggttactatgatagacatttactgcacaaaatttactaaattcaggataatcaggttttcttatgtgtttgaaatatgataaaaatatatatcgcctgaatgtttcatgctacagggtgcattttgtgaatttacacttcaatcacttagtctactgcaatataatgttgatttatgttcagggtttgaacctctattcaatgttgaaatccttaaaacaaactttagacacagagggctcttcacttttccattagacttcttaatccagtttaactatatccttcttcagttaaaaagctagaaagaagtgttgttgaaggtcacagtgacagaaatttcagccagcatgacactcctggaggttattgttttcctacagagctggatgagttaatctggtattgttgcaagaggttgggaaggccaaacaaggccgaatcagggtaagacaattttatagtcttacagctataattaaatccaggacctgggatcaatgtaaatataaatcccagtattagtcctgaatttagttcacaaattgctttttggaaactgttaccctagcaaactcctatttattcttcaaagtcaaggttagctgtgaccacaccctagaaggctttcctgacacccagaatagtgtttgtcactttttcctctgaggaccttggatggtatatgtttctgttgcatttactactctactgcacaactgtttgtttatattatctatctccttattaaatgatgacctttttaagtctgaaactgtgtctaaactatctctgtgtcctcaggagctagtacactaccaaggacatagtgctcaatgaatttttgttgaaataatgaataaagcaatatattctggctgtcccatgaatatgattgtgcagcatagtgcccaggtgttctgagcacatgcaccaagttttaaattaaactgccaccactttcagggcagagaaagaaaagcaggttgcaggccaattctggtccatggttgccttattgggtttcctcagtgtcattaaatagctgaactaggtgttagccaacatttaaaatttgagagactacatgcaaaagtctgcatttctagcttcttacaattttcaaagctatggcgacatctagctagcatttccatggggcctaactggctggggctggctgcagggcacacaacttcctttcctgcttccttcacctggcttagccccttaaggcatctgatctccgagcatgagagttttcattgttttggtgagaggatggtttatgtaaagccagccacatagtaatacagattgacacatatgatgggaagtcagccatgtgctcttgaaagcaattaatacctattaatacaattaatacatatatctaattttaggaggatatgaagaatagaaatttaggtgccttccattaagttacttaaaatttaagagggagtagaatggggagataaaaacccatgaaacaatatggaaacatcagtccccctgaccaaaggcacattcatataatacaatctctacagcttacggagccaacaattccaagacagaacctatgtctgcagtctcactggccacaggaagaaataaaacaaaacaaataacaacaaaacacctgaaactcatttaaaaggagagataatttcccctaattatcctgacccatctaaacataatatttcaaagcttgccttcttcactttaaatacacagcaccctaagcactgctctcactcccttctgctcttccctcccttggagccacttcatttgtgaaaccacctccctgtacctctgttacaagcatttccatttgcctggtttcacgtaatccttagttcactcagcatttattgaggctcacgtgtattccagttgtgtactaggaggattcaaaggtcaaaacaaggtttttgtccctaagaaaataaaggccaaatcaagcaagaaaagagtaggaatcctaccttgatttccttataacagaccacatacaccttacgtgataatgctgactataagctgatgggaacacaacatttagtcatgatgcatggactggtaagctctgggtcttgttcaaagaaaaaaaacacacccctcaattgctttgggaatgaagagcaaaggtatgcaaaaagaattgtagcatacttacaaagtaacatatcaatgctgccaggacttagtgagcaaggtgtgagtaggagattgagtggggcagggagttgtgatcttattccaggagtacctccaaagcatatgaatttagaaaccagattgtgaggaagagaatttctcatgcctttgcacagtgtattctttctggatggcatttatactttctcttgtccacctggagtcacatggaggcatggcttcctctgctgggccttccccagggccctctgcaagcggagctaggattccacttgccccacgcctgtctctgctcagctgctatagcttcccacatgccttttagaacatcatttccctttcaggcttaattgtagaccacaggcccttgagcaaatgcattttgccatggactcctcagcactgacattactttgggtgctcccaatttggtaatcgaatgaagaggagtggcaggggtggggtgggcaggagtagagtagcattttgaacagaaaaatgacatacaaagtggaacagttgaaggaaaacctatgtcatgctctgtggagtgaaagtatttctgcttggctgaagtaaagaatttgtgtcaggaaaaaaagaaaaatgaggctgttgaagtgtgaagcaagtctatagagggtcttgggcatattatgaagagggaaaaatcacatcttgccataaccctgatgattctttcttgtcttttgtatagctcttacttgatcccaaaccaacctcacgtgttacatctcatcatcgaaagccttgctctgcaggaactgtgtgatttttcaaagtgtcccttacctctcaaaggggccactttctgcacgtctggcaggttaatatcctttccagtgcttagtgcatgacacagaatacctgctgcacattctccatatgttttcatgtctggccagtgcccataatgaaaccaccaatgtcctgtaaccatgcaggatgacaggctcaccaccagtggatactctgccatctgagccctggtgttactcagcatccctgaagcatcactggctgctcctcctgtcaccctgtgggtgtttctaaattagatatcaggtttgtagggcaggactggaggcgcctccatggctggtccacacaaacagccaaggggcagagttcatccattccagaaactcataaggtgaacttatatcccaacagcgtgggaagccaggtagatgcttcaaacttgtgtggatgttcttgcctcttctcccaactccttcttagtttgtgtctcaagagaggccagaatcgatcagaatgaaaagcttccatcacagaaactcaagaaccacagttccattctttaccttcttctttactcactcacctacccctcccttattgctctcaccacaggctacctgcttaactagtcttttttcttttcatctttttgtctcacttcaactacatatatgtgaaagaaccccaaaggcagatgttttgaaaaagcaaaatacatacatttaaaagtgtataatggttgggtgcaatggcttatgactgtaatcccagcactttagggggctgaggcaggtggatcacaaggtcaggagatcaagaccatcctggctaacacagtgaaaccccatctctactaaaaatacaaaaaattagccaggcatggtggcgggcgcctgtagtcccagctactcgggaggctgaggcaggagaatggcgtgaacccgggaggcaaagcttgcatagaccactgatactacatgaactccagtatggggaaagttcactgaggactgctgaggccctggctggccccttgctgggacagctgtttcttatatgttattttcctttatttcacagctggatctcacagtgggatgcttggcttgtggacaggtggaaaggaaagtgtgcagtgtcttgccagatcagactcatggatagatttacactgaaaataaagactaagagaaaaaaaaagcggaacaagtagaatgtaaaagccctctcatcttactggaaataatgatataaaacactagcaaaaacaaaaagtccgcattctaagaagtaacagcaaatttttgcaccttggttctaagctgtcagatcctccactgttgatgtgaatcatctaccctataaaattcttttcttcctaacttggcctaaggatatcagtagtaggactttttgaaatatcagatgaaaaagaaaagaaaacattgtcttaatctaagaatacgagaataatgtcccatcaggataatggttacacaggtatcccaaacaagtaaaagacagaacacataggaaggggaaaatcttagatgccgcatttcagaaatgtgtaaagatggtaggctccttattgggattgtactgcagaagccctctgatctgactcaatcctaggtgagccagttaattcaaatgtcacctagaatagggaatcagaaaatttgtcctcttactcatttatgttccacgcagagggagcaccaattggaggcgaaaggggggacttaatttcaacagattttcaggtttaaatccttggtctgtcaaatacctgctacaggacttagcctgtctatgccaaagtatccccattggtaaaacgggtgcaatgataggtcctaccccatgggactgtgataaagatgaaattggtgagtgctgtaaagtttgtagaatagagtctgacacatggtaagcactactatgtatttggtaagtgacatttttggtagggccaaggctgcttctttgcttagagatctttttgttggaatcttccattatctttttttttttaatttggcatcaacacacactttatacattgtctatgattcctaatttttgttttccttaacaatggtacaggaacttaaaggcatttgaggagcagtttgcatgcagaattgttccacatttaatacaatttctggtctcccacaatttatttttatagttagacaactatatttaatgtgatcacaaatactactttagcagacctactaagttacaaaaataactcattcttggcaagtattcagctcaactggtaagacaaataagtgtacatggtagagagctctttactagctgccaacattcattaagttgagggcattgttcagtgtgatttgaaagggggaatgctgagcatcagtgaatccagacaagtaggttcaaatgagcttagttaggagattccagtctctgtaagaacattacttttggattttgtttgctatcccgccatctcaattccttggaatttagttccaatgttgattttaatatggaggggggtcttgttaatctgatttattgccacccatagtcccagagatatcattctagaaaatgaaatcaatagagaagtttgttgtcaatcttaagattttaatttcagcttaggcctttcttatttccatcatggacctggctccctttgtaagtttaccagaatctgtcaactaatcctcagagcactccctttctgtctctcccacataagaatttgctaaatgatatccatataacctcttattctgtatttttaagggacaaagaattggctgtttcttataagttattttcctttatactatttataatttgtctacctaaatcacaatgtgttcataactcttctttctgtatttcttttcaggtagcaactttggaatatagagaatcattaggctgtattcaacaaataataactaatgcagccttctaagaagtgcaaaaaaactacttagaaatctgctataatgaatccaaagaccatgggcagcagctatagggtcaataatatttggaaccagggacacactggtggatttgctgcccccacccaccacatcctcagacatactgggctggaacacatgactgtgtagtgcctcaacattcatgtaagacaggaaaacttcaaaagaggtgggagcacaaacctctcttaagtttatgcaaaataactctccagaacaatgaattattatttgttcattattccactcaacgcataatgactgagcatccataggtgtaaagcaagtttggaatgattgtattttagctccactgtatatattttgtttctcaaaccctaaagtactatcagaaaatgaaaagccatgagtgaaataattaacacaccatctgaaaagccagtcatgtcctctgtcttggattatgagctccaagatgttaagagggcaggtatcacactttatatcattattcttcacagaactattaacagcccatcttttataaatattatttaaattagaatggctcctggagggagtactatttggggagaaatatgaagtgtgttggctgaaaacacctaatgaataaacactgatgtctattgttagcatacacatcatcccctgatctctgagtatgaatttaagaaatttgtgacagccaatgaaaatgcttatatacccatagcacgtgtgtttaccatgcaaataaatgatcacaattcataaacagggactgtagagtcttaaacactacttcagaaaggcctcaagttacaacaggcagaacagaaaaaaaatcaggaacatgcaacagcttttaaaagtaattctaatattgaatcttgatgatgagattgcaaaagaaacacaattttttataaatgcaagatcccctatgacaaatatttacggtggtcaggaacagaaaacagaatagagatagatgacttcgctcccaccccacaaaatttttgagtcataaattatgaattatgttcaaacatataaggcagagaggaaattaatttaggagatgagatctattttataattcagagagctgttttattttaatttggggggcaaattacattttgatgttcagcttaccgaacatctttctttctctgaaatgaattacaatttcccgttatttctctgaggagtcctaagatttttattccaaaattcagagggtaaattagcaacacagtctggatcatttggaaaaataccgtccagcagagctttccacaatgatgataatgttgtccacgtgtgctgtctactaaggtagtccctggccacatgtggcttttgatgactggaaatgtggctagttggacatagaaacttaattttaatttaatttaaatttttaaaattaaaatttaaatagccctacatggctagtggttatagtgctggacagtatcatccagatgaccacaggatggacaaggaccttcctctcagccaattagaccacgcagtggtgggccgccctttgcacattgcacactgcccctgtgaaacctcgatgcagtctttgacagcttagcctcagaagggcttgggggcaaagctcatgggagcttgtttaagcaaatatacacattaataggatcacaaagatcggaaacagcaaaggtcagccctgcagacccctctccccattcatatgtttccctgcagtgggacatattctctagtgctttgtcaggaacagcttcaaatcgactcaaatggcttgactttccacagctttccatgttatgaaggcaagtaaaaaaaaatagttcagtgagagcacttagaaaaagacaacctgtaaaaatactgagatagaaacaggagacgttctgttataagaaggaactctgcatagagagagatataaaagaaaaacaaaccccacatgtatttttgatcataaagagtttgaaataaaaaaaatgtgctttggcactacataaaattcttccttgattatcacagtatgcaagattactaatgctggtccccaaagcaatcaattatttcctaactcctttccatggttccatttagtttactacagaacatcttctgattgtcccttttgcctgtttattatttgttagtgcatttccttatctgcatgtagctttaaaaagtcaagaacttcagacaccttcaaatttaatgacataacttgagaaaggaaagaattgggattctgatgcaatatgccttgctcatgaagatgttgctaacttctgaacttaagtaacttcctgtcaatagcatttcagtagcaaagattgttttccagataaacacatacctggaggagcagatcagaagtgggtctgactcgctgttggaataggatgcttagtgttcgattctgctgttccaaatcaaacactcttgttttcaacttcacacattcctctcttagatcctacaacaaacacatcgaaggaggaaaaagtccataactgaaagatgtctttgcatattataaccatattttatatatctcagatcattagtaaaaaacggtatttttattcttcaaagcccccagaagtaaatcacatacgttttcgtccacagaccattgtctgatagaattattatgtgcaaagaagaccaattttttttaaaaaagcaccttgaaatcagaaatgcattaatctagcatgctatttttgaagacagtaaatcttagcgatatgaagtcaatttaagtttccgcctatatattttgccttttcactgtctttataaaagcaatcatagagcacaaaccacaaggacaacaacagtgtttctgcagggaatagagatttgatgagctaaagaaactatcatttctgatggagtttttcattgtcatttgtgaaaacaagttgaaattctcggtgatggggctaatagagtcagtgatgcatttagcgggagagaaatagctccgaagagatggcttttaaaaggccacttgccacttgcccatcctctgaactcatggatttccataccttctggggctttctggtctcagtgctgggtaagaagcacacttagcccattctggcatctgtttggagcagctcttttgaatagttcaaacaccacagagaccttttccccagctcatggaggaagctgatgtactagaactgccttccaaactgactgcaataaaggaacttgcggtacttaaatatctatgccctttttgatggaattcaaggcagacgcagtagaataaaacccaaattcaaggttcttcaaaagctgacccttttctgcatttcaaactatctttcactacttcctgatgttaataaaaaaaaaaatgtcttctgttctcaccaagcagagaacaaaggtctggcgtgttgttctctaaagctctacgcattccttctaccttcttctcttttccttccactgccacttttccttcttatccaccttcttctttcagcccatatttggctctttgattgaagtacagttcaaactttatcacctctctgaccttttacctggcatccctcaatacctgctccattttctgaactcccatcagccctcaatgcctcctttgtgacggttagcatatattactctgtattcattttatcgtttgtgctctagacttgtcaattacacgacacatttttcaccagacaagctcaagaagatactgaaataaccacaccagcatattgctcttacattgtttttattccatcacctagcacaatgccacacatagtaggagcttaataagtgctcacaattattttgctaaaggggatgatgatggcaaattctattcactagtgattggtgtgataaagagcgtttaagtttctcaacacttctacttcaaagatttatgtattctgatgtggggcagctacctattgggcttaaggctctgcaagcaagggagagcccaagccacagttctgatgcctagggcctaaataggagtcacagagttacctgggcctgccataaccttgtatgaatctaatggtgaagttagatctcgctagtaaagccttctctgaggcttgatgagcatgcatcatcttatccagtagtattaattctattaaagggggcaaagaaacaggccaaggtatagcccactacagtttcaactctccttgccttttttagttaaatgggtaaagcttatgtatagggtgttttcaactgatcggtgcctacaaatggagagcagagaaaagaaatgtcatgttcagaatgacgtgcaagagtgcaagatccagcagggcaggatcacgagtgcacattttgtactcatgagcacacatgccatttggcagaggccattgtgaggacccactcactgctcaaattaaaaggtgcaacttcagcctggccaacatggcaaaaccccatctttactaaaactacaaaaattaggcaagtgtgcacgcctgtagtcccagctactcgggaggctgatgcacaagaatcacttgaacccaggaggcaaagattgccgtcagccgagatcgtgccactgctttccagcctgggcaacaaagtctcaaaaaaacccagtctcaaaaaaaaaaaaaccaaaaaaaaacaaaggtgaaactttctttatttttatttattttattttattttattttgagacagagtttcactcttgttgtccaggctggagtgcagtggcgcgatcttggtgcactgcaacctccacctcccgggttcaggcgattcttctacctcagcctcctgagtagctgggactacaggcatgtgccaccacgcctggctaatttttgtatttttagtagagacagggtttcaccatattggccaggctggtctcgaactcctgatctcgtgatccacccaccttggcctcccaaagtgctgggattacaggcatgaaccaccatgcccggcaaaacttgctttctttatttagaattcaacctctgtctgtgtctcatgctgatttttgttcttagcatgtatataacactctctgctcccaaacactaattgtttttagtactgctaattaagtagttaataagacttgactgtgaggcagataaatattaatagtacctattggatgggaaaacacaatcatcctcatttgcaacatagagatatggaaacggaagcatacagtgtggatatgcaagtaaaaggggacctgaaagcaatagtaaccacgatttttagcagcaaaactgagaataccttgaaagagttcttcagatgggtaaaaaaaaaaaaaaaagaaaaagaaagaatgaaagaaaaaaatcaatatactttatagagagtctttacacaagtgcccaaatttcaaaggccattagtattacttaaggtatggtaaaagttcattagtgggaacacaatttatcgaccctgagaactctctgttcatcactattggcacatccagctcagcacacagcagcagggaagacagaggctttagggttgtgacactgatctgatggccattgacaaacagaaatgagctgctctgaaaatctgtagataggaaagaatcgcttgcgttgtttttaatattcttattttcttcagacaagctgtggatcaccagtaactgatgccagagagttgccttcccaagaaactgtaaacaaaaacacccatgtgcccatgtacacactcataaacacaatcagaatggatatatataaacaactgttttgctaaccactattgtagtacctggatggagggggcagatggctgtcttagcttcctctatgctcccaacaggaacactttgacataaaggaatgcatgactgcatgatacatttaggctggatgcaagagcagctactctgaccctgccagttcagaggcaagacccagaacagcctccccaaggaaggctttagaaacaaaagaactctcctctggataggtgccatagtctgggatcatggctcaagggagaggctgtactatgtatcctctctcataatccttctttttcttctatgacttcctggcatgtatcagacctcaagaaagaacctcactgaaaatataagattgtgtcttcagataagaaaatggggacataacataaatatttatcatggaggaataatgccaaagatttgactacatttaatatcatgaaaaaaaaaaaggtacagtggtgtttgggttcaagaaaatactcagacctgttttccttgcactcttcatgttactatcaattggaaacagagacttaagagattacagctgagcaatgtgatacactggtctaatgggctcctgtgcatcttaatgatcccaaaccataatttctctggaggatccacacactgtaatcctgataaattccccctgtgcttgggctaaagatgattctagactcactgctatatagtacctataggagtacagttactttatgtattgaagagtaaaattgttatcagctctaggctgaagtacattttttaaaatgctgattgcttagaagcaggacatacactaacatgatcgctggtgtgtcattgaaaactatttaaatctgattttaccaagtaaaaatgacatgatagtggtatacctatttcagaggcagtgtctatcatgggaatacatggaattggggcttagagggcctgggctctagtcttcattgtccacagggccttgaagtgattgcttctgattaggtctcagtttcctcatctgtaaaccaaggcactgcacaaaattgggcttctgttcaaaacactgtatctctcactagcttcatgggatgtcttttcgagtgctgctttgttccctccctgaagcctaatggccaccaaaaccaccagcctcttttgtcataccctttcttggtggctttcactgatacatccttatctctgccccaaatgctaagacttttgtaacatgaaaagccacttctggaaaaggctggtcacatctcagactgatccagggcttcaacatcgaatactaaaaggcaagacaggtgacataaaagtctgactgaaccaggatactgcacaggaagtagtgagtcctgtggcaaaatacatactgcaagtctccaccctaaaagccttcggattaaaccacttataatgagggcaatggctaaacagttcacgtaactacagtcacttgagcccattaccaaagctagttgacaatctcaggattaaatactcaccaaggctcctggaaattggggaatttgggagttaaaaataagattgattttgagaaagcttgaccccaaatatatagagtcagttttactccacagctatcaaactctaaatgctcttcctgctacagaagataagcaatacttccagaagttttaggaagtcctgtggctaccctgccttttattttattccctgtgatcataaccagccgttggatttcaatccttcttttgattttcatggtatctctctctgtcctactgaactatgggggagaaaaacaagtgacagaatgggattgtggaggaagaatgagggagtgggtcagagcgtggggtttacagtgcaacagccataattaaagcaagggctctgccactgcctggcagttgaaactatgagcaaactttttttttagtcctacctcacggggctgccttgagaacaaaacgactttgtggatttaaagtgctgcatgtggggtctgaaggcttgtaaatgcctgctaaatataaacagccacctgataccacacagaccactgctagagaagtggacacggatggttcaattgcccctttacaggggaaataggaatttggagttttctcaggtacaagctataaaattgttttctgtttctgcctgaatggctggattctaccatacccagctttattccatgtcggtgaagaaaacacatcatcgaaatatgtgtttcctccaaagaacatgcagataagcctgagactgttcatatgaacgaaaataactgcagagaaaatgcctttcttccgtgttttgtttagtggcaaacaagcaaacaaacaaaaaacaaacccaaaacactgaagaacctaggtgagttacattttctgcaaatgtaattgacttaatgaagataaaatatatttcagataacaatatgaatttaacctgaattactgatttaattcgcacttgtagacttggacccatgatttggaggcatcaaaggaagaaaagttgggtttaatatgatcacttttgtattgttgttctaaaggggtacagtccattctcctaagggaatccacaggtttttgagataaactaaattacttgacgaggtacactgaacagaaactgctaagttcatggaaataattttttttttctatcagtatcagtagactctgttacttcaggatacttgtctgggccaattcatgatatgccatgaaaaatgtatttctggctgcccagtgaagagctgaagccacagcagatttgcctttgtgtcataactaatggcatattctaaaactgcacagtaatgcttattatttcacctcaaggatcttctggtgacttagataaatcgctcaagatttttttctgttttgtctttgctacctacattcctttttggaattatttttctcatctgcatttggagtacactgtatattttatattgtgctcttaattaaaaagaaattttagtctttttgcagcaattttacagtgcccataaaaactggaggcacacatttctgcagaacatgattcttttggaatctccaaaagcccccagcatctctttctgcctcatagtgtccctgaggtatgctatctcacagtagcatgtctttctgtgtctcactgcttaattgtaccaaggtagatttatctgtttactagttattacttggatttgtgtagctatttttttttttgtagctgacctgaagggtcccgttttcctttttatcgtaccaaatggcttccttgtctctttcctgaggcaccattaacaaaagcagccatgggaagtctttcaacagttgtacacagagctgcaataacactcccctcactccttaggtttgtaactaagtcagcatagagtttcaaacaggagaaaaacaatcgagaaattaaagccttagaaaaagaaaaagaattcaaaaatgttgaagcagcaattataatttgtcctccaatatctatttctcaccttcttccaaagtaatttcagctgggcacacacccagaacaaagacctctttgccgggtttgtttggtgtggctgtgtgagtaaggtctgttcacagagatgtatgtagtaatgtatgaaagcttttggaagtgtcctttaaaagacagctgctgtatgccctttatcatcttcatattcctcagcttttattcccttcctgatggctggaatgtgtggatgtgatgactggagctagcatagtccttttggaccatgaagtgaccttgaaaatggggccacattccatgaaatacagagatggaagctagggaccccaaggactttatggagcaaagttaccattcctgttcggcctacctgtcggtttatatgtgagaaagaactaacattttagcttatttaacccacctcattatggatctctgttgctcacaatggaacctaattctaactctacgtaagtgtactcaaatctatttatgcatgttagtataaaactggaagcagttaaaattatttgtagaaggaactgtgacattttgacagaaatagtaggcaagaaagtctagcaaaagtatcacaatgcctgtatcatagaaattttaaagaatatttaagtatctccatgagcagcagtcaacccctaataaaattattttcaattaaaaaaatcaaaatggcataaattattttgctgccatttatcacatcatcctgaatatgctgcaggatctaaaagtttcttttggagaagtctctatttcacagatagaaatcaaagtaaacaaaatctgagggaactaaaatttagcttctcagaaacttcatggccggagatggtaaacattccataaaattcactgaaatagccaaatttgggcaaaattgacctgcatttactgtctgccccaataatgtgatctgatgttgtctgcaggcagaatggcaaggcagcaaactcataggtatggaaatttcaggcacagtggttaccattattttatatgtaccacaaactattgcagtaactgttctacatgcttccttttgtagggtcaccacagcaatcccaggaagcgggaattgttattcccacattacagaagaggaactagggctcagggaaattaaatgacttccctaactcttgctgaattttagacttttgttaatgctgtccaaaagaagatactcgttttataggaattgggagaattcaccaacttattgcaagtttgtatttactaaataaaaatggtgggtttgctactcatctgggtaaatgaaaatcaccttcaaaaggctttctattattttaccgaaagtttggattttttattacaaattctattggtcactgatgttacttcatatgccatgtaaaacacaaacgattttcactaagtgaataaatacagaagtattgcatctatcaatcacaatttcctagcttaacaacatgagctccaatatagtcacaaaagtgccttgaaaagaacaaagtcagaaagtgacctaccttttgagtaagcagagcttgaacaacttggttggctacctttaaaaaataaagaaaaagttgtcatttataataatgagactttatatgcaccgactctaatttaccaataagtttctcgcagcttattgtagctaattagctcctcatttgcctctttcctctatatgcagagatctgattattttcataataagtctatccttctaggtaatattttgctttctccaaaggtgaccttgttgctaattaagatggttacacttaaaagatcattcataccttgactttcacatttccatatttggaaaaatgatatcctttcatatactccaagaaggctaaaaaatgatatagtgcaaaacacagtcctaattatctgtccacagtttctacactttgctgatttacaatatcctttgcctgtccttcctattcctttgctgtctatttcactgcttaatattacttgcaatagagataggttgaatggtctagcatagggacaactcattgtttcctatgtgtcctgctttcatcttcaatgtttttgcttaagtcacgctcttgttgttgctacctgtaatataatctggtagttgtttactacaacatccattttttcccttcttcctgagtaacaaacccaatcttttggggctgggcacattcaactgcatttcccagccattcttgtagcaaaatgttgccatgtgacaaaattctggccaataagacataagcagactattctcttgggcttacaggaagtctcaaagaagaagggggctcacccttcgtcttcctgactagaaatggaagtacagtaatggctggagcttcagcagctaccctgacaacaacagtcacatattaaggatatttggacagagaaaagcttggtcctgatgatgttatggagctgtactgtctattgaatatctatgtggtggaaataaggtagtcactgttattttgagtttcttccagcgaacaacaaaatataattcttagtaattttttcagggatctcattttcttcaagtatcaggcagcttgagacagcagaagaacctaaatccctcctcagcccaaggcagtgaatcttgattaatctaagccaatcttggcaattccagtgattggtttaggagtgggcatataacacaattccagctaaggaccacatgtaaaaccagtaacatgttcctggtgtttcaaatacctggcattttctccaggtaaccattcgttattactgtatgtatttgtgttaagatttctttttcatctgcatatttcaaaatactttgcatagagtcacctactaaacttcactattaccttgaagctatgtagctacatggctactgttgataaaattaaggtggacaggtgaactaggtggtatttttcagctaatacatacactgtaaacatttaatgtgataactgaaattgacagcatgaaagactaaatcagaatacttaaatatcctagatataaggcactctggttcattcatttcttccttcatttatccaatataaattttctgagtatctacttgcaaagctagatgattgggccatggtccttgacttcaaagactcatacctggcagtgagttggcaaaaacacaattataacacagtgtgacaaacatctaatcatcatggtaattcttacagtcaacgggagactgagggacacttttgtgttatttttctcttggtaacatatttgtttttggtggtgcccaactatttgtgcttctttctctatctagtatagtcgaacagattatagtaagaatgtttccatggagcttaattgttttttgactcaatactggcaaatagtacatccttcacaacagctggctaccagtaagtctcatagaaaattaaaacacaggctgtcatcaacttttgattagaaggcaatcacaccacaagcagtaaaagactaaaatcagattatctgtaattgattagttaaattatatgcacaagaaggatttttttcccatcagaagtcttttcaaagttacattgcagacattaagtaaaaaagaaaggctcttcattgaaactatgattttaaataaaatgttttcttaggtattgtttttgagtgaagcacaagttacagaactaccacagaccaaaataaactatactttcattaactgaggccatatgttcctttatcactttatttatatgtgatcacaacagtgataaatgttatccaacccacacaaattgaccaatagcataatagtgaaagtcagttttccagcattcattccaattcataagtaactgagaattcaaagtcaaactacatatcatctattttattgttggcaaataaacaaaacaaaacaaaacaaaacagaagaatcgaactattcatgcaggttgaatcaggaacaaggtaccaaagttaattcatgccataaataatttacttcttttggatctcaaactttggatttgatttacattctcataaaactgcccaatatcaatattttcttttctttctcccaattggtctctcactgaaaccattctggtaacggtggtcacataaaatagctctatccatgatttatcaggagacacggactaatatcctaactctaacagcccacaggaggaaatatgttatatctcacaatccaagcagttgccctataggcttagagactctatatctaacacagttccttctggcatgtactttggaaaattatttgctcctcttgaaagctgaacaaagatacacgaatgccttatttctttacctactgacatgaggttatattacctagaaggactcactgcgcttctttgaaaaatatcaggcagattatagacatgctttcctccatactgtctataacgacagtgtccgaggttttgttatcgcttttaacagctaacttccctgatgcataaataggacagctgtttggagtttgtgcctgcaacctctactaggctcaaaagataatgcctggaatgcgtccctgccctcaagctaacattatgccctaaacatttgggttgcaaataatcacacacccataggcccagctagtgagaacaaatcacttccaatgtcatctgccagctttcctctccagagaaagggcagcagctgtgctaggctgcaagggacttgaagcacactggaaaaacaaagctggcagtccttaagccactagcttgtagtacagccttccttaggctgtccatggaggcctctcccctttgctcctaggagatggagcagggctgcaggtgagacaggaatgccaaggagagcgcctgagtacatctcgtgtttccttctcagtaagaattttctcagacaatctagctcctctaacacatggctgatcttctactcacacaaaactttgctcttcttccctgaaaaacttccagggctcgtgattcctccatgcactctcttggaagtgggcgagcagagggaggaaaagctggggctatggagttctctattattttattgaaaaacagtccttgaagctgaataagaagccacactaagcagtttattcagagagggagccaattctcagccaagggctggggtggagggtggagaagcttcaggtttacgggcgtggggagcgaggatctccatgctctatgctttgacagtcctctcctggctagtgggcttgctttcatatcttcatgagctatttcaccatgaaaagccactgtcatgtcaacaaagtaactgaaaaatctcatcagaaaaagtatgtgtttttgaaaatgtgctttggagaggtgttctatgcttctgatcttggttgattgtactgaggcagctaggagaaagcatggagaatatggacttgggttaaaacagtgcctatgttaacctcatacactgacatgcgcaggggatgggagagaaatctgacttttctcagccataaaataggggagctgcctacctctaaagttgtgaaaaaggcatgagatgatagacataatcagcgaaaccacctaggacaggacttgatataaagccgtcacccctaaatgtgaatcaggccagttgaacttcggaaaatataatgcatgttcaggtaagcagttaagaaaaaattattttattttattttattattttgagacagagtctcactttgtcacccaggctggagtgcagtagcacgatctcggctcactgcaagctctgcctcccgggttcacgccattctcctgcctcagcctctggagtagctgggactacaggcgcccaccaccatgcccagctcattttatttatttttttgtatttttagtggagatggggtttcaccatatcagccaggatggtctcgatctcctgacctcatgatccgcccgcctcggcctcccaaagagctgggattacaggcgtgagccactgcgcccagccgaaaaaatgttttttaagaataagggattctacttggaaaggcgtgaggggtatgtatatgtgtgcgtgtgtttgtgtgtgtgtccacataatatacatgtataaatgtaagtcactaagcatctgtattattcatttactttgtgaaacaatcctgtaagatagaaacaagaaagaaactcgaagaggtaaatacacagccccatacaacattggaaaagggtgaacagtgaaccctagtctgcctaatccaaagcccatgaagttctcttctaattcaaatcagactatttgaagtgggtccactatttttttcagctgattaatctttggattattacttgggttagtgcataataaatgagtgctcatctctgaagagataactgaagaaattagtgtaaatatatatgtgggatttggggaaacactaatttggaaattaatttcctgctgatactgtccattcattcatttagtcattcaacaaatatgcattaggcacctagtgtgggccgggaatctgctgggtcctgcaaaaataatgaggaaacaaatacagggactgcctccagggcgatagaatctggagcaaacaaggagtagatcatctgtaatttccaagaaatgagtattttgaacatatgaaagtgacaagtacgatcgtcttccatttctttcaagaccttgatttttttttttttttttttttttgagatggagtctcgctctgtcacccaggctggagtgcagtggcgcaatctcagctcactgcgaccttcacctcccgagttcaagtgattctcctgcttcagcctcccaagtagctaggcctacaggctcccaccaccatgcctggttaattttctgtatttttagtagagacgaggtttcactatgttggctaggctggtctcgcactcctgaccttgtgatccacccgccttggcctcccaaagtgttgggattacaggtgtgagccaccatgcccggccaaaaccttgattttaaagatgacgtagggcccagctgtaggatatgcctgagagtgtcctgggaatgattctacaatctaggctaggcatgtagcatgtggatcagagagacaggtgagaaatagtctcagcaacctacttccacccttacttaaaattctatttttgtctatttctgaactacatccaaaggcctagttttcaatgtccttgcgctctgaagtgtagaggttggaaaataactcaactccaccgtcgtcactgactgtaagggcccagctctgattggagaggaagaagcagtttctccaacttttcgtgcagaagctcctcctggaatgtttgtgaaaattgccaatttcctgtccctgcatactgattgggaaggtctgaatgaggtctacggatatgcaattttagcaaccaccacacatctttctgatgcaaagggctcccagaaacacaccttgagaaacactgggatatggtttattttattttattttattttattttattgcctgtagctttatattatctcagacattgttgtggaatcagaagtactttaaaacttccacatgggtctgtgctcttctgttactgtatctaaacttggtggagggagctttcatccttctactgaaaatttctgaaaatgctctctacagcacagcattcagataatctaattgtggtgttcttaaccccaggtgaatattataatctcctgtggtgctttaaaaaaacagaaagcccaggctccacccaagagcagagtcagatgggaatctctgaggtgtgacacagccagcagtatttttaaaggtccccaggtaagtccaccaagcaggtacagaggagaagcacttgctgttctggatctgagacctcacctgctgcagcttcttctgctgaagataccctttccaattctgccccctcctctgctcacctacccgctgctcctcctgccctctggtgactgcattctgtgtttccaaagtcctcagtgcagctcatttgctctgtgactttctctcacctccctactctatgactgtccatcccttgcacttctcctgccaggctgggagtgccgtgaactcagggcctgggtgaggctgacatccagtaaaggtttgcaggatacaacggaatccattgaagtgccatgcagtggttttggatgttattttacttattttacttctttacatgggaatagtaggtatgaaagaaactgtggccaaggcaatactgtgaataaatagcaagtcattgctcaccactaagtgtctgtcaaacagctagactaagaaacctgattctaacatgcaaacctccaaactctaagattaatccttgttttttcctttgtactgcaaggctgagagatgagatagggagcagtagcggtgaggatgaagtgtatgcaggcacacctgtttgtatacaggtgtgtgcgcatgcatttgtaggtgtgtgcacttgtggatgtgcatgcctagcaagccagggtgtatgtgtgtgtgtgtatctaggaatgtgagtctgttaccttctgaataaatgtgctcttctattggaacacagattctcaagtgttttccccaaatcctcaatatgttcctcatttcccagaaaataaccatcagtgcaagaaggattgaagaacattttgtttatttatttgagatgaggtttcactctttcacccaggctggaatgcagtggcaggattatggctcactgcagcctcgacctcctgggcccaagagatcctactacctcagcctcccaaatagctgtgtctacaggtacctgccactacattcgcctaggttttatgattttattttttttattttgtagagacagagtctccctgtgttgcccagaccggtcttaaacttctgggctcaagtaatcctcctgcctcagcctcccaaagtggtaggattatagatataagccactgtgcctgtctgaaaaacattttaaatttacatttatccacctgtgtatgtttgatgacacccactagcaaggaaaaaacttacataaggccttaccttgttagtttgtttaattagcataaaaaaccttgaaaagaatttccagttggcattattactacattcaactaccccattgagagtgttctcttacaatgtgtggaaatggattatctaccctcatgtaattagttataaaacaacctgcatgtgtaatcaggggtcagtattcatgaatacaaaatatgtgtattgcttagaggcagttctttgtcacaaatcacctctttggcaacagttaatttttgcaactaagaacagaggaacacgccctctaaaaagtctgtcttcagtggaaactttatatgaaatgattttgtggataacttatatttttgtcccacacattctgatgaaacgtacggagtgcaggcatgggaaacacacaaaatacagactatgagtttccataaagaaatgtgagtgttttgattgacagggagggttgacctacgggagaactgggacagtttctgtggtgtgagtcacataaatctgacttctaaatacagataaaatctcagcagaaatttctgtgcaggaggttaaagtgaaactttgctaatcaatacatatgacccaaaggcatggtatgttcctttaaatatccttggatctgtttggtctttcttgccctaaactttgactggaccacgagcccagggagcagtgagggctgctgaactggcctcactagactctgagccatgtcagagtcaactaactttagtgtttaactttggacattgtcaagattattctggtcttttaaggtcctgacagggcagagaattgcaaataccattttgcttgagtaaccagtgtatgtggttgggaatattaaacaattaacatatctaatattaaacaaataattttctgaggacattttgagagttcttcaaccacatataagtaaccaatacaaagtggtatgatgatgacagtgtctcaaactatcaagtgcgccagcatcatcgggagggcttgttgacacataggtcgctgagccctaccccagagtctctgattctgtaggtctgtcgtgggtcctgagaatctgcattcccaatgaggccctaggggaggctgacgctgctggtccagggatcacatttttaaaaccactggtgcagggagactccaaggactactggacctcagaagagagagactgcttccagtttgaagggaacaagagttatatacggcgttactgctgggagctgagcatgtgttccttatagatcatcccattgacttctgagacagtgcattggaggagaggggaatggagagggtaagaaatatgaagaggagtttgttagaagagatttccctcatggatagtagggagaaaaagactgacgatatattggcagttcccactggaaaggtactggaaccagacgaaatgcagttcttcttttctttctaaaatctgcatcaggtacattgtaacaaatctccaactgaattactcagaccacaataaagttttaaggtgctagacagatgactaaagaagtgatttcatttaaataacaactgcaatcactgacaggtcctaggtgagaacttgtcagggagcgaatggccaatcgtggcagggagagacaggatgcgtcggtgattggtgtgagccctgatggtgtgaggtgacagcgggggaggacgagggctctgagcgcatgtctgttttctcctcacctcccagaaactctcaaatgcccattatctttgccatcatctcttcattatcatcacgtaatatttatccagtttactcatgcgtatagccctgtcttcttccattctgctccaattttcttcctcatttctctttctcttcttggcttgttctgaatctactgatttttttccctctggttgccaactgtgaacatcatccccacccactctatcaaggatttgctttttcagaaatggtatccaactggagatgcagcatgccccgacatggttcttctcattcattggaagggatcacacttattggacagaaataatttatcatgcagtaaactgtggcccaagaatatgaaacaacaaccaaaaggaatatacagatgcctggataaggaattagggagggaggggggcagatacacacacacacacacacacacacacacacacacacacacacgcacgcatacacacacacacaccgcccacacacacacacttccttttcaatggctacatgtttactacatttctttggaggagaaaatgctgatgttttgtggatactggtagcacacacacattttgagatcagattaagggaatcccaactagtccagccttggatcaggagcctctccatcccccttacctcatcaagacatcgctcatattgttccctttgattttcattctccaaagccaacgctgaattctctgcctgcagtaagatacaaaaataacacaaataaatcaatgaaatgttgtgttatgtgacaacttattccatacagttactaaatatatctcctcgtgatccaaaacaatcttttagaagtacctatgacaagttcactctaagtactattataaatatcgcagggatgacttctgtcttaccaacttgctcactaaaatacatgagaacttaaagaaatgcaaaacttgatattctgaacaggtagaaaatcaaatcatggtttgatgtgagagtgttccgtaaaaagattacaatgtttattttattctgtgaaaatgtaaatgggagaaatgccttaatccacttcattaaggcccatcacagactcacagacttatatttgtttaggccacagaaaagaatctcacataaagtcatgaaagcataattccaaatgcaaactaaatatgttactttcattgttagtcaatgacttacgtacataagataatgagaaatgtaagacttgaactatacttaagcatccccttccccacactcttgtaatattactgctttctcgctccttagagccatgtgggtatgtggttgaatatggttactaggttgacatgtagaatagtaaggggaaagaaaagtaatcactggaagcttattaggttttagaaggagcgtgaaatgctgatatgaagctgccctccacctcaggtgacctggttccactgcaggttcctgtctgaatcttcaactgtgccagtgaacccttcccagggctatgacaatgaccacccgctctaagcccacaagcaatcttggctctacgtgccccttctctaaaatcctccttgacatttggaagtaggggtatagtaatctaaatcagtattttcaaaattatggtatgatttttaggtggtacacagatcaacattttaacttcatagttttttcccatccgtttttctaaaccttttatttggaaataatttcaaacttatatcaatggatgaatggattatggtatgtatacacaatgaaatactatttggccataaaaaagaatgaaataatatcatttgcagcaacatggacagaactagaagtcatgttaagtgaaataatctatgcacacaaagacaaatattgcatgttctcactcatatacaggagctaaaaatgtggatgtcataacggtagagaataaaatgatagatactagaggctgggatttggggtaggtgcgagaggggatgaagagacattggtcaatggttacagatataagttagataaaatatatagttaaataaaaggtgtaagttctattttttgacagcagagtagggtgactatagctaacaacaacgtattgaatatttcaaagtagctagaagagagaacatgaagtgttactaacacatagaaatgataggctgggcttggtggctcacttctgtaatcccagcactttgggaggcagaggcaggtgcatcactagaggtcaggagttcgagaccagcctggccaacagggtgaaaccccatctctactaaaaatataaaaattaaccgggcttggtggtgcacacctgtaatcccagctattcgggagaatgaggtgagagaatcacttgaatctgggaggtgcaggatgcagtgagtggagattatgccactgcactccagcctggaagatagtgagactccatctcagaaaaaaaaagagaaaaaagaaatgataaatactcaagctgatggatgcctcaaatactgtgacacaatcattatacattctatacctgtaacaaaatatcacatgacccataaatacagaaaataatatgtatcaaaaaacaaaaaggatagcattaagaacctcacaaatcctttcctaagattcacaaattgttaacgttttgccacatctgccatatcgattcctttccatttcttttctgtacctggaaagtaccttgtagacatgatgcattttattcctaaatacttccacatgtgtttcctcataacaaagtcattgtcttgtacaatcacagtatagttgttaatttcaggaaatataggaaatataaatacagtaccacaatgtgatctacagttcttccagtttcaccaattgtcccaataatgtcattgatagcaatttttttccagtatacaatcctacctgtgatcatgtactgcattcgactgtcattgccattcatcaggtaatctctaatccggaataccttgccttttatttatttattttttttgagatggagtattgctcttgttgcccaggctggagtacaatggcatgatcttggcttactgtgacctccacctctcagggtcaagtgattctcctgcctcagcctcccaagtagctgggattacaggtgaccaccaccacacctggctaatttttgtatttttagtagagatggggtttcaccacgttggccaggctggtcttgaactcctgatctcaggtgatctgcccgcctcggcctcccaaagtgctgggattacagacatgagccattgcacccggcctggaatagtttgtctttttatgttttttattttcttcttcccttcttttcccccttatttcctcttcttccttacctttctttttttttttttttttcctttctgagtagaggccagttatgttgttgaacatcccttaatttgggcttctctggagctccctcatacatatttggtggaaacagtgcacaggcaatgctgggcccttctcagtgcatcatagcagccacgtgacatccatgggacctgctgctggacatgttaactttcatcacttggttaaggtagggtctgccaaatctccccactgtaaagttactgattctcctcttgcaattaataagtaatttgtggggagatactttgaggctatgaaaatatcctattgctcatcaatctttcacctacctatttaagcaaccatcaatgatttttaaccaaatcattgattaccttggttgcatatggtgacttctaactccatttttctatctacatttatgagttgacattcttccataggtaagtgattttcctatctgttagtatgaaaacatcaattctgataattttgatgttcaaatcactccagctttgggcaggtgagcccctttaagctggtgtctatatccttttgacatgtacccatcatttcttaaatactttctttttcagcaaaaagagatgttctaggaccatcttgctttttccttgcttcaatccctgaaatcaggcatttctctaaggaattctacttcctcttacttggggaatgataattgggaactaagatctgggtgttagcctgtatcagttgctaccaaggagtcactgcttctagtcgctttcagtggaaggatttttccacactcctacatgcacaggctcaacacccccaccccaccccaagccctacaggattctttcgtatcttctccttttcatattagtatcttcctttttgtatggttagcactcaggctctcagcattattttaactcctttgttcaatcttaccatgtgtacaaaattggtacgctacccaaaccagtgctaggaaaagttcagttttgtgtttttctttagaacaaaagtataaagtaaaaatactgtgttccaaagttactaagttggtttttcccctcctccccttttagtgtgtttatattattcatttgaaattcggttcagttcatttgtttctgatagtattcaaatttaatttcctctcttcttaattacattttgttttttagaatacataaaacattaacaagaatccaaaagttaaaactatattaaagggtatatattgagtgcagtgtccctccctctcctgcctcgttcctttctacctctcgaagattctttaatagtgtcattatcccttttttgtcttcctctgttacttttaaaatcatgtcctttggccgggtgtggtgattacaggctcacacctataatctcagcactttggaaggacaaggtgggaggatcccttgagcccaggagtttgagaccggcctgggcgacatagtgagatctccatctctactaaaaataaaataaaataaaaattagccaggtgtggtggtgcatgcatagagtcccagctactaaggaggttgagtttggaggattgcttgagccccaggaggtcaaggctgcatgagctatgattgtgccactgtactccagcctgggcgacaaaaccagaccctgactcaaatacacacacacacacacacacacacacacacacgacacccaccatgtcctctgactccctcctattacatatccaacaatcacctttcttcctttctctccttttttcctgctattttattagttgcatacttcctactttgccagggtatatcattttcacacaggcttcttccacctttgcccccacccttggtttggtctccttaatggataatggctggttggtcttatgttcttttgcttctgtagcaaaagaaattgctttgaaattccctcttttccttttccccttcacaaccacgtctccacactgcacctcctctttcccctttatctccttctttcccggcaggctgcctctctgagacagccacctgggtctgctcactttccagccttgcccaacagcccactggatctgccacgtgtccacctgtgtgcagtgctggccttgggctttctcatttcctcggtgccctctgctttccatctccctgggcacacacgctggcagcaggagttacatgggtatctggtatttatttttctacttacagtaatttgaaattcaagtgttctctgttattgataatgcagaaggcatgggttatatgtggttttatttgtgtttcctggtgatatgaatgtcttctttggcaggtgcttgaaaagtttcaactgtaggctagtttgttactttaatcaacaatgaaacttaggagaaatgattgaaccagaatagggcacaaaaatgaggaaaactcccggaaaaagtctgtttgagagtgacttgccattttgatcaaggtcaggtcatttcaactcagtcacggttcacattccagaactcctcaaacactgtttcttcttcaggttacagttttgatccttggctttgaccttgttgctctggggctgaatccgttttaacaaacctgtgaacaccccagtccctcaggtgggatcctgccacgttctttcaggtctcataatggacagacatctgccacacagcacgatccttctgtgctcaggctgatcatccgtttgccctttttaagcacagttattggttattcccagactgtttcttctcttcattcttcaccaaactaaactgactttgctgttcccttcagggattgcttttggccagtcccatggaagcttttccgtctctgcagctgagatggaacccctcagttcctcctccagaccaaaaggaagagcaggctccggttccagttccattctgttgcagtcttattaggcaatgccatcttgagtaacttttagcaagtcacttaccattgctgggtttataatttcttagttaataaacaaagatatccaacttgccaatctaaaagcgatttccagttcaaatatttggataccatgaatcacggaggaaaatgctagaattccaattctacaaagtcatgatttctttggagaaatttaccttttgtggagtctgctgattttagtaagccagcagtacaagggataatgggaagagagataaaggagagaactgcaaatgccacttcacactgtttactttaaatgtcttggaaaaaacatgtatggaaataaagctgaaaatgggaatttatatgggatatctacacctcgctcctacccacaatatcacgttgcaaaaacactgcaatcgatccattcagataattaccgtcattataccgtttacattacttgcctcacgtttactgctctgacaatctattactgccaagcaaattaaatacctaaagggtgctggtgaaagcacaatagtcacatttatggttactgtgttcagttacagagaccaatttaattgatgtaatcctacatatcccatgggacaaaaaagatattaacaatcatgctggtgaagttaaaataatcttgaactgatgattttctttaatccatttgcatttattagagattcaggattaacctgctaccaacttaaggcaacagagaaaaaaaaaacaggaaaaaaaaccctcttaactaaatgtgatttaaagaaacagtgaatatttatatagcaggaatgggaaaggataagcagagagggaaaggaaagagaaaatgcaagtgtcactattaagaattacagacatcacaatacaggtctttttctactttaaataagtatgttattaaagtcaatatgcccagaggatgcagttagagcattcaagtaaatgtaacagtgaatctttgcattcagctttgtcttccacaacaatcaaaaacttttgctagacttagcccgggatttcctgctcagcgtggtttccccatggctccaaattatagtggtctaaatatgttcatggtttcatctctaaaaatccttaaatgtccttataaaatcaaagagcatcacagagcaaatccgtattggtttggtttactgtggaaaaggggtttgacttgatacgtaaaaggaactgtgtttcttagaggtcctgctcagtgaatagataggctggctggaacttacgaatgattgaaaaatctgatgcttctaaagccactgtcctacattaattctgtaagtatgtattatgtttaaaatctttgtatactataaatttgtttaatagatccttttccacagaccaaaggtagactactagctctacacaaaaatctgtcctctgcataacataacagctccgctgcaggcttttcacctcttatactttgtctccactcacttccatgaccttatatatctgattctccacagcacacaccatctcaagagtcaggctcagctcctaaagctcccatgctccttcctgggctgtacctttggttttgctgctctagcatggaacaagctttactctcccattggcctttctaaatctcactcagttttggtggtctggctcagatgtggacttgaaatacttaaatggggacacctttaaattaaaaaaataattggatgtataaaaatgtagcaaaatattgcaaagaattcccccacaccattcaagagactccccaaaggttaactattttaccacatttgcttatcatttaatactatctatacctggagacaactttttaaaaacacttgagagtaagatgaagacacaatgcaatgtccttttacctcttaatacttcggcatgtacttcctaaaaatacattttctatataaccactgtgtagttatcacattcaggaaattaacattgatgcaatagcctaatctactctacaggccttgttcagatttttccagttgtccctcaggtgtccctgtctagtccaggatccaatccaggttcacagagctgcatttagttataatttctctttagcgtcctctcatatggaacagttcctgaggtgttgtctttcatgatcttgatacttttcaaaagtataggccagttattttgtagaatgtccttcaatttgaattcgcctgatgtttcttcatagattttaatatttatggcgagaatatcatggcaatgatattgtgtccttcttagtgcattgtatcaggaggcacatgataccaatttatcctattactacaggtggagtatctctaatctgaaaatctgaaatgctccaaaatccaaaactttttgagagccaacatgaataaagaaatgtgcaatagagtcttttagattttggattttcagattaggaatgctgaactgggtaaatacataatgcaaatatttcaaaatctgaaaaaaatcagaaagttgaaacacttctggtcctaagcattttggataaagatactcaatttgtatgttaaatttgatcacctggtgaaggtggtatctgtgacatttctccactataaaattatttatttccttttatcaacagtaagtatcttgcggcaaggtacttcaagatatgtaaatatccagagtctttgagattgcaaatatgcaaatatctaaactttggttcactcctcttagtatctattggtaatttttttttgactaaaacaattatgactgtggtggttgccaaatagcgacttttatttttattttatctatcatctatctatccatccacccatagcaacttttattttatctatctatctatctatctatctatctatccatccatccatctttccatccatccatccatccatccatccatccatccatgttggtgcaaatgtaattgtggcttttgccattacttttaagggcaaaaactgcaattatgtttgcaccaatataatatctatcttgttacctcttatactttgtctccactcacttctatgaccttatatgtctgcttctccacagcgcacaccatctcaagagtcgggctcatctcctaaagctcccgtgttccttccagggctgtgcctttggttttgctgctctagcatggaatatgctttacactcccattggccaaatagtgactattggctctgtcacccaggctggagtgtagtggtgtgatcatagctcactgcatactcaaactcctgggttcaagtgatcctcccgcctcagcctcttgagtagctgagactgcaggcatgtgccaacatactccactaatttttaaaaacatttttgtagagataaggtattgctatgttgtccaggctggtcttgagctcctggtctcaggtgatcctaccacctcagcctcccaaagcataaatagtgatttaaattctactagtcttcctgcatttgctagtttgaaccttatcacaagtaggggccacacattttagcactttattataatgccttcaattgagatgagtagtttcatgagtattattagtcttctccagttagactctaagccctttgagacagggatcatgctttatacgcctcttttcaaaggagtgagatgtaaattagtgtattttaactatagctatgggtggaaatgaaaattcagtttgatatttagattcacttagcatcaatgcgtttgttggcatggaatatgtacttttacctatgtcatctcagtggtggtcatacacacatgtggatatatactgatgtatcttttaaaaatattatagacaaatgagaaattaaaccagtgataaccaacttttcccctttgcaaacatcaatataaatttgatttattattaggatgtctatattttttcttctttcttttttttgagacagggtctcttgccactcaggctggagtgcaatggtatgatctcagctccctgcaacctccacctactgggttcaagcaatttctcccacctcagcctcctgagcagctgggactacaggcatgtgccaccatgcccagctcatttttgtattttttagtagagatgggacttcaccatgttggtcagcctggtcttgaactcctgacctcaagtgatccacccacctcagcctcccgaagtgctgggattacaggcgtgagccactgcaccctgcccagtgtgtatattttcaaaatgaaagatgaatatacaccatctgacacattctgacaactgacaaaatatttaaagcttgtacttcgttatattgaatagtagaggagactgaggttttgcccctcacttataaatgttaactgcatttattactagtattgttgtagtagtagattaaagatggttgcaaatgctctgtgacttatcttcttgaatctagactggccttactgacttgattgaccaatggaaggaggctgaagtgccatctttggtcttccaagactacaccatgagcttttaagcttctacctggcctcttagaacacttcttatatgagctaccatgtaggcagtctgaatgttttgaggtggtataaagccccagctatgcagacaggccctggaggatgagatgccttgcagagagagataggccaggggacactgagaggccagccatgggagtgaaggagccatcttggaaatggatcctttcacctcccaacatcacatagattggagatgaactatccagctgtgtcctccccaaatttctgacccataaaattgtgagaaaaattaaattgttattttaagcctcaaagtgttgagatagttggttacatagcaataaataagtggaacagtcatattcaggaaacgaggtggaacatcaattcttttatgtgtacattcaattactggtcctttgctgtacctgcaggagctatgctgggggaaaataaagatggataaaatatacaggggccaccataaagaaaacaatagtctaatagaagaaacaagttaatttctcacattgaaaactacaatgcaataggatcagaacaaaaaaaaaatcaacaaacttcagatgaggtaggaaagaggtgaccgacccttgaatcagtctactcaacaggcaatcaaaacaatgacaaaggtgcacattggactaaataaaaataacacagttttgaacaaaatgccaagaaaatgacacctgacttgtattcaaaaagcacattattcaaccaggctagaatcctggatgtaaatattgtcaaattattatgaaagcaaataatgtcagacactatctaatacccactgcagagaaaaccttgggttcaacaatggcaaaaaaaataaataaataaaataacaaactgatcatatgcaaatgaaacaggtagaaatgaacagggttgagtggtgtggaggaaagaaggtggaaagaagatgtcctctgaaggcaaaaagagagagaaagagaagaaaacgaccaattcacagtagttaaaaaaggctgcctccctgtggctttcccacggcaaaagctggtcttttccagagtgacatctttcaagcttgctgaaactccttcaattcaggaaaggcagacaggtcagaataagatcagaaaaggtatttctctaaaataccaattcaactcatggtttggccccataggtaagaaaaggtgcttctgtactttattttctctttggaattttttccagccaaaaatgtgctgctttatgatggccagcctgtgtcagagtcctgtgccactctacttaaataacacacttcacaactctaggccatcccaacaatttcatttggggaggccaaagggctgtacctgcaggagctatgctagggggtatacaaagatggataaaatatagagaggccaccataaagaaaaaaaatagtctaatagaagaaacaagttagtttctgacagtgaaaactacaggcttccaagcaaaatacacaggtccccaaaatgttcctaattcccctgcagtctgttctgttttgaaagctgtttaaaaacatcctgaggaaaaagtcccaggggagtggctaagcgtgccagccaggtgagtgcattttcatctgctagagtgatataaagtctgaatacaaggaacaccaagaactggagctggaatattgaatccccttccctctatgattataattcaaacttacggggtttctgaatcactcatcttatcacacctggctgccatagtggccatatgtgtagcgtagttggctaaagggtgttccccactgattgtatttgagagcttgtacagtatccagacccagacaatgtctagggctgctgggcatcttggaggcaaatgttatcatcctagaaaatgtcaataaagacattaagctctgaccacctacagagaaacaaatacgtgtacccatacatgtgtgaaggcatcctcacaatgtccttattcttggactcaacccattaggtttaggaccagcacaagacactaaggatataaactacattaaaatgaagtctttgtttaaaaaagttgaggagctacgccgtgagaagatgtgatgtagaacctgtccacaggttcatttttgaagagttgaatagaaaacacttcataatgaaacctctgtgtacttctagaatttaaacgtttggatggggcttcaggccagtggttggaaacttgagtgtgcattggaatcacttggggggttatgggatcacagactgtgggggagccaccctcacatttggattcagggcacctacagtagggtccaataactgacatctctaacaagttcccaggtgctgctgctggcctgggaacagcactttgagagctagtgctcaagatggatcaacttcagggtgaaggtgggtgtcacctccttcttcccccatgctgccattgccttggaagcattcagaagtctcttactgcttctctggaactggggggtggtaaccacacaattttatacttttccttctcttgttttgtttatgagtctgcctctctctcctacatcagtgactctcattgggagaaaacagcctaagggcatagatcagtgtctctctgtgtgtgcatatgcatatgggtgagtagaacagaaaaaaactgtgtgtgatttggaaaaccattatttgatgctgcattacatctggaaaataataaacggtaatgctttcatgatacaagaagtcagctcgataatttccttgcccagggggatatacagaaaagaaatccatgcctggagtgcgaaggcaagaggagtggtaaagcagatctatcttcctaggaggagagtaagataatctgatgggaagtgacggcgtgcttttcaaatttccttttatttgaaatggatgtaaaaataaatgtctgtcactgttttgggttgaatgagatgatgaaggcagaatgtaacgaacatggagcctggccctctgtatggtttggtgaatggcagtttccttcagtcttttgtaaaacagctcccatttgtaaccacggccactcacaggctttaatgcagggggtggtggtgtcagccaggccagaaattgtccctgctgagggagagattttggccaacagaaatgtaccatgggtcctctggattggacagtttaaacaggctcacatacagattagcgtcaggtcctgattcttttaacccacagtcttcctctctcaccctttcttcttctctttctcaccttcttacttctgcttccagatgcccatttatcaactcattattacatttatcaactcaatattacatatctgagctcaagatacaacacgtattttccaattatgagagaagctgaaattttagggactccaaaatttctttgtaaaaacaacctttaaaccttaaaacatattccatcccccaccaccagatgtgctttcagagatacaaatctatgactttcaagctagggtggactagagtggatttttcggttttagaagcctcacagagaaatttcatggagctaaaaaatgtaaaacaatctgatcactctgttgagtagagaatatttgtggcattaaccaccaggtattttagaagttaaactatgcaaaactcattgactgatttgcagaaaagaatatcaattaatatattgactttattacctcatttaattgaaggcccccaaactctgaggtagataggatcagctccattttacagatgaagaaaataagagactatcaatataaatcctttgtgttgcagagatagtttatttatatacacagtccttattccttactaaggacttaatacagtactttgaagaaaaaaatataaatgacaatagcctgataaatgcctaaataccagcgtgtttgaaccctctctaccaagaagcaggtaattcaggtcaggaaaaagactgagaatttctctagaaataggaattcttgacctctgatctataaaaaagctgaaaaaaaaaaaaaaaaaaccagaaaggaaaaaagcacagacatagtcattctaggaatcatttcatccaaaagaggaagccacttataaagcaagtttaaacaacaacaataccattacacaccaacccaactggtgcaaatgaaaacatcttacatggcaagcgttggtaagaatgtggaagaacaggcacactcatgtgccactggtgggtgtgtaaattactacacccattttaggatactttggttcaacttgctgatagagaagatgctcatagcttctgacccagcaacgccattgctaggtataacccctgtaggtacccgcaaacacatataccagggtgggtgtacacatgggttcacagcagtcttgttttctagccctcagacagaaatcatctaaactaagattgacagtacaatgaataatttttattaatcaatttatataatgggatactatatagaaacaaaagccagtgaatgagaactgcatattgaatctggcaatgataacattgaatgaaagaggcacaacatatatttaaacacacacacaaaatcttccaacatgattctacatacaaagttcaaaaactggaaaaattaaattatattgttaaggatacatacataggaggtaaaccatattctttcaaaaagcaagcaaattattattacagaagtcagattcatcattaccactagtggggagaaaggaaactgtgataagacaggagcccatggggtgccctaggctactagcaatgtttcatttgtggacctggtggcaggtactcaatgttttgcttcattattttttaattataaatatacatttttgggcatacaaatgtgcagtcttctgtaaacatatttcacacacacacacatacacacaaatgtacacactctaataagtaacagagccctaggagagggcctgaaggaaaattgtggaagggccctggtgtacccgggcatcccgctgccactgtaatgggcccagcaggtggacagcccatgagatgagagagggaagacactgaggcggatggagccagttgctgaggcaaagggacgggaccaaatgtatattttaaggaaggaatcctggcaccagcaacaaagagcgatggaaggggaagatggggagatccaaagcatgctattgtagcattcctttcaaggatgacctactcctgaaataaaacagcggcactgaggcgaggaagacctacatttgagaaagaattcagtacagattcatcagctcctaaccagtacctagatgagaaggagagccaaagacgacactgagttttatattctgggtctccgccagggcgataaggtctttaatagaaatgggtaacaaagtgagataaagtgccatgggagatttttagaaaaaaacctattgccttgccatgtaatgacttttttttcttttcctacagggaagaaaaaattgcagtgaatgtatgactctagttcttaaggtatgccagcagtcacagcgacctctctcccctttctttccattgtttgcatgtttgtatgaaattattttgttcagggatgctgactgctcactctaactctccttgttctctcaaggatgaatattgtccctttgcttcagaaaccacaggattaaactttagggagattatatattaatcatttaatttgatcatcaggcatgagctctggccttcccactcaggacccctggccttgcagctagtggtgcagatggacagtagcagggtgacagagggccgccctccgccctgctccccaatttcttctgcctccagcatgagtgggtgagcagcagtggctcaggagcaccaggaggctcgcagcctcctgccgttctgcgaggacaggaggacagggtgcagtaggggtaaagcagtgtctaagtggaatttagcttgggcattgccagcatctgagagggaacataaggacttgggaaaccctttgacttgtttttgtcatctggagtgtccttactttgcctaaaaaatcgaaataagggccgggcgcagtggctcacatctgtaatcccagcactttgggaggccaaggcgggcggatcacaaggtcaggagatggagaccttcctggctaacacggtgaaaccccgtctctactaaaaatacaaaaaattagccgggcgtggtggcgggcgcctgtagtcccagctactctggaggctgaggcaggagaatagcgtgaacccgggaggcggagtttgcggtgagccgagatcgcgtcactgcactccagcctggagactggagtctttgagactttgtctgagactctgtctcaaaaaaaaaaaaaaaaaaaaaatcaaaataagatctggccatgagagagaagttacctttgatttgtagcagttctcaaaatcatcattctttgcagaaacaattattagttcagttttgtatatatgcagcatgagagcaacatctggaagacatctagccagaagctggaaatgtaggtctagtttaagaagccagggctggagtcattgctgtggctgtgacagagaagaacatggaagctacagaaaatgatgatgatgatgacaatgacagtcaacaggtgctgatgattactatgtgctacactctgtgcttagccctcaacaaactttatcacaagtaattctagcaacactacaaaagagacatctgttgctagccccattttacagatgtgcagtctgaggctcagagtggttgagtggctttcttcaggccacacagagctaactgaatgagaaggactcaaaaaaaaaaaaaaaaacaaaaaaaaaaacacagtaggccaggcgcagtggcccatgcctgtaatcccagcactttgtaaggccgaggtgggcagatcacctgaggtcaggagtttgagaccagcctggccaacatggcaaaactccgtctctactaaaagtacaaaaattagctgggcgtggtgggaagcacctgtaaccccagctactcaggaggctgaggcaggagtatcgcttgaacccaggaggtggaggttgcagtgagccaagatcacgccactgccctccagcctgggtgacaagagtgagactctgtctcaaaaacaagcaaacaaacaaaaacaaaaaaacaaaaacaaaacacagtaaacttctcagcgttctgaactttcaattgttttgtcataatgaaattacgtgaaaatgaatcccattctagaaaccacatttcctgtttgcaagttcaagaactaaaagtgggtggatgatgtttggtttctctgtagagaactggcaagcagcaacgtttgctttgaaaatcgtggaaaacgaagagcactaacagattcatacaccacccttgttcctctccttctagcttttaaaatttcctccgtttctttgtgtaagtgagtgggtaggagttggtagatatttctaagcagttaggaccctgaggtgataagggttgaggggaactgaaatgtagtttcttatcgagggctggataaaggaagaataaacacctcagtttacagctcagctcaggtgcaataatagacatgtagactgagaagctggcagccaccaattttattaaaagatttttctgtttgaattacatatcattttaccaagagaatattgaatcattgtgcatactgtgtacttctccagtgatgctaccaaggaggtattttatacctagatgatgtctcatagagaatcttttaagtataaaaagaatgtgttatccagagacctggctttttagttgtagtctggcattttagaaacactgtccagcagcatgatgtggcagagagaatggctaggaacacacggtttcaagctcttgcatttaattactatgtgacattgatcgagacactgaactcctcttagctttatttttttcccttcataatcttactagaccacatcatctccaaagtcttttgcagccataaaatctcagacagtatgaatttatatagtaattatccagagataaataatcatggaatcatagtttgaggtgacagaggatgaaattttaactgtcttcatagtagaataatccattttataaaattgtgaaatatatggtgctcacttcttcctttccttgattccatgagagggtcagcaaacctccactaaaaccctcagagcatggctggccttattctctaaaccagactttgatgcaatctgttgagcagagagaagcataacaaagccagaatgaagtctcattaagacaaacatggatgaaatgtcaggctgggaacagcaaagcttatttctatgtctcaacagatggctgggaaaacagtgtcttgttgatcttgttagaataaattatatacaaagaagctctctatataatgctagagtgtgtatgcagtacttgagtgtatttaacatacctatatatacatacgaatcagagtttctcaaccgcagcactattgacattttaggtcagatagttctttattttgaggggttgtcctgtaaactgtagaatgtctggcagcatccctggcctctacccactatctacagacataccttggggagagacatcatgagtttgatcatggattccagatcaccgcaataaagcaaatgtcagaatcaagcaagtcacacgaattttttagtttcccagtgcatgtaaaagttatgtttatattacactactacactatagtatattaagtatgcaacagccttatgtccagaaaataatgtacacaccataattcaaaaatagtgcattgctaaaaaatgctaacgattatctgagccttcagcatgctggaatctttttgctagtggagggttttgtctccatgttgatggctgctgactgactagggtggtagctacttacggctggggtggctatcgtaattccttaaaacaagacaacaataaaggttgcagcatcaattgactcttcctttcacagaacatttttctatagcaagcaatgctgtttgatagcattttacctacagtggaacttcttccagaattggagtcagtcttctcaaaccctgccaatgctttatcaactaagtttatgtaatatgctgaaatcttcgttgtcatttcaacagtgttcacagactcttcaccaggagcagatttcatctcaagaaatgactttctttgctcatccataagaagcaactcatctgttcaagttttaccaggttggagcaattcagtcacatcctcaagctctgcttctaattctaactctcttgccatttctgccacatctgtaattacttcctccactaaaggcttgaccccttaaaagttatccattggggttggaatcaaattcttccaaactcccgttaatgtttatattttgaccttttcccatgaatcacaaatgttcttaatggcatctagaattgtgatcctttccacaagggtttcaatttattttccccagatccatcagaggaatcactctctctgccagaaatagccttataaaatgtcactacttaaatataagacttgaaaatcaaaattccttgttgatccatgagctgcagaatgaatgttgtgttagcaggcatgaaaacaacattaatctttttgcacatctaccccagatacttcagagctcttggatggcaaggtacatagtttatgagtagtaatatttggaaagggatattttcttctgaggagtagactctcaaaagtagacttattagtaaaatattctgtgaaccatgctgtaaacacatatgttgtcacccagacttggttgtaccatttacagaggacaggcagagtatgtttagcataattgttaagggccataggatttttcaaatggtatatgagcattggcttcaacttaaagtcaccagctgcattagtgcctaacaagagagtcagcctgtcctttaaagctttgatggcgggcattgacttctcctctctagctatgaaaatcctagatggcctcttcttccaatataagattgacccctacatcaaaaaatctgttgtttagtgtagtagctttcatccattatttgaactagatcttctaaataacttgttgcagctttacatctttacatgaagcagtggttgtttcaccttgcactttcatgttatggtgacaccttctttccctaaacctcatgaactaccctctactagcttcagacttttcttctgcaacttcctaacctctctcagccttcatagaattgaagagttagtaccttgctctggattaggttttggcttaagggaatgtcgtggctggtttagtcttctatccaggccactgaaactttctccataatagccataaggctgttttgctttctcatcattcatgcattcactggagtaccactgttaaattccttcaacaactattcctttgtactcacaacttggctgtttggggcatgaggcccggctttcagcctgtcttggcttttgacatgtcttcctcactaagcttaatcatttctagcttttgatttaaagtgaaagacatgggccgagcacagtggctcatgcctataatctcagcactttggaaggccgaagcgggcagatcactggaggtcatgaattcgagaccagcctgaccaacatggtaaaacaccatctctactaaaaatacaaaaaattaagcattgtggtgtcacacacctgtaatcccagctactcgggagcctgaggcatgagaatcgcttgaacccaggagatggaggctgcagtgagctgggattgagccactacattccagcctgggtgaaaaagtgagactccatctcaaacaaacaaacaaacaaaaacaaacaaacaatgaaaaaaaaattaagtgagagacatgttcctcttccttttacttgaatacttacaagcagtgtaggttgaataattggcccaatttcattactgttgtgtctcaggaaatacatggcccaaggagagcaaaggagacagcagaaaggccagttggtggtgcactcagaacacatgcaacaggtaccatgtgcaccttatataggtgtgcttcatggtgccccaaaacaattaagtatgtcacatcaaagaacactgatcacagattaccataacagctgtaataataatgaaaatgtttaaaatcttgtgagattataaaaatgtgaaaaggagacacaaagtgagcacatgctattggaaaaatggtaccaacagacttgctctatgcagggttgccgcaaaccctcaacctgtgaaaaaaatgcaatattcacaaagcacagtaaaatgaggttatgcctgtactagtagcatccccttcacctagttttgataataaagatgtctctagacatggctaaatgtcctgtgtgagagatacacatacaaccacacacacacaaacacacacatacacatatgaattattgtacatattcatatatacacacatacatcaatgacatcagatctatactggcatggcactttcaacttcatgaataaattttctacatttttagaattagaagggtttgaggtatcaagtccaaccacataattttatagagtatgaaaactgttatgaaaactactgttattaacagactgtagcccagaaatgtaaataatgactcttacccagtgactgtaatttatcttttgttattagacacaagaacaccagattgagaccagcctggccaacatgtgaaacctcctctctactaaaaatacaaaaattagccaggcatggtggcaggcacctgtaatcccagctacttgggaggctgagtcaggagaatcgcgtgaacccaggaggtggaggtggaggctgcagcgagctgagatcatgtcactgcactccagaccgggtgacagagcaagactctgtctcaaaaaaaaaaagaaaaaaaaaaaaaaaaaagaacaccagaactggaagagatctcaacttcactcaacccagagtctattttacaaacaagaaagttacatctctactttttgcttttctgcccttctacccattacactgattgtttcgatcacttgttctgacagatttggtattaagtgaatcaattttattcctcaaagtggtagaatctgtgcccaattattgggagagacaaactttgcagagcatattccctttgttcaggtaagtggtgacaggttgagtcagctccaggctcagaactcacatctgctgagttccacttaggttttgtggtagcaagaacacaattatctagtcaattgctctggagggaacatcatcttgaaaacatgaccaaattcacaccactgtaattaatcagacaactgctctagtgtgatcgtggttaccactccatagaattggaattgtctttttaaacccgaggagacactgctcactttaaggttgaactttatagaagctggtcccacatttggatgctaattagcaaaataatacccacaatgcaacctgattaaacgtttcacccatgggtggaaacgcattaagtaaacaatgctgtaaataaaataagattgtgtcaacagaatatatttgtgtcagtatgaaaaaatacttaaaatcccttaaaaatagctcttcatattttaatgtcctagaattgttaacttttaaagatgaagattttgggggattatcaagataggactatagaaagaatttatttaaaagagcaaaaggcagtgttgcactgtgcattaattgcatgtaaagatacaccaggaacttagaagggtctggttccaatttgcaaatgctagtacagtacatgttttcatccctaatcatattacatcatctttgtgtgtttgagggcacagataagacttattcaaacttctagttgacatgcattttgcttttgaaaaccaaaggttctcattttctattagcttttgtgctactagtttcacagcatttgaagattcctgaatttctgtgcatattggtttttccacttatcaatattcatatacagaagcaattattactgtgaatcaccatgataataaacccgattttacagcaccaaagtaaagagaaatctgtatttaatctccatttgtctgtactggaatgaagtattcttaaatctgagaaagtcaattattattcaaagaacaatcacagcatagttaaaaaatgagaaatccaggacagcagaaggtgtaaagaaggcatttatcagacaccaagggaaaagggaaagacggttgatagctgaggtgtccagttaaaactcaactagcaacacaaatctctggtaggtatcactgataaaggtcaaggggaacagagttatgacagtgaactttaaaaatactgacaggaaacaagagtactggtttccacgtgtgttgccttgctattcacataaaaccattagtcctttcacagaagggtttattgatttacacagatactcgtttgtcacatcctgtagagtacattaaaagctgcccaggtatttcaaatgtacttagcaaatttgccttctcacttgtgtgcagtctggaatcttggctgtaagatagttttcagcataaaaggcttgattgaagagaaagtcagcaacttaacaaaagaatcgccgtgaggcctctttgtgatgtcttaccaagaagctgctctcatggctggtggacattgatggggaattcatcatgtgaaggggacttaacacattagatgcacagggattcacaaaggatgaacaacacagttttcctcttgctcatccccataatattactgacttcctatgtagtttgtcacttccgccagatgtgactgccacatgcccagtcctgtgtcatgtaggaggcagtgcagagtaactgataggagaggtggctttggcatccacttatgtaggtgtgaattctgattccacagcttatcgacaccctcaccctgggtcacttgcctctttaccattcagtttcccaatctataaaatgagagtaaaaacagtacctggatcacaggttgttgtgagggtcacatgggataatgcatggagagcactgaagaagatgcctagtctaaagtgatgccaccttgtagagctgcagctcccaccccccttgccacatgggctactcataaattaactaacattaatttaaaccaaaaatgcagttcctcagtcccaccagacacatttcaaatgatcaatagccttgtttggctaaatggctaccattttggttaaatggctaccatgctggacagcacagatagagaacatttccaacactgcagaaagttctattggatagtactattttagagggtgacttacatagttttaactttattaactagtttttaataagcattatcatttaatctgaggcacaggcccgtgtctgatagtcactgaaaattatttaatgtgttgatgtgacaaatgtatgttgacagacctcaactcatatttgtatcacttcctttccttctaaatcatgctttcatgtttatctcaatttatcctcacaatatccttgtcaggtaaatacatcagacatctattattttcatgtcacaggggaaacagaatgtgtggtatatgtacattcagataagcaaataatgtctatcttttggagggttttgagagtaagaaacagattaggcaaggtagactacttgggaggaagttcttattttttctggttcaaaactagtaagagtttattaggagaaacttgaaaaatacacaaactatgatgaaagcaaatattgttcaaacttatgcaacccacacgtaattaccattaatgttataatgtagcttttcaggggtataaaatatacattgtatattacaatttatgtattgggtgataattctttttcttgtgacatagagtaaatatttccccacaccattaaaaatatttgataatggcccggcgcggtggctcacgcctgtaatcccagcactttgggaggctgaggcaggcggatcctgaggtcaggagatcgagaccatcttggctaatgcagtgaaaccccatctctactaaaaatacaaaaaattagccaggcatggtggcgagtgcttgtagtcccagctacttgggaggctgaggcaagagaatggcatgaacatgggaggcggagcttgcagtgagctgagatggcgccactgcactccagcctgggcaacagagtgagactgtctcaaaaataaataaataaaaattaaataaataataaataaaaataattaaataaaaataaataaataaataaaaattaaataaaaattaaaaaatatattcgataacataatgcatgcacaagattgtattatgggaccatactatacgttatttaaccatttctcatgtttgctgcaaggattatgcttaaacataaatctcattttacatcatggagtattttgaaagatagagccctgcagttacaactactggatgaaagccctagaactttctcagggacttctagtacataggattactttgctttctggaaaggctatatcaaatttcacttccccaggagcatacgtgagaatcaccgcccactgattagtaccatctaaacattttgccaattttgtacacaaaatatcctcttttcttatttcactttttattgccttggtctcatgtgaggctaaaattttcccttgtgttaattagctaatggtattttctaatctgtggattgtctcttcataccctttgccaagcttcctgtcacaatgttcctgttatgagtttatactaaatcttcataatgaggatagaaaaaatctagttctgatgttttctgtttgtcctttaatgttgtttctgatatttctgatatttttatgttcatagcatttaaatgtttataaagtcaaatcaatcttctttttcctttgtgatttccttcattgattttgtaatcaaaaagtccttttcccacccgagcaaacttaaatagccacttttgttttcctcaagcttaataatgtttcaattatcttttttttggtacatttatctctttaatccacataggatttatgttatgctgtcacataagtatcttctttctttccaaatagtgatattattgtcccagaacatttccagaatcagttttgcttctgtgttgatatacaatatctcctttacaactattaaactgttaaattttgcaagacttatggcagcatggcttattctgttttatggatccaccttatctaaaactgtaatcacacagttttaattactgtaagttcacatcgtttcaatatatgatatggcgagccagcatttgtgagtcctctcttttcgaaacatttcttggcttgtttattgttctacatgaactatagaaccatttcaaattcttcccatagctctcctctaattctactgattttttctacttgtcaagatttaatccaaccttaaattttgggaaaaagtatcagctttgtaatatttggcctgcctatcttggaacatggtatgtctctttactaaattctgccttatttcttacaacgagtgttatagttttctttaaattggttttgcacattttaaaaatagtattttataaccttcattatatttatacactgaattttcccgataatttttgagccaccattcctcatttacagaaaactactgatttttatatactcatacctgaccaccttactgcactctttatccgttctaatgctcttccaattgattttctcaggttcatagtatatactatgccacttgcaaatatttttttccttcttctcaatagccagttttatttctgattcacatatgaagggacgcagcagaactccaaaaacaatgtgaactaagtgtgcagatcattgatgtgattgttcctgactgcagtaaatagctccagcatatttttctattgagattgctattggttaccaaataaagctattctttatcctgttaaaaattatacatttagttcaaattttccaagagtttgaaacaaaaactggtttggaattgactgaaagactattgatctattatttttctaagatggtgtttggatttctttgccagatttgggtatctttccatccaactatagttactggagtagctaacagagcaagagagttctctaagacttgaaattttacaaaaatttgtccacagactacttgactagagggaatgaattccaatttaactagatgtgggacaaattagctgttaatgaaagtgccaacaaaattacagaagcagatggctattttctagatgagagattatactgtaaagagagaggcatttttggagttgtcatcgccatgcagaggtgatatggaccttgcaccccaaccaaaattttgttttggatattgagactgataataccacatgcacatgaagaaggcatgaaaatacttataactcccataatgaggtcttctggggagattaggggagacccccaagcagatctgaagtagcttgagagagcccaaccttgcttagtttgaacttcccacctgagccaaagaagaaagtacctgggctttcttgacaaccagagcagatgtggagcagaatggaaagggatagtggtgaggcttcaaagctgccagcaaacataaaacatggagtcaaactctttattacagttgaggttgaagaaagatcagaggagcactgatttgatgatggagaaagaagacatgaaaattgatggtcatggacctcaggagtttgggggtcaaaacagcaattctccaaatatttaaaattgcatgatgaataaaggattcaggctacaatagaattttctttcttgacacgttttacttgaatgatttactgttttgcagaaaatttactgaacttacactgcatccaaggattgtgacttttgtaccataatcaaaatcattgttgttgaaattccaaaagaatattttaaatatgcaagagcagaaacatagggaatttagccttttcctaacattatttatattactaaacattacttttaacttatgaatagtgacaaaatatttagaacaacataaggaaatacaaatacctagaaactgaaaaccttttagtccatcctcaactcataacaatgatcacctaaccaaggttagccatttttgaggttgaatatagacttttccaaccctgtttgattctttacctaaaaggtaaaataccttgaggacacacctggctctaacttgggcatttcagagattaagatcacgcgggtagcaaagtcttcagggctgctgcttctcaaaaatttagagtcctctttaagtttagcccagagggctataaactcccatcttaagatactcagtttagctcttagagactctgtccacattttcctctttgtaggtgggaaaagatacttcctatgtcacctgcctgaagccatcacctgtatgtgcactaagaggcagtatgattgcctcataatcaaggctcttaccactcaaagacacgttttagaggtgtttagataaacatctcagttaatgtaatcattcttttttctttttttttgagaaggagtctcgctgtgttgcccaggctggagttcagtggcacgatcttggctcactgcaagctcagtctcccgggttcacgccattctcctgcctcagcctcccgagtagctgggactacaggcgcccaccaccatgcccggctaattttttgtagttttagtagagagggggtttcaccatgttagccaggatggtctcgatctcctgacctcgtgatcctcctgcctcatcctcccaaagtgctgggattacaggcgtgagccaccatgcctggcccacaatgtaatcattctttataaagcctcatacccaacagagatttatttggtcaatgcttttgtttataaaagcttattagtcacaataagcaactcctcctatacctagacacttttaacagttacaaattctttctttagattagattttcatttctgtaacctttatttattaactcctttttgcttttaagagctatattaaatatatctctatggggttacacaaaacattttttttttatatttacacatctaaattacatcatcttgatttttctttccctaaattaagtagctgtggcctgatttctatcttttcctacaacatggtttttaggtgcttcaccatcttggttgtcttttctctttctcttcttttctttctttcctaaggcactctggtcagtcaatttctctcttgaaatgcaagtatccagaatcaaatcctttaggatgtggtctgaatggggtagagtgtggcaggactaactgtggtcttccaaaaggatattattcttctatcgaatatcctccgactgtcttagcttttagcataatcttgactaatactaagcttatcttcaactactctcccatgatttttcttttaatgctaattgtttttaagcctcttgatttaataaattgatttttaagccaaaaatgcaggaggtgacatttattactgttaaatttttatcttgtttactatagtccactgttgcaggatattaagaaatgaaagaatatctggaattctgactgtgacaaaatcagttatgctaccttcccagtttggattacctttatgttaaaaacctgctgtataatcttcatgttattgacaaattatgctgaataatgcagttctaaaacatggatccctatggcataattctgaaatatcgtagtctttattgtggcagctgattacaattacgaatctttccaactgaaagatcagccaacacacatttcttcatcctcactgaacagtgtcataagttaagtaatcagatgttttgttgaaatcttggtgtgatcaacttatggcaatctcacggtaagcagtttttaaaaaatcgattaaaaaagaaaatactggccaggtgcggtggctcatgcctgtaatcccagcacattgggaggccaaagcaggaggaccacttgaggtcaggagttcaagaccagcatggtcaacatggtgaaacctcatctctacaaaaatgcacaaattagctacgtgtggtggcgcacgcctgtgatcccagctactcaggaggctgaggcaggagaattgcttgaacctgggaggtggaggttgctgtgaactgagatggcaccactgtactccagcctgggtgacagagcaatactccatctcaaaaaaaaaattatatctatctatcttatttttagtatgctcaggctatatccaatgatcatgcctttctttctcatttgctcctttttagaaatttcccaggcagcaatctcaaatttcttatgctagggtattcaaattttcccctttatcaaaatgaagacggtattatcttctatattccatttcctcagagattatcgacaatggttctgagataatatccagtacttggaatgtaattttcctgactgggagatgactcatccagaggagctaactgcttgtgttctaactcctcaccaatcttgggcattgattcatccattgggataattactccatccttcccaatgtgaggaacactttgctttacagaaactacagatggaaaacaggaggtgactagctttgtcatttatggctcctgctgctgcaaatgctgctgttttcaccatgtaaccaaaatctccaagtggttgagaaatcatatgatttttcttcttggagggatatgagtagcaagctcttaaaaagtccttactctatgtgataggacttgctaaatgcttaaagaatcttatttaatattcacagtaaacctatgatggaagtgcagtcattatgcccattttacaggcaacaatgcttacaattagagcagttaaggaacttgcctgaggcacggctagtgaaaacgtggagtcagtattcagactcagggttttctgataccagcaaccataatattttaaattttttttcatttctaatttttatgggtatatagtaggtgtatgtatttatggggtacatgagatgctttgatacaggcatgcaatgtgtaataatcacatcatggagaatggggtacccataccctcaagcatttatcctttgtgttacaaagaatccaattatactcttttagttatctaatatttaaaaatgtacaattattattgactatagtcaataatatttgtgctatcatatagtagctcttacacattcttcctatttttctgtacccacccattaaccatccccatctcccccgagcacgcccccaactacctttcccagcttctagtaaccatccttctactctctatattcatgagttcaattattttaatttttagatcccacaaataagtgaaaacatggaatgtttgtctttctgtgcctggcttatttcacttaacataatcacctccagttccatgcatgcctttgcaaatgactggatcacattctttttcatggctgaatagtactccattgtatatatgtaccacattttctttatccattcatgtgttgatgaacacttagtttgctcccaaatcttagctattgactactatgctacattgcaattcatttttttctttaaatacaaaagaatattttaattactgttttagaaactataaagcttatatgtataagctttggattggattggatttggaaatgagactgtaccaaacaatggccaaagaagactcatccattctaggccttctcttttgcctggtaactcagaagtataattctatctcataagcatcagtactcataggcccagttagttacttacaacatggccgttttctgcaaatggatgccacatctcttgggcctggctggaatactgatattccgtgccatgttgtcttctgaccgacaccacccattcggtagagagacttcactgcctgattcccacatctcatttgttgctagagaatactgtgactggatgtttttccttccacctgtctcatgataggggcctgacccactcagccaagtaactgcacatgattcatggatctttcaagaaacaaattgctggtcatttcagactcacgtcttacaaactgataaagcacttgtaacgcaggtcttcaaacatggcttctattttcttttcttaaaatctaatctttagactcttcctgatgctctagctcagccagtgtccagctaggaaatcaattccagtgcactacaattcacttaaaaaatgtaaatttggttgacattctgactttttggcaaattttagttcatcattgacttttatattttatgatactattcttttaagtttatgcctctcttgtatcaggtaatagtctttccttcctgcaaaattccaagtcctttaaaaatcaaattttgttggtgaactccctatgtgatattttagttaaatatctcactgtgacctcccctttttcctactacagttcaaaagtcttcttttgtgtttgtatgtgtgtatatacatgtaaatgctggcactgttttctaagcatttcccacacagaaggacatattttcctttgccctcctatgtgaactccataagcagagaaagggccctggttcccatcctaaagaggtaacggagaattctctctgcagcacaaaaaggaaaaagatttattattccctggatcctattacatacatctgctgaactcccccatggctccggtaaactgcaggactgttgattagcgggccctcccaggccttccaagctgcctgagagctggccagtcgctgcttcttgctggtggttggaggcacgcccacagtgtctgcctggaggagcctgtgagctggggatatctgcagaaactaccaatctgagccattaaagaaaactggtgaaagagtggtgttagaaaagagtactcatagttttctactcagcagaggactagctctcaaactcttctgtgcaaagtcagatgctggcctgtggtgactatgtggcagtgagagaaagaggcaggcttgggcacctccaacaggaccatacagggactgctgtgcctgaagtgagccaagctctcgctctctgtggcacagtgccctttgggaaaagtcatcatatggtccagaggaagaaatgcatcctatcctagacttggtacataataccattttattcaagtacatgagtatgaaaatgcattcaaataacccataataaaactttggacagtcaatcagggtttttcagaatatatagatagatttcatctgcagagccttcaaccctctgtggactatgtttcttttcagagcccgtccatgacatcatagttgctcattcaatgaacattctgatatcttatttcctaaacattaagtagtgtgtacatatctacaaactgccctgcttcctatggttcctttgatgctgatttgcttctttaagccttccttccttccaaaccatgaatcaggtccttccagaggctaagaattaagttcacaattaaggcgactccctcactgtttcctctgctttcagagaggggaaaatacttccaggacaagtcaagaatttatcagatgctctgctttcagcagcctgaaactttcagcaggaacacgatagccgaaatcccatgccacttcttctattgaggcttccgtttaaatcaggtgagattaatcatcctccccctgtatagtctggttctagtgttatttcacatccctcctcatctgtgctttgaaatgatatagaatttttttctatatcaacaacttcacaaatttccagtttgctttcaatttgaatgttatccctacagaacattagaaagcactcagtgtttaataacctaataatttaatatgctgccctcaaactactacggtctcttccctatacttaagacttggacctaagatttgtctcaataaattattcagctaccatcaccagggcctttcagctatgatatgccctggtgatcgtagctgaatcatttattgagacagctcttatttattgattatccaccatgtgccaagttcctacataacacagtcagtccacacagaaatgttatatgttaatcatgcacatctagcttgcaaataagataaagagactttaataaataacataaacacagatctgactatctttacaccatgtcatggataagagagattctacagccagatggaacctgggtcactatactatttattagctgtgtgatctcgggtgtgatgcttaacctctcagtgacttggtgccctcatatgtagactagagacaagaagaacaataatgtggttttatgaaggataaataagaggtgaaaactgatagaatatgcctgctacctagttagctctcaataaatgttagctgtcttctgaatttttatttgtacttataaatcaattttttccataaggctggttcttagcattatagatgtaaatgatcactttgggaggtggacgctgataaagagtattgactgggttctgtggctttgcttcccaccaaaatgcctcttgcaaattatgcaagacagtaccttgcataataaacatttgaatatttgaataaacaagacttcaatttttaagatatctatgtttggaaatacccacaaagaacagggctcatattgaagtgcatggagaaaactcttgtcataattttccattctctctatcctctattagcatacttatcgtcttcttcaatctataagtaaatttgaaaaataatggaattcagatttatttatgaaaatgaatctgctttttcgtttagcccaatgggctcagttggtaatatttcccaaggggtccttttaagattcttaaagtaaacatatagttaaaactcgcaccaccttgaaaaataagcataagagccttaattgcctttttcttggcatacatcaatttctacacataaaaatgcagtactgaataacagcagtaagccaaatttctttcaaatagcacatctatgtgaatagtagctgtccattatgtttcttaaaatctaggaggctaaatcatatttgtgaaaagaaactttataataaaatttaaaaagcctaattcgtgtgcaaagaaaaaaggcatagaaatgtttctttttaaattaatacaaaaccttcccacatgctccaaaacagtaacaatttgatgttaaaataattcattgtatagtcttttatgataaaaattttagaaaaaaaataatgaagtgtaaaatataagcaagataggagaggaaatttggggaaattttaactgatctattttttaagtagaaatggacaattcctgagatagccctgttttctctttggccccctttcacaaatagtctcatggactaatactacctttaaaatacaactgcaatatagactctctgaaacccaaatgctgggggtagggccaggagagaactgagaacacaatggaatcttgaatgggatcttgtaccccagtaacgttaaaggacttctgaattctatgaccactgaaggtactcagcactttaagacctgtgcatttcaccacccgataattttatttcaatacaaatgagatagttttgtaaatctgatgggtcactgagacgtgaatgctgctcaaggccatcagataaaaagcctatcaggaggaagtgtgatagccctggatatgtgtgttttgtggcttcatccttagagcaacactgctgtatgatgacatcccagaaagatcatagctcttatcctaagtgtctcaagaggcaatctaagatattgccagaactcagccagccatcaagtaaagctatggccaaaaaaaaaaaaaaaatgcctattgcataccttctatttcagcaattaggcctctaagtattcatctaaggaaataatctaaatgtttatttaaaatgtgcacaaatagaagggtgctcgctgttgcaccagacatgtgatgaacctaagaccggatggaccatttgatggatctgctagacttgtggctaagggcatccagtgtctccttcctgagtttatatcatggggaaggaagtctgaatggtgaacagtggcatactgtgcagagctgtatcagatgagaagacgagaggccgtcctgtgtgctgcatggcctgacctggtgtgattcctacagagaaaggagcaggaggctaaaggggatgaggctgtttccaaacatgatttgggaactgctgctctagtcaccaaaatcccactttggggcccaggagggaaaggcatgttcccatcattttcttggacaggaagcaaggtgattgcaaaccaacaggggctacatcctgggaacaaggcactgcagaactctcaggataagtagttctggaacactgtaaacacagaatacagcccactggttggggcatcagaattcctgtgggggtgccccgagtagcagtcacagagaggggccttcgctaagctgctttcaatccaggtttgtgtgtgaggatgtgtcagtcacaaatggaagaagatgtttttatgactgtacatacgaatgtcctgggaacttctgaaataactagggggaagtttcttgtggggaagagtgagcagagcctctgtgtctgttgggagtggggaaagatggaaaagagccagccacactcagtttcttaatgtgacctaatctgaccccagaggcagatggcttagggagacttggggataatatttataatacggtaaatttggaaacagataaaatacccaacactagagcattggttaagtgaattatcacacatccatacaatgtgaggtggggctatgactcaataaatgtgtatactttctctgtatttcacagcctcactacattcattctcactgttaccccaagggaactgctagacctcagtgagcagaggcaatgctcagagaaattgactgccaaagtaaagacagaaatattcatgtttgcagaggctgccctctttttttttaacagcaagcaaagatgagaaatactatggtgaaggcaaattgggataggcaggggacccactatattgtgccttgggttaagaacttccctaggcatagactgaccacagaatttatgatcgaatgtgacagagggcgttagctggatgagtaactgggactcagagaaccttactttgcatggggctggttgatcctaggccactgttacaaacggatcattatgtaaccattaaagtgacagcataaaaacacacatcataaagtggaaaggttccactgtgacattactaacaatcacgttacaaaaaggcttgtactgtaggatcccattaaaataggaagaggcatagagaagaatgactggcgtgtagatgccaaaaagaatgattatttctgtattaactgtataaaaggttatttgaattctgtggttttccatctttctattaatggacatttattgcttgtaaaattaaagtttatattaaaatgtgaaagaaagttagttgacttaggaccaaaagtacagcttatatgtggcactagctgcttaattttgaaattcaatttctagaccacctttggaatcatcactacaattttactgtggactcaaatgatgattttctcaagggcatgatctgtatcttatttcatctctttacttttttggaggggttagaataacccagtttgtagctgtgatgtaggttagcatgtggctgccttcctgggtaaatcaaattgaaatattctactttgagtcttgattctctaatgcaaaattgatggaagtgccagagtggagtagacccaataatgatgacaactaatgtttatggaatggtttccatgtacctgtgtgccaggcactgttgtaggctctttgtgtgctttatttaattctcacaataatcatatgacataggaactcttaacatcccttgtttacagataagaaagctaagcagaaagatatgcagtgacttgtccaaggtaactgaaaatatgtaatctactcttgatctgccatggctttgatgaaactagcaagccactcttgagtttggcagaaaaatgacttaaaataattttcagtgcttcattatggttttagaaaatgatttttaaaaaactttaatatatacttttgataactcatttataagatccatacgtttggctgctcatcataatttacactgtgttctgatgttatacagaagagggcattaaaatgatagttcatagcccttatttaaccgccaggattggtaattttcattttgtcctttaatctattgggttggttgactcatttgttataaaaacttgataacattttagtaaatacatttttctgctttaaaatttataatagttgattattatgattagtatttacagttgctaacttgaagaacaaacataaactaggcaaatacagggaaaatattatttcacattctttgactttattggctgcagagatgggaaaacagccctacaggtgcacctttgtccacctgtggggcttaaacatccagctcccatgagctctttattgaggccatcagaaacacaggcctgtgactatgattccttttaatgtgtctttgggctccaaaccataagacttctctccaatcactctgtcacttaactctaaatcccacttataccatttcataaatttagtttctctgaggatcctcctcctcctctgcaggaggaccaatttaaatcatccttaaatcatcacattaaacactagctatcattggctgcaagggaaccaagaagtatattataccaagtcttaaaatgctgtccatgcctttttaattttaccataaaatcagagatagctatttgatcaggaaggatttaatgagtttaccttttaaactaatggactataatgggctccttaaattttgcatgtaaaaacccatgggttgggaaactttcaatttctccttaataactcatcactataaatcagattcctttaatatactatgcatcaacattgcaatgagctcagaaggatctggtaccattttcttcctgatgtctcagccacaaggaaaggctggtttttttctgaaaggtagtactcaaagcaatttcattttatttccctctacagaagatatcagatatttaattaagcactcccataaaagatctacccttaggtatttcagaatgacctgttccttgaggatttccttggtttctctcttgctagaaaagaaattaaaagacatagatcgtagggtttgtcatggtacattcagcatatattttgtaatttttttttatagccagtagttaaatattaacagtagaatgcatttattggatcatttctcctccaactaaaatataacactaatgattataatgatgatgacattacaacatccataatgatgatgacaatgctattataaaataacgttaacttgatccttctccaaagctttgcatttctctagatttctaaaataagaacaaaaaagacaataaaacacaagtgattcaaaggacagtataatgtaaataacaatgctttctgaagattccaagtttagaaaaagccatgaaaagaaattccaagtttagaaatagccatgaaaagaaattgcttcctgaattacatagtaaatcacaatctgatgcctaaaggcttttgacagtgaaaggtctacacattgccaaatattgggatgaaagcttcatgttttcaaatacccagtatcaaacaaaacaaggatattcccaattcatctggagttggcaccatggtaagtcacaaatgatctggtttaacttcttaaacaaatgatgaatttattgtttcatttcatggacctacaagccatagtcaaagggagaaacagaaattgtccagcttcttttccatcaacctaactaacatggcaattcacatagcaaagtggatttgcagtgacaagagaggaagccaatttacatgtatgggtggaatgggagtggtgatacagccttcttggtctgggggatggagaagggaaagaaaaatgcactttcaggtagagcactcccaggatgtgttcacttcagctaaaaattcatcaattaccctgccacagagaataccaagattatagtacagcatataattaaagaaggtggaggcgcagaggccctggcagagactgtgtctgtctatcttgctttgaatgtgtgttctacacagcagcacatgtagcttgctggagtctgggcacctggagagaagggtgggtgggagccaccgctgacagagagtcattcactgaacacgcaaactagctaaaagaaattaatgttaacaccaatcacaagattaaatacacaacatttgatgcaagatcaacagcgggatgatggtatagcttctgaaaacaggtggagttgaccttaaagaaatcagatcagcaacgacagacaagaagaacagaagagacaaagggcagaagaaacagaaggaaagaaaaagataaagcaaaaaaagaaaaaaatgagaaggaataaagaaaatatgatctctagaagatgacatctatacttctacaagacgatgcatcaactctagggaaatttagggcttatatgaaatatagaaatttgactcaaagtgactggaagatgctgagtctatttttcacacagctccagaatgagcagtaagtatctgcaaagttatgaagagaggccaagtcttgcttgtgtctaccttagttatcaaagggcagaaaagggacctctgtggcctggatgctgttgctggttgaaatgtgcattgctggagccaattttaaaatccaagtagcaagttcatggttccttggctactgcctgcatacctacattgcccagctgactggaccaccaggacccaccgtattcccctctcccccttgccatctggccttttcatgattttttttcttttaaattaagttcctatgctatttcatggcaggaagttttgtgtgatgtatctatgccagctctgaagtcagactgttcacaactcagtttcaccatttcaatcagatagttatgtgaccaagggcaggttactggtcctctctgaggtcctaggtaggaataacaacacattccacagaggaggagctgtttgctcattttgctttcacatactagaaatgttcacaattattctccatcctacaccatgtgttgagtactatctgtgggttacagcatcatgtaaaaagttaggcagagaaaaaaggacccccttttgttgatggactctaccaaaaaaaaagtgggagacaaagggaaagctgatggccaagaattaagaaagttcctgtaagaaaattcaacacttgcctgggggtgctgtgtgttgactttccatagcatgaggcctggttcaagggacctgaatgtcatgttccattgagagcttatatatatatggaagaacttatatatatatatatatataagttagtttatatatatatatacgtatatgtatatatatgtatatatatatatgtatatatatgtgtatatatatatgtatatatatgtatgtatatatatatatatatatatatatatatatatatatatatatatatggaagaactaggttgtcctttgagggctgggtccttctgctcctcattagctcagaatgcacctccctattctccttatttaaaactgtattaaactgacaattctacttgattgagatcctgatctcccttgtggcatttaggccttaatgtatggcactacagttaagtatcatcaactcccagcccactagtgtgaaatccaagaatcaaagtccatcatcagcaggaaagacattgactgaactgtatatattcccagagaggatcttctcatccttaaacccttccttggtttttctcatcctctcacgaagctttatctgccattcctaggttgatgaatcctcaaagtaagccccacaggaacctcatgtaccaaactgaaccctttatctctctctccaatctcctctgttgtggaggatccagaaactagggtataatcctccttctctaagacatggagacctccttctcacccaacactcccacctgaagcaggccctcaatcctgtagattctccctttttaacattcctcaaacatgtgtcccactgcaactaattataacttttttctttattgtaagctggcttctcagattctaggatagctcaatataacatccccataacaaatatttatcgagttgtccactaggtaccagaaatatgcaggtggataagtaaagagccattgcaatgctgctaggacatgagtatatgatgctattgggcatgcacaggagggatatctaacctagtctttgatagctcagagaaggcctcctggaggtagtggcaatcatcccgcctttgaaggctgagtgcaggtgtgttagccaggtatagcatcagttgatgtttcctgggccaacatcaattacctatctttgggaaagagtatcttgacttacgaggaacctcttcccctaccctacaagtcactgttcctgtgatttggttggagctgactccaatacagcacctccactcctcctgctttccaggtgggaatgtaatgcaggtttggccattcggtgcattccaaccccatggcctcagtgactgtttcagagatgagcccatgactctatcagagtcaatatcaggacttttgctgggaggtgcttagtttccacggacatgactgcgagcccaagatgtaggtctagaaatgttggccattattttgctaccctgtactgagagtctgcctgagaacagagcagagagatggacagaaaaagacacctgattctgatgacaccacctgggttcatgaacgcagctatgcagggagctacttctgagtaaatacactgccagaaccagtgtgagttaggttttctgccatttgtaactaacaaagttcttactaatgcattaaggaggaaaagagtattctaggaggagggaatcatacatgtaaaagctcagagaccaagaaactttgacccattctatgtacaaagttctatgtgaccagagagtaggagagaagagtcacttggagaagaagctagaaaagttaagagccaggcttttccagtagaatgttgctctgccagagtcaatgtcataaaatgcaaatgtgatcatgcaattcctctcccctgcttaaaatactttaatgagaccccaaaggttttaggatgaagttcaaacccattagcttggcacccaaggcttttgatgacctggctgttccttctctctctggactcatctcccacatctctcccatgggcaacctgtgctccagctaaattaaactacttgtagttttccaaacagggcatgctgtttcatgcctttgtgccttcatattgcaatgcattatataatttaatcctcacaagggcccccatgaagtgcatattattatcctgatgttcccagaagtatagagaagttgaggagcctcaaaaatcatacagccagcaagacagagatctaggatttgaacacatatgtctgacaccaaagctctccttctttcttttctactaccactcattccagttcttttaacttctggtcatggacctttatgttgcacagcctggtcttttaatggaatcaataaaatttcagaatttcaggagtgggggctggagggatgcataatgttcaatttaaagctactttgctactaaaatcaacacaactgcatcttctttcagtccaccttttttttagcatctccttcatgccaggcactgtgtggagagatggtgctacagaggtaaactaatccagctacagtccttgccttcatgggctttcagcaaagtaatctactcctcacacttaattctcctgagaaggcttcctggatacacttgagaatgaactccactttggttatacagacacatggaactccatcactgctgttgctgagaaaatatcaatggctacattattttcaactgctgcctatgagttatatcagagattaattgatcagctaaatgagaaaatgcagagaatacacaaggaataaatcgatgaaggaaaaagtgtgctgtgtcttctatacctgggatcaattgtgttacagctcactcagagaggcaccagattgccaaacagcctgcttgcaaggggtcacaaatagggcaaatcaccagcttaacaacatgtgaaattttcattgtcttatttataaccaatttctcactaaagtgaacaacatttcttaatggtacagttctgcagaagaacaaactagaaatgttttctttccttctaattgggacaaaactgatcatcacctaatgggctctttacagagaataaaagaaactaaactaaaaaaaatgctcagcacgaattggacgctaaggattaaatgaaaataaaaggacagttttgtttcatttttacctcagatctttaaaggtactgttagaaaaatctaataattgttttataactcttatttggtagaaaaagctaattattattaaaaattttaataaaaatgagaaaggattgtcgagaagtgaaaaattaaaagggagatttccaatgttgaaaaagcaccttttatgaacataaaaatctatcagtctgtcctcccctaaccatatttggataggatctgacacattaaaagctggacgttagcccagttagcctgagtgagaagtgattcaggagacaccagacataaaccaaatggctggccccacaaccagtgggtaaaagatgcttgctgtccagcagggtctgcagagccaagtggtcacagtgcccagagaagcccccttgggcaggcgacccctacaaacctcagcttctactcctgggcagaggcttttacagtcctgaaaatgctatgctacagaagagacattctgcgagtgaaaaaagccattattccacccaggaaaaagatgatttttttttcccataaccgcagtggccatcaaaaaatggattcatttttcttgtgctgtactctgggcccataaaatagtttcaggatctcaaaaagacgatgtcgtagatggaagttttgttgcaatgagccagccagaagtgagaatgactttaaaagactgaatttttaaaatgctctaaacccaaagattaagaaaatataaaatattacagataggtcactccttttgtgttgtgtgagttaatcatgtttattcaatgggtcccactttaaatgcagtatgtcaaatcctaaaatattattcttagttcttttaaaattacatgacatattctcttatcaacataggccaataaaatacaaacaggcataattggtgcaagacaacccttaacagctagtccaggttaatccactggcatggattagattatgaaaggtttaaataactaatttcaaagtcttacatatacatcagggatttcatttgactaagcttagtgattatttgagtgttaaccagagtaagttgagaggctataaaacccatgccaaatcacattcaataacatgagacctagggaggtctaactggaactgcagaattgacgtgaaaaaaatactaaggaatattttcattatagatttatgaatgtgaagtggattgggatagattttttttttaagctaagggtgaaaaaatagagatttagtgaaaataagttagggcaaaatggcaccttgtgatttagaattgtatgttttgcatctcatacccctacagaggctggctgtgccttagacacagtagtgatttgcttcttttgggggcagtggtcttcaacatttttggcaccaaggaccagtttcgtggaagataatttttccatggactttgttggggggtggggaatggtttcaggatgaaactgttccacctcagatcatcaggcattagattcttataaggagtgcacaacctagatccctcacatgtgaaggtcacaataaagtttgcactcctataagaatctaatgctggccaggcacggtggctcacgcctgtaatcccagcattttgggaggccgaggcgggcagatcagaaggtcagcagatcaagaccatcctggttaacacggtgaaacatcatctctactaaaagtacaaaaaaaaaaaaaattagccgggcatggtggcaggcacctgtagtcccagctactctggaggctgaggcaggagaatggcgtgaacctgggaggcggagtttgcagtaatccaagattgtgccactgcactccagcctgggtgatagagcgagactccgtctcaaaaaaaaaaaaaaaaaaaaaaaatctaatgctgccacttatctgacaggaggcagaggagctcaggcagtaatgctctctcacccactggcccactgctcacctcctgctgtgcagcctggtttctaacagcccacagagagataacaggtctgtggcctgggggttggggacccctgttttgggggatagttaattctagtctaaaattcatcttcaatagttgaggaagtaactttgccaatgtgacaaagtaaggtaggggatacaaagttctaaaatcaagatttcctgaccaccaggtgttatgttttttactaatcttttctaaaaaattttacgaatttagggggtacaagtgcagttgtgttacatggataaattgtgtagtggaagtctgaactttcagtgtagccatcacctgaagagtgtacattgtatccattatgtaatttctcatccttcacccctctctcactctcccaccattttgggtcttcaatgattattatcacacactttaggtccatgtgtacacattatttagttcccacttacaagtgagaaattgtggtattcgacgttctgtttctgtttctgagttatttctcttaggataatggcctccagttccatccatgtttctgcaaaagatatgatttcattccttttaatagccactagtattccattgtgtgtatataccacgttttctttatccactcatccactgatggacacttagggttgtgaatagtgctgatataaacatataagtgcaggtatctttttatatgatgatttattttctttaaggtagatacccagtagtggaattgctgggtcaaatggtagttctacttttagttctttgagaactgtccataccattttccatagagtctgtagtgacctactttcccacaaatagtataaaaatgctctcttttctctgcatctcaccaacatttgtttttgtttttggtttttgtctttttaataatagtcatctgatgaatataagataatatctcattgtggttttaatttgcatttctccagtaattaatgtttagcatttttttcattgcttttggccatttgtatgtcttcttttgaaaaatatctattcctgtcctttgcccactttttaatggggttatttgtggatttttgttgctgttgttgagttccttgtaaattctggatattcattccatgtcgtagtcacaatttgcaaatattttctcccattctgcaggttgtctcttcactcgtttatttcctttgctgtggagaagctgtttagttttattaagtcccatctgtcaacttttgtttttgttgcttgtgattttgaggtcttaatcgagaattatttgagtagaccaatgttcaaaagaggtttccctaggttttattctagttattttaatagtttcagatattacatttaaggctttgattcatcattattaatttttatatgtggtgagagacaggggtccaatttcattcttctgcatatggcaatccaattttcccagcaccatttattgaaaatggtattcttagtgtatgtttctgtcaactttgtcaaaaatcagttggctgtaggtgtgtggcttcatttctgggttctctattctgtttctttgacctatgtgtctatttttatagaagtgccatgctgtattggttattattgcctcaaagtataatttgaggtcaggtaatgtgatgtctaactttgctctttttgcttagaattgctttggctattcaggctcttttggttccatattacttttaggatttttttttcccaattctgtgaaaaatgacattggtattttgatagggattacactgaatatacagattgctttaggcagtatagtcattttaacaatattaagtcttctgatccatgtgcatggaatatttttccatttgtttgtgtcatctacaatttccttaatcactgttttgtaattttcctcatagagatctttcatctctttggttaaacgtattcccagggttcttttgtttgttttgtttttttgcagttcatttaaatgggattgacttgtggatttggttctcagcttgttattggtgtataaaaatgccactgatttttgtattttgattttgtatcctgaaactttactaaatttatttattaaatctaagagtttttggagacatcgttagggttttctaggcataagatcatatcatcagtgaacagaggtaatgggctttaatattaagaagttgggcaaaggggttcaccaagataagttctccttctataccttctactctttcttatggagaagagacagagccatattttcatgaactttcttgcatgttgactcataattgttttcccctttcacatgtataaaatatatctgtttcttaagtaaaagcaaaatttcttgtccttcccatatgcttctctgaaccctttctatagtgctttgtgcatggcttttgaatatagtaggaaatagaacaggatagtgtttaagaggtcagactacttgggaatccaatgtcagctttaccacttattaactaactggacttgaataagttagttaactcctctgtgcctcagtatctccacctgtaaaatggttacaataatacaattatcttataaggttacagggagaattaaatgaattattcctgaagctcttaaaacaacatctggcatgtggtaagcactacgtatgataaattaagataaaatgcttgctgaatgaccaaatgtttctttgcacctacaataattaatattactcattaattgatgaggtttccttaacaaagacatggtttgtgtctttgctaaactgtgaaaaactctatctcttctttgagataagcagaaagataaataatagctatgacacatatacctatcttgtaagttgctttgtaattatttattacttgctgaaaaactcaagtgggcaaggggaagaacaaggcagtcatgttaacatctaaaccttattaaagtttcatcttcttttaaagtccaggaagacaaatgagctaccagaggaattttctttcctctgtaaggcttatacacgaatttgaacataactattaaagtaaattaaatgggatttagtaaatggccaaataacactgtggtgggagccaagggagcagacagaagcaaactatcaagtttgggtatgaatttcaatgtctaagatgaagttagacctagtctaacttcaagactcctacgtggtggctcatgcctgtaatcccaacactttgagagaccaaggcaggagaacagctggaggccaggagttcaagatcagcctgggaaatacagtgagacccccttctctaccaaaacaaaacaaaacaaaacaaaacaaaacaaaacaaaacaaaattagctgcacatagtggtgtgcacctgtaaacccaatttgatggtatctggaggcaaacagtggagcccctgtgcagagcactctccctttctaccatgtgaggacacagcaagcaagaaggcagaactctgcagaccagaagcaagctctcccacaacacagaatctgccagcacgttgattttggatttcgcagcctccacaactatgagaaaaaaatgtttattgtttacaccacatagtctatggtattttattatgtaagcccaaaataagacagaggcaatgaaaaaaaaaatcacacaaaacacttttcttgctctaacactatgactgtttgatgcagaatattctcaaaatttacaattaaactagataatttctggctctttatgcagatgtgattggctttgcttgatttgtgttacctgagttaacaaataaaaggttaaaaaaccctaaaaatatactgttaaaattgttcatatttcagaatctgaaaagtattttgggagtacaatttaagaaaattaaatataaaatattatgattctcaggagaagctatgtacagagttgaataaagccacagctgccttcttcatctaggtgagaacagttctttagggtctaggagcaagcatagcaaagctctgtggaactctgcctcatggtcatcaatagatgtgctctctataatacaggggtaaatcaaactcagtatgatttgcctcatttctttacttctctcagtgttgtcttctcttctgccccatgtccttttcctattattggtcactatgctgactttgtgacatgtcaacttggctacagtaaactacattttctctgaattccctttgttgtatatttcagattagggtgagccacaagaaaaattcttcagagatacgagtcgtgggcgtaaaacagcagctgttgtgtagctcacacaagttcttgctaatctgctggtttttaaactcgtgatctgacttgtctgagagcatgccttgtggacttcaagccccagcatgagatccagtgataacagccttgcagagactacttccaacctccacaattgtataagccaggtccccgtaacaaatctcatactggttctgcttccctggttgaaatttgaatacagtcactctattgaccaggacgaccctgttgcagtacatggttgtctgcagtcacctggctggtagattcctccaaatctagggggaaggactaaagggcccccaagaggctatagtgatgatgtgataattaattttatgtgtcaacttgagtgggctgaaggatgcccagaaaggtggtaaaacattatttgggagggtatctatgaaggtgtttcaagaagaaattagcatcaaaatctgtagacagagtaaagaagatctgccctccccagtgtgggtaggcatcattccatcacttgatggtgcagaaaaggtaaaaaggtggaagaagggcaaattctctctctttttcagctgagacatccaccttctgcagaaaggcataggagctcccggctctcaagccttcagactctggaacttttaccagtggcctcccagttctcaggactgtggacttgatctgaattacaccactggctttcctggttttccagctgcagatggcagatcatgggacttattcccatgtgagccaattcccatattaaacctcctctcctgcctctctatatatcctatagtttctgtttttctgaagaatcctgactataccaacaacttggaaacttagaagtaacaggtaataacaatgatgctgcggatacaaacatgacaggtacacagcatgtactaaatgtagggtcccagtactacagactcatttttttctcaccaaccaccctataaaataggtactgttattttatctccctctatactctgaggcacacatagctgaaataactcgccagtaagtagaaagccaaaattaaactcaggtactctggctccagaatctgtgctcttcaatactattgcaccattccaaatcaacctaaatgtaatgctttccatcctctggctaccctgacttttagaaatttttcacaacagaaaaatagtgtgctagcctgtgacagtgcagccaggaaacttctgttctggtcctgatttcaccactgactggctgttgttaaagcaaactaagtatggcctgagaaggaccgcatacttctgtatctgagtgattgtggatgaactgtaacctagcttaacaggcagactaataggcctaataacaggcgaatagactaataggccaagctctaaccaatccagccatctgttcctcacttccaatttctgtacgtcacttccctttttttttcccttctaccatgtggctgcgctggagtctctgtgaatctgctgtgatagtgggggctgcccgattcgtgaatcattcattgttcaattaaacacctttaaatttaacctgggtgaagcttttcttttatcactgtgtagcattgggcaggtcaggctaacttccttacttgtaaaatgatctcagtgccttcttccagctataaaagttcacaattctatggtgttaaagttctgattatgatgttaaaagatccttggaaaaaagctgctctgtacaataaaattaggtaataaaacctacaactgtatatttgacttccttgcatttatttttcagcctcttcctacctcaaaaattattctgtagctccctaggtaattataatagtgattttttaccctttccaattgtgaggaccctgttaatcacacacatgcaaaaagagttgtgaaattccatagaagaaaaatataaaattgtaagttgagaaaaaatacgatagaaagacatgttacacttgataatgcttttaagtaaagttaaatttcactaattataacaacatctagagacatttgaaaaagagtgcatattcaccgtacaggaaaaactttatggagttactgacctacaggattcttaacagttacctcttggttctcagttcccactcagggcgctcctcactggtaatcacctattacaattgtatgcaacttgttaaatgtaactatgctaaaaatcaatatatgctgaaagccaaaaggaggactgttttatatgccacagctttattttctttagactttactgcctatttttgtgttgttttgtttgtttctttcatggtttttaaattgacagatttttggtaagtattataaaagtttctgatctggagaagtatcactcctctttgtttttcttttcttttcttttttttgtgtgtgggtgtgtgtatcttcattgtcatttagcgaaagttcccctaattgttaaaaagccaagagtaagcatcaagttagagacagggaaaaagtacagagtgaaaagcaattttaaaaattgcataatcagtctaagaagagtagaactggccacttttaaaggccaaagtccaaacaaggtctttaagaatttggtaacaccaatggcactcaccagatgggttaaggcaacactgcaatgggaaaggtgacaactgctcagtagaaggcagacatcatgtaaacagtcgtactagctgttttcttgtgtctgagtctatgcctagaaggggtttactttttccacaaaaggggaaacatactatgatacccctgaatatacatcctagaactcactgcttaaagaacacatagaaaaaaacaaggtcatgcaaccatccctaggaagttaccaaaattcattcttagttcccatctgggggcaaccctgatgagatactgcaagggaagaaaagaagattaaaggtaaacaggcgtagttcaatatcaacactttaggcaaatctttcctgattatcctctactttttttttttttttttttttgagacagaatctcgctttgttgcccaggctggagtgcagtggaacgatctcggctcactgcaagctccgcctcccgggttcacgccattctcctgcctcagcctcccgagcagctgggactacaggcacctgccaccacgcgtggctaatatttttgtatttttagtagagacggggtttcaccgtgttagccaggatggtctcgatcttctgacctcatgatctgcccgctgcggcctcccaaagtgctgggattatcctctacttctaactctcaaccacgagctgaaacaccctcactttttctatattttgccacacttcagttatacacaaccatggtttgcactataaatatatggtacctctctgtctctcccattagaccatgagtgagggtagaggaactgggtctcattcattgatctgttcctagttcctagcacggtgtctaacatatgggaactgctcagtgaatgggaaatggaattaaatatatctattagtttgctctagagatccaaatttcaggtaggaatccaagggaaatttttccaagtatgcataacaattatcaaactttgtgtttctcacggattgttgataactgcctttaattgtatttaaagataggtagtattcttttgaaatgtcagaaaaggcaatggcaaaaagccttcaatttggctgtgatcccaattaaaattcttcaacccaaaagaaatagctttgatctgatcaaaatgtatgagtttctttttttgtcaccataatttaaagacagaaaaatggtatttaggatttacatatacatgtggaggccaacctcattatgatgattgtactgagaagccaggaagttctgaatcataaatgtattttcagaaaagaattgtattttcagagggggaaaaaaaagagctacaacaatagctctaatttaactggagatgttcactacacaatccccgaagagcaggataaattgtcgagagcatcagcagactgtctattcatttggcatattagcatgaaagggggctttttgcccagtggagcccaacctcttctctacaggatcttgcttttgagatctttgaaacaagtatttcaaatacagcatactgagatttgctctaatcttaactatggcattagaaaagtcattataactttatgcataagttgttggtgtatggccaagtcagaaatcttgccctgaggaccaacatctacataataagagaaaatagatacgtgtgcagccaattattagatacctctggtgatggcaactagaaactacgtgaagtcatggataattcaacataataacaatcactatatggaaaaatgttcctggctcatgcctgtaatcccagcaattttggagatccaggcaggtggatcacttgaggtcaggagtttgagaccagcctggccagcagggtgaaaccccatctctactaaaaatacaaaaactagcctgacttagtggcgggtacctgtaatcccagctactggggaggctgaggcacgagaattgcttgaacctggaggtggaggttgcagtgagtagagatcacgtcattgcactccagcttgggtgagagagtgagactctgtctcgaacaaagaaaattttgtaaaaaagtaaacgatgaccccacactaaaactatgaaaatcaaagttaaagaaaaaaaaccttttaaatcaatttattttaccttaatttattaaaacatgtacatttgttagacatttatgaaagacctatttggtgccagacaagggtgatcatctctaagactcataaacaagaagttgtaaatgttacctaatgtgatgtgccatctctaatgccctctggaacccatttgagtgtggagaactctgtggctgtctacacaacatccatttcacctcttgtatgtgaatatataaaagtcataggattggtcactactgattccctcttcacaggtagctgccctaatttgtcttatctaattaaggttatgttatcccctttgtcaaagtgattgggaaatatatcccagggataaaccaatcagtacatggcttttttcccagctacaagagattggttcagggaagagtatttaattgattttaggtccatgaaggtatctgggaagtgaaggctccctgggagcttttgtaaaggatagttctgcatttctcaggaactcatgtgagaaatttcttgggtgatatgttaagtagatttgtagattggattgatgacagccatttatccaccttgaaacaagccatcttaagaatgatgttaactcatggaaagagaaaagccaagaaaactacacagaaagatggagcctgagccttcaccaaattgcagcacaagctcaacctatgtctagacttctctgaacatacggcagcttgagccgagtttttgttaccggcagccagggcatcttaattattataactgtaacaggaactgtggcatcagagctgatttctgaaaggaaaataggatttagacaggtgaatggtaggtatgggaattgagagagccctttctgggacaggaaattatgggagcaaaagcaaaggggtaggaaaacacacggtatgttcaggggcgagtctatcacaccggatgagaggtggaaggtgaagctgacagtaggttgggggtggtgggggactttactgacccttctggaaaactaactagtggtggaatgggagttggagcagaggaggagaagcagatacaggtggttgttaccatcatctgggccagtgctcacaaggacccttgctcacaccttggcagtgaagatggagtagagaggatgagttcaaaggccatgccaatgacaagctacacatgatgtggtgtcgcacttcatgagaagcaaagagagtaagaaatggactatgaagtttaagtctggggacatctggtaaaggctggtgccgttaatcaggaatgataattcaggcaaaagagttaaactaccttaaataatattttttttctttttttttttttttccttgagacagagtcccgctctgtcgcccaggctggagtgcagtggtgcgatctcagctcactgtaacgtctgcctcccagatgcaaatggctctcctgcctcagcctcccaagtaactgggattacaggcgctcgccaccatgcccggctaatttttgtgtttttagcagagatggggtttcaccatgttggccaggctggtcaggaactcctgacctgaagtgatctgcccgccttggcttcccaaaatgctgagattacaggcatgagccactgcacccagactggaatattttctatataatttctttaaaaagtcatagaaacaacctaaatccaaactaacaaggagctgaatgactggataaattatggtacatttcctgaatgagtgaaatactctgtagtgagacattaacattttcccatgtgtgactcacttgtctgataatatttccatgccagacacacccccataataaaggttcctcactccatgtggctgcacaagggggtgggttacacgtttatttttcaacaccatctctttctttctccaccacaaataggtcccttggcactacacagttgaaaactattgtttgggaggatgtcaagaaaaattctttagacttggagaaaaatataaccaaaagaaactgttatctgagtattgaaaatttagaagactacatacacatggaaaaaaaagatacacacaaatgtgcttacagtaattacttctgagtggtaggatctagagtatttttttcttttacttttttatagtttctatttactttctaaaatgcatatgtatcaactttataattttacaaggacatcaattatattgggttcttcagaagcagataatgaaatgagggtttgtgtgaaaatgatttatgaggcagggaataatttttaccagcttcctcatttgtttaatagtgatgatgtgaaaaagaaaccagtgagtgagtagggaagtgagaatcatcaagggaagagccccagcaaaggtgtcctattaagcaaagtcccactgagggtaacttgagatcaacttctgctgacctatagaagctggggaatttactggccctcctctagtcagtcactattagagagctgcccccataaatacgtcaatgcccaggaacttctggttcttcttgcaggtaggaaaatgtggggacagagaggctgcccaaagagacacaggtgctggctgctaggagtaggcatgggcatggtaaagggatctgagggaatatgcacggaacaacgaccgcatttgctggagatgcttacaaaatcttactgctgtaattaataaatatggaaacctctgtttactaactgtgttcattcatattaaaaacatttacttaaaagaaagaggactaaatagtaatacattgttggccagcacttcttactgggaaaggagatttgaagagtcttacttttgtaaacgctttcctaagtgctacctgcaccttaaatgtcacaccttatattgctttatgttctcagagttcacattctaaaactcatacgttaggaattaggaccagtggatagaaaaacttgatgacccctggggacaccaaatgttgattgctgcttgttgttacagaggcaagacaactgaagtttggggagaaaaatctcccttcctgacagcaacatgccagaccattaagaacttttgcaaaaatcaatattggtctgaattattcaactggtgtgcaacaggatatagtggaatgtaaactattgggcttccaccaaagatttgtggctggcatccactataaatacacaaagtaactactctctagggaggaaaacagcgagaggagcaggaaatgccaggtttcagaaaattagccaaccaagttcacccagcataaatgctgatgcactgccatatttgctaatataaagggtggaccctctgatacattacatgttgagaagatcctcagcttcttgccatgtttcaacgtggactaaacaaagctattctatcctctgagcttttaagctcccttttcaataaataaatcacaaactaaacattttgaaagtcatctctttctcctgtccctgagagtccagtcataggtctacacagatggctgtcaaggtggtatgatttgaggtgtgctgggaaagtcctgtttgtccccaaatatctcccctctattggcctgtcagtcatgaggaatcaatcaagatagggcatttcaggaatcagaggatacagtagagaacaaaggttctgaccctggtggaatttatgaacagatttcaggagtcctggtttcccaaaaattatttgagaaataccatgtgtatacacatgagtgcatttccaggttagagaatccagggctttcatggtattttcagagtaatccatgacccatgaatggttaaggatctcaggactgagtcaggagatctggttctctatgcctgtctggctactggctggccatgtcatctcagaccgagactctccctgcacttgcttcagattcctgcatttttgaagactgcctggttaaagtcttggtgctccaccatgtctctgtgtgtaaagggccccctttccaagactgctgaggaaaatggccaaatgcttcttttgtacctgcttcctatggatccccctcagctcagggaatagtaatactttaagacagcattactggagaaaggtagaggaaaggggaataacagagaatgttagagaaagaagggggagagaggtgagaaagagggagagagaaatgcctctcactgatataggggtgtctgtgaggcaaagtcaaaacaccattgacaaaggtggtcttaggatcagtcccttgccccagcccccgcccattcattccctctcacttccaagtacagctgcaacattcaaatgtttgaaaattcattttttagaggttttcaattgaacaaggacaggaggagaggaattacttatgcgtgtatattcatgtttagtttttactttttaaattatgaaaccatcgtgtcttccaacaagtaataaagtacaagggaataattttttactggcttcctcatttgtttaatagtgatgatatgaaaaaaaatgaccttttaaaaacacttaaacggttaacttttgatctcaagtcttctccccacagcttaatttattaaaactaaacacatcttgacattataaattaggaaagttgagagggcagtacactataattagaagcctgggccaggcattctacagaacagataactacaactattacaagccagcttactgaaaattttattggatgtcattcatgcacaagtaatgaatgaagaaccaccactcatggaggggctgataatacgatgggtagggtgggtagaagagggaaaatctttctggcccctctctgcattctagcctccgggcttgagactcaccaccaacactgcttataaacatgaaagggattctgtttgttcaagtgctgtaagacctatttttttttacattagttaaatttttatttgtattttattttttctcagtttttttatttcaatagattttggggtacaagtggtttttggttacatggataagttctttagtggcgatttctgagagttcagtgtacccatcacccaagcagtgtacattgtactcaatattgtagtttttggctgagcatggtggctcacacctgtaatcccagcactttgggagattaaggtgggtggatcacttgaggccaggagttcaagaccagcctggtcaacatggtgaaatcctgtctctactaaaaatacaaaaattagctgggtgtggtggtgggtgcctgtaactctagctactcaggaggctgaggcaggagaatcacttgaacctgggaagcagaggtttcagtgagctgagattgcaccactgcactccagcctgggtggagtgagatgctgtctaaaaatatgtatatatacatagtagtcttttatccctcacccgcatcccaaccttaccttctgagttcccaaagtccattatatcattcttatgcctttgcatcctcatagcttagctcccacttacaagtgagaatatatgatatttggttttctattgttgagttacttcagttagaataatggcctccagttccatgcaagttgcagcaaaagacattattttgttcataagggcctatttttattcactatgcaactaatgtaccaggcataatcccacaggattacttaagagctcataatgggcttgagactagagatggtcctcaagacagagtccatttctggtcacccttcagggctcagggaacactgggccctagctgtgatcaaatttggtcatcactgctgcactctaagactttcatggggtatttacacttaaaacataccaaatagaaagacatggggttatgacctgtaaatccttgtagttggttaaatctattctaagagcaaaaagtaatatagaaactgaataacagtaaaaaaaataactagcaacaagctaaatgttcaataatagggtagtaaaatgacttatgattgacaggatattatgcagccattgaaatgacggtaggaatcattgtaggtatcattgtggtaggtacttatgatgaaatgttaaattttaaaaagtagtaaaaacttatttattctttttcaaagatctgggtctctaatcatgccacaagattataattaagaaaaaaagaaaaatatcccataaagaaaaaaaaaagttaacattttgccatggaagagaggtgttaagaagtgatacttttcttcttctttttcatttatttgataattatattatcaattatattacacttgtcttacttttatactgatacatatatttataattaaaagaaacattaatattacattcacatattaattaaaattttaaaatattttctcctacattaattcatttgctacataaaggaaaagtaagaaaactaaaagtcaagttgctagatttggaaactagagacagtgagtgaaagttggccaagtccccacaactgtcagaaacagagcaaatcctcaaagacagggttgttaatacccagtctagagctctttagcctccaaatcaaaaggctatttctggcagaaaaacaattacatctactagagaatgtattcagggaaagaaacatcttctgttattgtactggacctctgctgtttgtacctatccattccagcactatcagcatctccctgtgacttcctttggtggaccactcttcccacattcatggtccattcatacagttttaggcagtgcctaccctatgtcccaaggccatggttatgcaatggcccatgctggacaatcagtgtagtccaaccagtttcaagcttatccaatgagagtgagccctgggatgttggctggaatgacattctttccactggggcggcagaactggcaacacagaaatctggtgttcctaggtgaccctttttactatctggagagatcctgcctgagaataagataaaccagggagaagcacagctaagaataaggtaagatgattcctggtctcatggcctgaaacctgggtctagcaattcctgagacttgataacactggatgttacattttcatgagtcgacaaattccgttatctccttttaaggcaatttgaggtaatttttattacttgcaatcaaaatactcctgactcatatttctgccatttcccagcaaagtgtatacaaacattttctggttaaaaaaataattattgatgaaagaaaccattgtagttctatatcatgtagtcacaattgcctgtgttcattcatcactgttgtgatctatgtcatattcttccctcgggcaaaaatattttagcatcttacaagatgctaaataaaggggcaaatatgaaatgaagcaattacaactatttgttttgtctcaaatgggtgtgttatagttcctaattaattttggtaagtcaacaaataactttatatatgttcattcacatttgacaatctgaatatgtatgatgcttaaaaataagttttgataaacatatcttaattgacagagcagaaaaggaggtttcttaacttgccatctatatccaatctggatttagacttttcaataaacattaaacatgaaaacatttttattagcggtaattatacataatttagataagtgattctgaaactttagtatgcatcagaatcacctggaaaacttgttaaaaaaatttattgctggccactgctcactctctctccaggtctctgattctgtggggctgaggttgggcctgagactctgcatttctgacaagttcccaggtgatgtcgacactactggtctagcaaccacagttcaagaatcactgatttagactttgtttttaagttttgcattttgctgtaatttttatttggtgtaaactgtaatatatattttatgtctccgattaaaaacatgagcccacgttttctgagatgccgatataatttagacctgaaaattctggacacaaagataatgatgtgctttaaaggtggatgggaaacaacagagttaaagtaatttgggcaaaaccttgattaaaataattcattatggaatccaatcaaccttaatttccaacagatgacatgaccactcaggtattccgctacatcaagcaaaattcaggctcaaatgttctcctgctgcactgattagcaaagttcaccaggccaaagtaatcaagtataccacaaattcctaggtgcctttttatctctgcctaacacaatgcaactaagtggtctctgtctgccaacgggagtaactcttaggaagagcaacgaaacagtttgctaaaacctggttagtctgcaggaagtcattaaaatgatagaataattcaggaatctgatgatctccaagtacaatgccttgtcattttgtgattatttgataattccaatccacttcattcaagtaagaggttctgggactttaaaatcaagtagggtctgaacctaccagggtctgaactgagttttacaatgttaaagcacaacatcttactgtcttcctctggacatacccaaatgggttttctctgttggtaaacaatgacatttctccctatctttccattcaaggcttaaccactaatgaagtaagaatctctcatattttaacaactaagattagattatgacagaaacttcattaaaagtcacatgtaaaatatcctctttgattgcatatcaatttgaatatagtccattttaacataccttgtcaaaagaagaatatacattaaatgtaaaaatgtgccaatgttagctgcaaggctagtaaatcaccagttggcaataaggatatttatttctgtatagtgaggaagtgtgataacatagatgcaaagagctgagagaaagcttacaatctgcccaaacccctctttacacacaggaaggaaataagctcagaaaagaggaatattttatcaaaggagttcacttggctgtaaaaatgatgttgccggtcataaagtttttcattttcccagtggagagagtcaccttttcaacacatctgcagcagactcagagcagggtggacagcacagatgttgccaacagcttcaggttccagaaaggccctgagagccagaagacaccgatgacaatggaatccacccaaccaggtaaaacttaactgaagtcaacatgctgccctgtgatcaaatcagaaacaactgtgtaagaacaaggcgggtgaaaagaccttaccaatgagagttcagaaactgcagacatgagtacgtagcctcctggggctgggtgaagtgtgaccgcacacttggtctgctttaagagttgtgcagcatgtgtagaggggacagaggaatgagagtttgctctgctcttcactgctcagatgggaacttgagttgtgtttggccagatgccacactcataaggcatatggagaaatgaggtcattcagggagatggatctgaatggtgcagggacttgaaccgtgtcttataacgcaagagcaggaaaaacagtggttatctagcccaaagaagaaatgttttgggggcagggggaatatgggagttatccctgggtgagacaagttgtcagggaaagagggattcaattgttctacatggccttaggaggcagatctagcactcatggatagaattagtgggagacaggctggagagaaacacagagaagtaattctaaaaatgagagatattcaaagtgaatgacagctaaatacaattttatctaacatttttattgagtccttattttgtgccaatttctgtgttaaggaccttaaaattgtcatctcatttcatccttccaacaaccgtgttaggtacattaccatactgatttaaatatagagcaatgacagctggaagagcttgagtaacttgtccaaggccacatagctggttagcgcagtagcctggattagaactcagctatctgctaagcttctcgacctcaccacgatgttgctatgggctactttgggaagtagggagtttcctgtcactagggtgtccaatgtgggcaaacatggtcttgtaatactttaatattctcttccagtaggaagaaactactgttctatgctttgtcctgaaagagcgacattttgagcacgtagagctatctttatataaataagagaaaatgactctaaggacattgtgaacatgtcataggattttctcttggcccaaccccagccaagaagtcactgctttcctggaaccaagaggataaatgagggactgtgggcaaagggaagaccttacccaggcagcagagatgggttcaggagttagagaggctctttggattccagaggcaaagccataggataatcacctatggatatgatggagaaggccttgtgctctgggtcccacaacagagaaaagacttctagggagctttgattaaaactggccccaagcgggttgagttggccaagacactccactggggaaaggctgtgctgctggtcctcaggggacaggagaagggaactcttggatgacacactccctacacccagataagttcctggggaattatggtcctagtaaaggagctacctgaaatttctttccatagtcccacttacatcaacaaatactgggggatcccacctgctaaggtgaggcgggggcaggggtggggtggggaaatgatcataagcacagtcaggggtttctccaactcctttgcttggaaggaagacaggacagatgaacaaggggatgtggccacagtggcagcaacgaaatcatctagttagctgaaaggaggatctctgtgcccttgggaatcgatggaagtcatatcccaacagctggatgcgtgataagacactaagagcccacagcacgaatcgatggaagtcatatcctatcagctggatgcgtgataagacactaagagcccacagcacccagtgtcaacatccttaatgggtcacttctcttacaaactgggggaaaaattacctcaattttacctagagataataacccttaagattttgctattcactctaagaagaaaaagaagtgcctcttattgtaccacaccccatgctagatgttcaaaagatgttactttttatttaatccatttgcatatgtattattgcttccatcttttagatgtgagattgaaacccagaagtacatccccaaacttagtgagaggaccaggagttgaacccagggctgaaggattcaaactctttactcatttctaccatgctgcctcagtattacgaaaatgtcaaaacactaaggtgatgtccagcatcaaaacagtaagctctctctacttcttctggctataattggtaaaggcaagtcccattttcctttgtcaggaaattcatattcgtgtgatatttatcacaagagatttgcattttaatacagaactcttggacagggaggtggatgtagctaaacatagaggaaataagtgaaatggaagaattatagatgatgtcagaatcagaaaggaggggaagggaggttggccatgtgatcccccctcaggttgcctggtaatcaatttccaagtctgctgcagcaaaagcgtcaggagatgaggttccataagatattctttgagaaagaggctgtcctctggtagagccaatatgagtgaccttctaaggcacccagaggaaaacaggcaattgatactgtatctagagccatctttagggtgaagatccagattcaattcagtggtaatgagtaatgacaatgttttgctggtctttggaatttataaacctataggtgacagcggccctcaaaaaactatttatctttctaatagcgttgactatactctcactgcccctacatgtcccaaaaacatcttaatttctctgttgaaaagctgacaaggaaatgaaaacttaacaaaaaaagtgaactccacttcatgaatgttttatcaccttcataagtttatatatgggttgggtgctgtggctcacaccggtaatcctagtactttgggaagccgaggggggtggatcacttgagctcagaagttcaaggccagcctaggcaacatgacgaaaccctgtctctataaaaaaatacaacaattcgctaggtgtggtggcttgtgcctgtagtcccagctactcaagaggctgaggtgagaggatcacttgagcctgggaggtggaagttgcagtgagccgagatggcgccaccgcactccagcctgagcaacagagctagaccttgtctcaaaataaaaaagtttgtatatgaagccaaattattacaggatgtatttttgaaaagtgagagttataaaacattagatcaaaatggatgaaaaaagttgtggtgtttcttaaacatacatataaaaaattcagtctcacagggatatgtcatttctatttagaggatcagggttgttttgaatagtttcttatttgtcatatgctcaatgtgcattcaaatacaggtggcaatccttgaagaaaattaaacatgctgtgacttataaatcaaataggaggactataagaacgataaactttcaggttgttaatatgaaaattttttgaaaagtttttattttgggtactaaaaaaagttaagaagacatcctgtagattagttaactcttcataaaggtcattaaatggctttgaatagtatagctgatttaaaaataagatatgctaatttatgtactgatagagtaaatggaaactagcaataaagtaaaataagtgagtctatcctgggctttgtcacttcttggtttatcagtattaataataaagtgtaattttaaaataaagtgattccttcagcagatagtacacaattccctgcagctaaagaatggaaaagagattaattccatgacaattatcttggcttatcatccctttagcagggcccctctgcttgttttaaacctttctatttgtatgtgaaatctactgcctgggaaattaaaacaaatgttacaattcaacccagcgagctctgtccaataggaattcaaggtgaaatgtggctcactgtctcagccctccaggagcccaccgtagagaggacacttgttttcttttaaagcttaattcccagatatgggaaatgaagaattcacaagatttcacttcgggagatttcacgatagagcattcctttgctggtttcattgtcacctgccccaggtaactcatgaagtcttatgagaattgcctcttattcttcgggaaggattactatataccttctgctatgaaattaaccccagtgctgagatacacaaacttactacccaaactcaactcaccctgacctgagatgaatgggggattgcgaagtctttctctgaaccaacttctcagcatcctcacagatgcctcttggatgctcaagggaatacagggaagagaggggaactgtgaaaagtttctgtgggcagacttagataacaataaacggtaatgatgacagttttttttatctagccaaaatagatcccacttcatttactattttctatcgatgtaccctttctctgtactcttcctggtgcagtggtacaagcggggcttcaagggaaaagtgggcccctttatgaatggctggttagggggggaagcttggctatatgtggatttgcagctcattgcaacgtgattcatctcagttggttatgtgcagagaacagctggcagcaggtacccaactagttgcagagagaagttaaaagggactgttgcctgctgagagtgcagaggaattgctttaaggactccctgaagcacagcctgcagcgagcgaaggggcacaggcagggaggcagagaaccagcagcggctgacaggcagttagagaaaacagaaatcggccattcagagcaaaggtttggggccctaatttgagtccaaaaggtggaatggcaaatggtaacaagctcttggagagccccaaaggagaggctgtatgaaagaaatagcaccaccctccaagccccttaattcaatgccagagatgaaatgcaccagtacagaaggaaatcttggccaatgggaacaaggcctcgtggaagccccggcttctgagatgactacagagccaggtacagcgctccaccccttctcttgccttttccccacacctccactttggcaggtaggtagcagcccatggacacaagtaaatcaggtctaaagcctaaaacaccaaaagattaatacatggtgtttggctgattcactatgactgatttgttctgtggaaggaaagaaaaattcaagtaaattcaaagaggcctgtgaacttttggtacagtaactcagaagcaacaaagatccagagaaatgaaaagaaaagaaaagaaaagaaaagaaaagaaaagaaaagaaaagaaacatggtgaggaagaaggacaagacccaccccccaccctgccccatccagggataagaagaagcaaagaagctggtgaactggtgaggcctgggggccagtgatgaaggaaatcatccagaagcctaggaataaaatgtcatttaggtctcacagtctgcaatgaacacgtccttatttccgtattctgaggctttgacatctgggaccttgctgactctggaggggcagtcccttcaaggttggccaattgctagagacagtgaacaactcactcgtgagcaaattttgcaaatgcaagccaacccagagcccacaccacctccaaccagctctctctcactctcacatgaagggcccctgtgccccagagcctgctgaaatcattcaaactgccaactctagacctgttctccctgccttgcttgctgctccttcccacagaaaccacagtaaggattcctgcctgcagtttcccctctgccccttcctctgtctccagacagaccctgagcttcaccttgaagccccctcagggcatggcatccccctccttctgaaacctgtgagaataagaactatcttttcagtagccctcatctcctaagctactggctttgccatacctacataaagtaaaagctatatttaaaaacatggctcccaaaccatgtgtcgctaaaaaaaaagtccattctgatacctcattgaaaactgtcattttgtaacaggtgaacatggaataaatacattaacgtttaggctgggcgcagtcactcatgcctgtaatcccagcactttgggaggccatggcggacagatcacttgaggtcaggagttcgacaccagcctggctaacatagtgaaactccatctctaccaaaaatacaaaaattagccaggcatagtggtgggcacctgtaatcccatctactcgagaggctgaggcaggagaatcgctggaaactgagagatggaggttgcagtgagccgagatcatgccactgcactccagcctgggtgacagggtgaaactccttttcaaaaacaataaaaaagaaaaagaaaaagaaattactttagtctgttcactacacctttactcctagattgtatcttactaaaaatatttttgaaaaagtctccgttttaaaattgtgaactgaactagttcaagatccacataagatgatcagataaatgtctttttatatttttctccaagaaaatattatcagtgaatttactgaatttatatctggctggcatcaagaggtttcaatattacataaatgttataatatcattattattcttcaatatatgattattaaatctattgtaataattacatggcgatgagcatggcttagattccatgtgatgatccatgaagctcttatacctttgcaatgaggcccctgggatcagttttcagacactgaggatggggtaaggtcataaatgggatgtgcattcaagaatttacattcatctcaggaaataccccgacaccacttttggggaaaaaggaaaaaggctgtttgttttcttatttgtctttctctcataaaactagactgcagggagattttttggtgatttggatttccaaggaacccattttatcatacgaacttagaaacacctgcacatcatatgctgtttgcctgcagttgcttctcattttaagctggaattacctacagagttacctcccccaagctactacactgtatgggaggcagtctcctctaaatgaattcctgatcatcttagtattttatgagattaccaaaaccaatttgacttggccccaggaacctaagaagcaaaaaacaaaacaaagcaaaacaaaacagaaacagaaaaaaaaatgatgtcacaggaaaaggtatttttcctgtttctaagaaaggtcttgtggatatgattacaaatgagacaaaggtaagggaaaagactctatcttgggaaaaatgatgcaaaatttccaactgctcatgttccttgctctgttcttaaaaatatgtcttctttactttgctgggttgagatgctgttctctcaaaacaaaccacggacacgtgttacaagctgtatcttctttagaaacacagtcgaacctgctttctagaggagcccctgtccaccgtgacagctgagcagcagcacttactgactctgaaagggaggctgagcctgccctgggtgtgctgtaactaaggcgttccaattccaaaggcaaaaatgctattaagcagccaaggatgtttaaatctagaaagttcaattcataaattaaagatgtatttcagatatttctgaaacaggagtaattaccaaaactaagactgtagagactcttacaccatgacagctggtgtttataatctctcctcccacatccacatcttaaatctctggtcctttatcggacttgggtcacactgctttggttataaagtaaaactgcatatttcccactccctttgtagtgaggctctagggttggagctcatttgaatgctaatgaattagatcaccctcaaaaggttgctatcagaaatcagactacgtggatattttacagcatttcatagtttcagggtgatcgtgttcctgactcagcaagtcaagccaatacctatataacaagggcatttttctggaccccattctagagccacaatttttcccccaaggctatgtaacattttctcctggcaaactattagagttaatagaatgctgtggttctgttctggggactgctcatcaatcatactgctttttgaatcacaacttgtgtaatttttattcatgacacttcagtaagttactttgaagcatcacatctaaaacaacccagggactcactaaacaaaaaaacaaacaaacaagatttggggttttgttttccacttctactcatgatatactaggctttaacttactttgtagagtaaggattaaaatgcttaattggctataactaagcaaactgaatcctttagatgaatcaagccagccagctttcagtttctgacatcaaaatttatgctctgtgaaaaaaaacaaggccatggctacataacattaaaccaacacacaattaacaacactttgttctaattatctctgggaacatttaatgttgcccctatagttcatttttcttctttgatagctcttagaatatttatggagattagtccttgatgcattggccttctctgagatctggggttttcttagaagctcccacacaaatctgagccatgcaaagtaacatatttatgcagattaattcttgacatattggctttttctatcatctaaggtatttctaataagcttctacctaaatctggccctggcaatgcagggcagtcacagaccccccccactccttggcttacctcacactaagaatgtttttttctttctctcagcagttggtcataactgataaaaggttatgtcttgattgaacaagcttccaggagttggaaggccaaaagggctgctgtaaaacagcaatggagatgctaataaaacccaaggtaagaggaatcttcggctgcctattactgagaaacctaaattgcagacaagttcagcttcctcacatcaatagtgagagacaggccacaagaaaacgagcactgatcaaaggcttttgatgatggtagaacttcaatttatggaatgcacgtatttttctacactccaaaggcgtttcttctgaagtcactgggggcattcactttaaagtcataaatattctctccatagctcaggatggtttgcagcgccacttggcgtgtttgtttgggcatgtgatttgatgctctacagatggattgaagcaccacgaggagcttcactgtggaaagtgaaggggctattagttaagaacacctctaaactgattagaggcttgctgaggcaactgcatgagttttaaacatagatgttgttagctcttcatactgatgtgttggatagataggtagttccatgtactacctatctatccaaagagtgtgaacaagctaagtaaccaacagtgaggattaaataaatggcacttgcacatataaacaggccgagccacttggcctcatctctggccataggtgccctggcccttgacaggcccatgttctgagggctccttgaggctgtttcaggcttttctgcttttgtctaggcaattccctctgctcttcattttaccatctttgcctggagaactggcataaagcctcaaagactcacagttcaagtgcaacttctttatctctttgcttcctccaaaactaattcagttagatacttctgtcttggtgctccactgagccttgtacacaccttacatttttctaaaattttaatgtgctttatttttattaccttaattaattagtatatttttaattattatatttttgtcttctttccaacaatgtgagtatctcaagggcagaaaagatgctctgtatctctttgtaattccagcatccagcaggaggccaggcctagaaatgccaaaggagggagaggaaggtgtgctagagagaagacagacaggcagacagagagagagagagagaagagaaaaagaaagataatatgccacagaaggggaaaaaaaaaataagcagtaacattctttctgggtggtattaaagtaattctgacatttaaataactaaaacacaagaattttgccaaatctttgatggaattgatggaactgctggttgaaatgctccaccctccagaggccaagaggtgggcctacaactgaagtcaagccaatgagatccctctctctggactgtaggagctttgatgggatgactaggaaagagacatggccttttcacggtgctgctgatttggtgccatcacatagaaaaggcctgcctgagagaggaactagctcaaatgaaagcagaactgagagttggagaaagctttctgacattgtctgaacccttgcattcatccatgtcttgttacagctgattgtccagttatatagccatccttccttttagttaagtcagtttgagtagtgtctctatgacttgcaactgaaagagtaatcacaaatagaataccttgaaggaatactaagatttcccacagtataaagttttcccaagattttaggtctttgaaattgtttcagcagcccacggaccctctcaatattgtatcctatactgagtgacaatggtggccccttggagcatgtgggttgggtgctctttgcctaactgtgctgcctccatcagcttcatttctgggattcttgattttggttcttaaataagaaatctaactgtctatggacatgactgctttaaaagataatggtatgctttaaatattctatcacaatatgtatgtataaagacttaggcaccaggatgctcataagaacattataatattgaaatactgtgaacaaggtaagcagccaacagtgaggattaaataaatggcactcagtatccattgaataaatttctacatagccactgcatcatatttttgaaaagtattgaataatgtggagaaacaggctacttaactgtatacagtgatatttcatatatcctaatttgattaggtacaataataacaaaaagactagaaatatatatgctgaaatgccaattccagccatttctgattagtgtaattacaattattttcttatgatttttccaattttctgtaatgtgactatttactacttttataatcagaaaactgctagtacaaagttacataatgacatagaatggaatttttctaaaaacttcaagcccctttaccaaagaatagtttttgtctcaaatcctagcttagtgatgttgctaggtgacccacagttggatgtaaaacaatcaagagaaagataaatgccagatactttaagacagggatgtctggtgttacctgtcagcaaactgtcatagaatctaaagattagaaggaaacaattatgaatttctattcagaataccactggcacgttgccttaatttcttttacattgtcttaagataggagaggataaaagtaagaagaacaaggtaagaacttaaagccaattagaaagggaaagaaaatagcccgttcctctcactggcaaggagacaaagccaaacttggacatatccgtggccatgtcaggggagccctcaaaggtggcatgaagccactgaagagcactttggatgatgacctttccccaggcttcaaagcttgtggcactgggcacatgtgggaagggcctctggatctaagtctgaagacccagggaaagttctacttaagaggaggcaggggcgcagaaaggttagattacaaggtggttaagatcagcttcatccatctctgaaaggacatgaattcattcttttttatggctgcatagtattctatggtgtatatgtgccacattttctttatccagtttatcattgatgggcatttgggttggttccaagtctttactattgtaaatagtgctgtagtaaacatacatgtgcatgtgtctttatagtagcatgatttataatcctttgggtatatatccagtaatgagattgctgggtcaaatggtatttctgcttctagatccttgaggaatcgccacactgtcttccacaatgattgaactaatttacactcccaaaaacagtgtaaaggtattcctatttctccacatccttgccagcatctgttgtttcctgactttttaatgatcaacattctaactggcttgaattgacatctcattgtggttttgatttgcgtttctctaatgatcagtgatggtgagctttttttcaaatgtttgttggccacataaataagatcaatgaaagcagagagtagaatgttggttacagaggctatgggggtgtgagaatgcagacagggtggtcaaagggtacaaaatctgttgataatagagtattacacatctcaaaattgctaagagtccatttcaaatgttctcaccacaaaaaatgttaagtatgaggtgatggatatgttaactagcttgatgtaattattacatgttgtattatcaatcataacatcactctgcatgccataaatgtatctaattataaattaccaatttacaatttttaaaatgaccagtgaaagcttgttgggtttagtacagaactggacctaagttgttttgatagctttaaatgtcactctaaaagtggtttctgtggttctcaatcctggctgtgcatctgaataatccacagagtttcagaaaaatacagatggtcagtttccattgtagacttaaaagagctgggatttcctgggttacattctagacatctgagtttttaaaaagctctatttcttctgtggtttcatctccctagcctgcttgcagatctcattcttgcattcatacttctctctcccgcatcatcgatttcgccctctccactagaacacggccattggcacacgaatgtgccataccatcagctgccttttgaagagtttctcttgtaccctatttctcttcagttttgactctctccatgtctgacccacttcaggcctgtctatacatgtctccacatgttttcctccacgcccactcccatcagaaactgttgttaccgaggtcatagctgaccatgccttgccagagccgaggatggattctgtgatccatcttgctggtgctcttagcagcactcaacaaggatacccttggagcactttcttctttaggctgctacaacacttcaccttccattttcctcctaccacaccagacactctccccaggctcagatgctggctcctcttcctctgccagacctcgaaaaatggggaaccttagaactctgtcctctgccctcttcttgtccatttacagttacttctgatgggaccttaattagtcccacaaggccgagtgtcatctgtatgctgatgactctcaaatccatatctctagccctgacctgaactttgtatttccacctgcccatagaacatcatcacttgaatgcttaataggcatctcaacttaacgcgggcaaaaaccaacagacaattgcatgctaattttgctaagtcacctttcctccaaggcttgcctctctcaggaatttggtacaacctcacactcagttgctaaaaccaaagaactagaagttatccttctcacttttttccttgtattccacatccaatggatccgtaattcctaatagaccttacttctgaaatatattatctggctatttcttactagcatagtatagtggagctatacattgggagttcaaattctgactctctcactgactacatgaccttgggcaaaatttccaaccttctggggctcactttcctcatctgtaaaatggggataatagtgctaactactgttggggctcagaaaaaatatccccaaatgaaagcctcagaagccaaagtttttctctgatcttgtcctcctgtctcccagcttcattttcccctagtctagtcatagaaactagaatccctcttccccaaggcaggtcaaagaaaccagaaagctagacataaaacctaaaaaatattactctaattttccttctgcttttctatgtaaaatctgaccataaggaaattatctgacctgtcttgtttgctataggtcataagacccctattctagaagaggttttgccccacacccagaaggaaggaatgctgcaagcagaggccaagaagaatctagacaggcaggcctcacagggtttccacactcagtctattaccattagatcatactctttttttgtacagtcatctttctacacggctctctatactccgctgaacctaagcataaaaatggacaatttctcctgtgtctttgagtccccgttctgaaggctcctatgtatacacattgaaaataaatgtgtatgccttttctcctaccaatcagttggccttatgtcaatgattttctgtgaacctctaggcagccaagggctcccgctagtccccatactaccataacccacagggttacgaacatgaaaatagcatatataaacataaatggtaatcagaacagtgtttgggatatactaagccttataggaaggcttgccaacatggttattattattcccattacatccctctagtccaataacattaatatggtatgattatcattccctattagtcctaggcacctaccctagactagtctactaatattgtttgtttgaatctaaaaacaacaacaaaaaataccttctacctggtctccctgcccctcctatgtcccactattagcccacaaagcagaaggatttgtctttataaatgagaagttacatcattgcttcttcccagtttaaaattctctaaatggcttccttttacatttatatcattttcagagtctttattgtgaccatggcctatatggcttaaccaggtctggcccttgtctacctctgtgaactcatcttcttccattttttaaatcttgtaccttgtgtcccaggacagacttcttatttctgttccttggacttgccaagctttccagcatcttcaggtggcctttcacctttgcagctgcctcctcttgcaatgttcttcctctgatcttcacactgctgtctcctttttattttttatattacacacaaatggctgatgtcagaggtcttctcaagtaaatacctctcctacccctagctcacattctctctgctactacctcaataaacttttcttatttacaggcatatagttgcctgtttgcttatttattatttcatttaagtatatgcttcctgtgtctgcccactggggtggggaccaaaaaaactgatctaatccctgtgcaaagaacacgtttggcccatagaagatatttaatatatttactattattaaatattatattatttatatataaatatattaataatatattaataaatatattattaatatatttaatattaatatatatctatcgactaccagttctacaggtaattgtgatgcacagccaggtttgtctattttgaactacctaattttaaataggaattaatgattaacaaaatgcttatgcacagcactgtaattgtcatcatttcatggaaaggtataattgagtagaaaaagctgttattcaccttaacacatttaattgccatatttttctgcacaaaataaatcattcctagaagcggccaagttctttcaaccttgaggctatctagctaagtcatcagcacatgcttttaggcttaggactctcaggtggtggcgggcctgttctccccctggctagaagctgagtatcagagatgccatgggagttgggagtgagccaagggaacatccagcttcacttttagtcaggtgtgcagttggtccctgagtggagagaagggccacgtgggagtgtcaggagtggggcctgcagacaaacaaatcatgtctttcaaggaacatgccatgagcaaatctggggcctgagtggggcaaatgcccaggagtagggaacagggaagactccagatgaagccagtggatcctggagggcaggtctgggaagatcccttgaatcagtggcttctggtggggtggcagaaaggagtgatcctttcgtagaagggacctgagacatggcagtgctgttgagaatggtgagctttgttctaagtcaaataaacagtctctgaaacagcagccttgaaaacccaaacttttaaaatacatagaaaatgctacagtcaggcactgagaagttacataaaatgtgcaagtggcatccagattgtccatgtgtgccctatgacaccaatatacaccaagtgatttctcctccaggcaccaggaccctaaacacaaattacaattgaagcccaggggaagcagtggctgggtagtgagggtaaacggtctactcttcaccatgaaaagctggcaacagctgaaaccaacgtactcagtagagaaaatcaggctaaaaagagaaagagagagagtgtgtataattataatttttataattttgactgttggccctggaggcgtttttaggaaggtaaaggtcttaattagcacaatattttgctgagcaggcggatgatatggaatgagcccatgacatggcatgcagagacctagacagctctgcaaattaaaagacagaacttggctgtgggagaaggtgtctgagggagaggagagtaagtgggacagagctggccacgttctaaggcgggatctgggaactgaggagaaaggctactgcgaaacgccctgcaaccaaaggactgggaggaaacagaactatcaaaagacagagttgaaggcccttagcctccagaatattctgccatgaccccatatccttcctagggttggattttggaaaaatcaagtaaagggggctctgtttcataagaggttggtgcgtggagaagaaagaggaattgattgacgaatgtgagtcggaacttaccccagaaatggtcacaagagggaataaataatacaggggtggcagctggagggtgatttgcttagacaatattaacttaattttcaaagtcaggggctcctcaagttgtttttgaatattactgtcacagtaatcaagaacgtaatatagaagtcatctctgcatttcattttccacaccttcttagaacctgttaggggagcaggaattaaagaagactgctgtccaccaccctgaaaatcattcctttctgtgatccacaacaccaggggccaagagattagggcatacaaatatggtcatttcaaaaatacgctgatggggtgctggtggtatattggtgagcctagctgccttccaaaaatatgctaatagaaaaattctttgtttttttaaaatcttgttgtatatcaaatttttccaaagtaatttttgacacattataattaattcccctgcaatcttccaggggagcatttcattaaagcataaaaatccacatggggtctgtgaccagctctgactgcagtctgtcaaaatcagttctctattttcctacaataatgtttaacccatgcaaagatcctagacactgagaatatggagcaaatattttaaaataaaaaaaattaagtagcatataaaattcatatgaaaattgaattacatgtatgacaaaatgacatctatatataagaagatatatttatatatatttacaaacatatatttgtatttcttattttacatactttattataaaatgaaataatcttcttattacctgttcaagtagaagatagtaagatgtgaaggcaaggagaaagttcatttaatattgaacaaagaattttaggaaacaagcagtgacactatgactataggaaaattaaaaaataaaatagttttatgaattaaaatagtgggtcttaatggcacttacagatatcatctattgcattcaactaatgctggaatcaagagttgttgcctgaagtgtaaagaactctgtggaaggaaaaaagatactgcttctcttttactcactacagtttaagaaacattcgctgccaaatacattttttaaagacctcttagcttaatgaaataaaatgtacttttcaatgttgtctctaacaacaacatgaactaagattaattttctctgtagtcataaacaaaaactaacaatttaagtacactgttctctgggagtaagaaatgataatatcagctctttcctattgtgaatctagttaattcaacctcaagataaagttatgagtttcttaaaactcaaataggaacctcagtttcccttgagaaagctttcctatcttttatagtgactatctttaaaaaatgacgaaagaatgagaacccttggggagacaagggtgattcctagctctttgcccagagggagttgctagcgattcctttagttgatatttgttctgctctgtgtttgaagctacttgcttacctgtctgccttcggtcacacctgtgtggagtagcccaactctttcattcacagtccttatattgttaatcactgtgcccaggtaagtaggaacaaaattaaggaaaaggagcaggtttggtgtggatgaatgaaagagactatgcaccaggcatcattttaaaaataattacacacgtaatcctcgttacttccctgtaaggctaattactattactatccccatgctttcagctgagggaacagaggcatggggagcctaagtaactttgatggtttcaaatctagaaagtagtcgaacagggattcaaatcaaaccccaagaattgagcttcaaagtgcataatctcaccattctgctttattatcaccgaggaaattagtgtaaaatggatatgctcattatagacaatgtggtagatctgaggtagaattgcagaaagcaagcatagaaaacaaggcccctccaggtctttttgtttttttgtttgtttgtttgtttgtttttttgagtctgtcacccaggctggagtgcagtggcgcaatcttggctcactgcaagctccgcctcccaggttcacgccattctcctgcctcagcctcctgagtaactgggactacaggcacgtgccaccacgcctggctaatttttttgtatttttagtagagacggggtttcaccttgttagccaggatggtctccatctcctgacctcgtgatccgcctgcctcggcctcctaaagttctgggattacaggcgtgagccaccgtgcccagcctccagctcttcttcctttatgctagtagagttttcaggattctgtagactctatggtagaactgcgtttttagatgttgggtgaaggccctttataagcttatcgaaaggacgtaagtgaactcatagaaaaaaaaaatctttgctgagtctttaagcatgtgacatttcaatcaagaactagtaactagaatggtctttgatgactgctataaaaattcatgaattaacacttgaaataatgtcgaatgccacgaagtaacagacgggtgttatcatatcccggtctggaggtctctggaggatgtcagtgctccaaaaatctccttaagtctccttagccagtttcagctcactgttagatgctttacacatttaattcctgcacgttttttttaaagatatgactatactgcttataaaatctctgtgtgtgtgtgtccaatcatctttacatactattaaatattttgcttagtcattcattcattcattcattttaccagttactggggaaaacaaagtaaaatatcacatagcctcttcccccaaggagcttgcaattttaggaactaatccagtttgagggctgaatttaagttaaaatcaattactgccctatgtactccttttaaaacaacattaggtcaagaccctttcagtgctaactttttgctcattgtagacaaatctcagcaggaaatcgtagatcatattagtctgggagaactcaaaagggaagatttatactcactcaaaaccagtgccaataaaagaagcagaatactgttatttttcttgaagagtgtaaaaattgcttcatttcttacctctagagctttcaatctctctaatagcaatttggtcttttcttttccctcatctgtactgctgctttcactcctcgaatcctcatcaaccaccatgtgaagatcttccaaagcttccttatgttttctctcttcctctgacagcttttcctgaagcaagaaagaattactgttttcaataatctccagtgaaaaataagcatgagtgtgaggctgaaaaggctggaatcattctcctgcgtgtgcattcttccggggctgggagtttgctaaacaaattctgagaggggtttattttaaaaaatgaagtagatatttttactgacccctggaaggacaaggccattgggttgccatctctcaatgcagttgtcctttgcacagttggagaagtgactaagccagcaaagccataggtggagtcatgtggttaatccaattttatctgcacaatgaaactcagctatactgcaaactgtggaaaaatacatcaattttgataccttcatttgtgaaaggcatagctcctcaagatagggtcattaaagtcactggacatgcagccatttaattaaaagaatataaaatatcacaaaatactgaaataagagtgatttcagaattcaaagctcacacctattagttctttcagctcaataatgacacaacttttaaggatccctcagtccctttctgtaacactgttcagcattcgtactatggccttgaggcagacataaaaagttattttgtcttgactcactgttggaagcccctcactcaaccttgtctctggaagctttttgaaagttgagaagtactaagttaagcctcatgaatagctcttgttttcaagggaaaaagaagtatcaagagattaccatattaaaaaaaaaaggatccattttgtgcatggagactcttgctccccacaatcaggtgacatccttccattacactatttaattctaaacacaatgctgcagaaatctttgctttaatgtagctggttgtcaaccatctgaacaaaactggattatcagtggtaaaagacttctctatattttaatactaaactaagatctatttgcaaatacagaagcacaaaacgtatcattcttaccctcaaggagctcatacaatctacttagaaaagaagaacataagaagaaaaaaaaaaccacggcgttttcaaactgtgctcatcaaggtactttgaaggttccaaaaatatttaagttactttttgaaaacaaattatgaattatgtaaaaatatgtcttaatgtatatgtatacatttatacatatatatgtatcagtgtatacgtgtgtgtatatataaatcactttagaccacaaagtcagtgaattcatccatgtgaacctgttatgtacagatttcaggatctaatttctcctgtcatctctgtatatataaatgcatagttgattagaaaggttgtagttctttatgaaatcaggcccaagcatgtgtaactgtataccatgtgcaggtgtgagttcagctcagataaatgccaggcaagtttaagatgtacatccacaggccaggaaacaagtccaggtcatggtagcatttttatagctttgattttttagggtttggtcacctgtcagacttacatttccaagataaggaatatgaagtttgtagatactgttcctaaacaaagaagtacctttacttctcttttgtggtttgggatgactgtaagtaaacactaacttaggttgatgaagcaagctgttttaaaattatcttcattttacttttctgtatatagtttttcattcatcactcagcatatgccacttatattttatacatatacatatgtatatatgcacacatacatatatccacacatacacatacacatatacacagtcacacattccttaggagatttcatcattgtgtaaacatcatagagtgtatttacacaaacctagatggtacagcctactacacacccaggctatatggtacctaggttagaatcctatataccatgttactgtactgaatactgtaggcaactgtaacacaatggcaagtatttgtgtatctaaacatatctaaacataaaaaaggtacagtaaaaacatggtataatcttacgagaccaccatcacacatctttataaggtacatgactctttgtgtgtgtgtgtgtgtgtgtgtgtgtgtgtgtgtgtgtatctgtagaagtatcctgtaataatcagagcccaatagctaattaaaacaaagaaaagccattggggtggtaaatgaaaagccaaaagactttggaatgtgacagccagatttcaggtctaacatttatttagcagtttggcaaatgatcttacacaaacttcctttatttttggaaatggagactcgctctgttacccaggctggagtgcagtggtgcgatctcagctcactgcaacctccacctcccaggttcaagcaattctcctgcctcagcctcctgagtagctgggattacaggcacctaccaccatggccagctaatttttgtatttttagtagaggcagggtttcaccaggttagccaggctggtctcgaactcctgacctcaggtgatccaccctcctcagcctccgaaagtgctgggattacaggcctaagccaccacacctagccttggacaaactttttaatttcaataagtcttgatgtctttgtctcctaaactcctaaatgaggctaatgtcaacatatatacactcacataccatatagtgaattcgtgtcattcacaatggttatgttctctaaaattttcatgaacagtacaccaacttaggaaatgtgaaattattgttcctaggggacatacagagttaggttcctgtgagcctctggtcacattttcattaaccagccattatataatcttgttttatgtgtatttctatttaaagacaccttacatttaacatatactgttgattcattcacactgacctaacagccaacagcactgtaactcatcctgaaggaagcttatccgacacacatgtattttatctgtagggcgcatcacagcctgcatgtggttaggaacaccagacagcacttaagcactacactcagggccatgtcaaacagtgaaatcaccaacaaaaagcacaaaatacaaaaagcatatcactaaatagaccacaaacaggatactagtttattgcatgaaagctaaaacaacaaggcacagtcagtgctgccttgctccatctcagctagtaacgtgaaccttgggtgactaatttttcaccattccatgtatgttcacgaatgaccacaaaagtgacacaagtatggatttttgggttgcaaatacatttttgtgagtagaaaatttgcaaatgcagaatctgcaaataatgaggagccactgccctatcgtacacacacacacacacacacacacacacacacacacacatacacacacacatacacacactcttaaagtacctagatacagtgcccaagtattatgatgtagaaataattaaagacaatatggattatgtatcagtatttagattacataaaacgtcagggtcactttacataatttgaagaaagggcaatcaatgaaagctgtgagacatgattctatggaaactgaatgtgactcatactctaacacagtgatacaacttaaatagttagagaggcatagggtcggtgtttggtgaaagagaaaattttaaaaggctcctagtcaagagtaagttttgtccttacaggtttataaggaaatcagtttgattataatagagaaaagctttttgagagaatagttgaataataggattggggagaaaaggagggggagaggatgcttggaaatgagacaaaaattcagatacaattcactcatttgttcatccaacaaatgttttgttaaacatggattactggccatttgctgatctagctaatggagtatggaaaacaagacaaagttcctatattccatgaaattatattctaatgttggtaaacatgacaaactccaaatcaaatctgtaagtaatataaggtattagtagctggtggtaaatgctatgaagaaaataatatcatctgatagagagtggtgtggttaggggcaatgttagatgtgctaacaacagagtgaggctgagtgaggaggtggccattacagcaaaggccaaatgatgaggaggaagtagctgtgcagtggtttggggaagagcattcccagcagaaggactagcaaggcaaatactcgtggcagggccaggcctgccttgctggccagctgagggagggtctgtggtggagcatagtgtctaaaagaggaaggctagcaggaaatgagatcagaaagagagctggaccatagagggtctttctaggcataggaagaagtttggattttattctaagtgcactaaagaggaactgaagtctagacgtaggggagtggtaggttctgatttacattttagaaacatcatcctgactgctgcaatggagaatgggctgtggaaggaaggagctaggagactagttggaaagtctttatacagaaggaaataaaaatcaggaatattttgaagggattgaatcaggacttaccaaaagcagtttttacggtggttcagaaactaccacagatgatgggtcagatgccctgaattcagtgcttagattttacaactttggaactttctgggaaaatcattccaactttttaggcctcagtttcccccagagataaggtgaggagttggactcaatgtctcttccagtgttaaagttctaagaattcaattaagatacagttttcagaaagaaaacgttgtcaaggcactcagtggtagcagaaatgacaagagaacagaaaaaagcacctctacattttgtaataagaaggttgttagtgggaacttgagagctgtttgactaaagtgtgacaatggtacccaaattgtcagtggttaagcaaaaagtaaaaagggagaaaatagaggcaattttctcagatgctcatttgaaagtttggcagggaaggaaatctaaagaactgtagctgaagggcattgtggaggcaagtggaaacctttttcaagatagaaaaaaatgaggttgtctgaagaactaaaaagaagagggagcaccagagagagtagcaaaggtgggaatgtacgaagagatttctaaagccaagaaggcaggggatgaagggcactgatagaggagccaaggtttggaaaatgcagctccctgtaaaatatcactgacttatttacttatttattttgagatggagtctccctctgttgcccaggctggggtgcagtggtgcaatctcggctcactgcaacctccgcctcctgggtacaggcgattctcctgtctcagcctcccgagtagctgggattacaggcaggtgccaccacaccaggctgatttttgtgtttttagtagagatggggtttcattatgttagccaggctggtctgtaactcctgacctcaggtaatccacccacctcagcctcccaaagtgctggattacaggcatgatccatactgcgcccatccccctgtaaaatatcacttacagtttaatttctcagttagcatttctaaatcattagtgtctagcctgaattcttagagaacaaggaattgagtacaagcagctcatttgggagatgcaggaaacaccagtagggaggtagggaagtgactcaaggaaaggaagaattatctgaccccagggtgagagagctgaggtgttggtgtcccaaccctggaggagtcattagttgaggccagctcttgaggcattcatttcctggctcttctagcctgctggaggcagtgaggctctgtgtagttctcaagtaaaagtgctctctgacacagatccttgcagctggaagtcgcagggccactttgaatggtcctggggtgcaggtactgctgatgtgctcgtgacaaagagagtttaaagctgctctgatgtaacgccacccaggaccaaaagccacatccgcatgctgctcacagactagtcactgacctaaaggcatacttgcctgtgctctacatgacaaaatgccctgatgcaaatccagaaggtggggttctctcttgtttcttaatcatttaagattaatcttttgtttcttaatcatttaccagtgagagcattagaatataaggtaacattgagaaagagagaaaatggaagggacgtatttagagtaagtgaatgagcaaaagaaacaaataggtggagacagaggtagaggaaagacctgagagagcggagagaaacgtggctataccctatccacagatcaccatagtccattttagatagactagcagttggatttatcctacactcataaaaacacgacagtattttttaaaaaatcaagtgtatgggttctatccaaaaataaataacttattttaatcagaaaaaatatcacaaattttaggtcctttgccaattaagaatctgagatatacacagcaaaaaggatatcagacagagaggtcaaaaatgtgtagtgctaaatactgtgtatttgtcttacgaacctccaaaaaggaaataagaaaaattagccaggcccactcatgaggatgtcaaagttgaagagaataagttgattctagaggtgacctgttttcatttttatggagtttaatcaagagtgaattctataaaagtgaagctaccatacaaacaactttcactccccacatatttcatatatgattgagaccataagcttgtttacctcaacaaataccagctagaactcagaaagctaaagatttaggagctcagtttgcatcgaagggtttatattaaatttcaccttgtcgctacataaagcaatccttagagctgtaagtttccctaagtggtatctagggtaatgattcacctttggcagagcactcaccttttgttctcaagcagtcaacatcatcaggcctatgtaaaataacatcaatcaacacaaagttctggaacgcatcaagtgaactcagatgacagcccaggaagcttggttagtcctaagagaggacagcatggctcttcatggatggccagctgctgctcagtctatacccttccccaaaatgtgtaaatgtgacttctccatcttctagtcactggctttccccattccaggacacaggaggactcaatcaatattccataaggttattttgtaattcattaatcaagctattcaattaatatttgctgagcagttcctacatgctaggcgctgaggaatatgccaggcatacaaaagtgaaaaatacacgtgtggcccctgttctcatggagcttacagtcttgcagaagaagatagctattaatcaaaatgtcaggagcaaacataaaatagcactgtagtgtgtcctgtgaggaagagtttcaaggtgctttgagaacagataatagagcgatataaatgagaggttgggagaggtttcccagaatgaggtgagatccgagggcacagtgagaccaggaaataaccacgatgtgagaagaggggagggcaactgagaagtccaaaagtaggccagggtctctggggagggagatgaggctggatgggcagatggggctaggccacttgtcaaggagttttgtctttaccctcagggaaatgagaagtcactgaatggaatgccactgactattttcaagtatggcagcagtgagggtaacacagtcagatttgagttctgaaatctctctctgatatggtgtggatgggttgggggaagttaacacagatgtcagaaaaacaagatgctgctgcaataggctatgcgggagttgaaggaaccattattaaaacaacagtctcacaaaatgagaacccacagtttgtaaggcgttccataattctgattcttcagtatgtacttcctctaacagtgacaagcaacatttccttatttcaatgtttctcagagagtgggccatcagccaccagcatcagagttgacaggggctgggggaggagaagaagtacggcttgtttaaaacgcagattcctcggtgcactctggccctagtgactcacaatacctgggagtggggacaggaatctttcattttagagaacactacaggtaattctaatccaagactaagtgcgtctggacaaacacacttgagcatagaacataaatcacttttactttagataagcttttgaggttgcacatttgatttaatttctattattaacaagtaaaatgaacagataattaatcatccaaagcaacattccctggagagtaagagtgggtgtggccattaatagtatactggaacagtaggtgtaaccaaacaagctgatacacatttacctatagcttgctaaccctacttcagtaatagatgtcctatgcaaactactctaccttcaagtgatgagagacccctcaaaatttatatttgagttctgagactctggggctcactatcttatgattgttccttttcatagaagcagatggtattaacagcctgtaactactttcagtggcttctagagcaaagggcattgaggctccaagagacaggttctatgtttgcaacaatgaagggaaacatgtctacaactctcttgcttagaaagccttagtaatttaggctgggcgcggtggctcacacctgtaatcccagcactttggaaggctgaggcaggtggatcatgaggttaagagattgagaccatcctggccaccatggtgaaacaccatctctactaaaaaaaatacaaaaattggccaggcatggtggctcacacctgtaatcccagcactttgggaggctgaggcgagtggatcatgaggtcaagagatcgagatcatcttggccaacatggtgaaaccccgtctctactaaaaaaaatacaaaaattagttgggtgtggtggcatgcacctgcagtcccagctactttggaggctgaggcaggagaatcacttggacccaggaagcagaggttgcagtgagccaatattacaccactacactccagcctagcaacacagtgagactccatctccaaaaaaaaaaaaaaagctttagtaatttaaaaacaatgcctgcttgccccttgttttaattaaataaagagagaaatctgcccatcagtgtcccaaatgaggtagaaaagtggcaacttgttgtcacaataggctcacaatttctctcctaagaaaaataagaagaaaagttggaacattttcatcccaactccaatactcagttccactgggtggatataattgcctagttttgtgtacaaaggcttaacctcaacacggtggcccttctgccttctacaccgtcactggggagtgactctaggtctgtctgagtctaggactgtgaagataactaaagaatcccaaattatggcagaggggataggcagtatatatcacactcggacacaccttggtatttcatttgacagtcaaccttcttgcggatcatcaagcaccgtctcactaggatctaaaagtctattcttctccagggtagagacatctagccccattttcagtaagccttagaacaagtagaagaaagaaatctgcattccctcctagctctgccactagccagctgtgtaattttagttatcacataaattctctgtccctcaatttcttcatccataaaataaaatgcacaaacatagactcactcaaaggtctcttctcactttaaatttatacaactttgatcatctgtaaaaactcaaccttgagaaataaatacttaaaacactgctgaagttcaggggtttttaatacataatttcattaagattagacctgcctagaagattccctgcataataaaactttcgtgcttcttttccagaagtgtatttctatcttcccatttcctcaccttcttggaaaaaaaaaaacacaaaaaaacaaaaaagaaaaccttctctttttgctgtgtacttttcttgggccctaaggttaaagctacctgtaagaaacaaaaggccagtgagagtttagtgaaagatactcctaacactttccaaaaatcatgcctaatataagccctttctaatggcatttgcttatgggaaaatagtcccaagtagctcttggttgcaaggccttaaaaaaataaagacaattcactcatctatttttattattactaactctggtggtggacacaaagcatccatgtagtaacactgcacctatcctgacggtaataacagctaccctctgtttccaactcactcattattttctgatggggactatccttaaatcttagcactgtagggggaaaaactctaaagtacttagttttttaacttgatggcaaaatgaaattacagggatatgaagaaacatccaactttaggaactagtcatttgtagaagttaaaacagaacttgttcattttgaaaatgtaaccatgtgtcaaatccacctactaattcatagcaacaatataaaaagctataatttaggactgttcacatgaggcagagatcagggtggtgttaaaatgaaatatgctctttccagaacacaaaagacataataaataacgattcatatttgtataacatctcagggttaaaccaagtgagttcagacatacaattttacatatggcaagggcgatatagggcaaatattctggactccctttacagacaaggaaacagcctctaatgggttgttaggtgacccgtttaatagtaagtggcagagccagaatttaaatacagttccgattttggacgtcatgctctttccacagactcggtgacctcttttggactttgacatgcatgtacagatctatccctaacggtagtaattctatctgagaatctgtgatctttagccaagcgtgaaccatgctactggcagcgtttctcccaaggctcccaggccattcctctacggagttggtgtttgtatcagaaatgtcagatctggcctcaggtgactactagcagaatagttttaacaaaccaccaccacttccatagttaatgatgacacaattagttcaaaacataaacacataccataataggagctaaatggaaatgcagagaggccagccgtctggctgacagctgctccagcgtgccctggttgtttcagcttctgtgatttatttactcatttgttttctggtggtgaggagggtgtgcaaaatatattgtcactttagatagcacttcagcaaataccataacaacattcccagggattgctagcagcttttgttcagcacaagcatactaaattttaaagagggaaaaatagcgtcagataaatcacaggattttaaaagaacatcccaatttgttcacagtttaacagtactactgtcaggcaaaacatataaaactcttctttttcatctctggatttgacttacaaagagaactaagcacatggtaaaatccccaagattaaatgtgtatgatggataagagaacaaagtgttttctttatgtctgtaatatgaacccacgaccactgacatatcaatccacatctcctccacattactcttcactcaaaaccctcctcaacattgccgattgtcttccatattgaacagatcctgtggagttacactaataaattttcagatgatgcttttattgcctgctccatctatcggcaacacttatttccctaaaaaaatagcctcaattctaaaaccactttacataaagggaaactctactgtggaatagaatggtgtgaaaagttcccctagaatttcattaaaggtatgctccaggtggctggacatctaagaaaactaataacagaaattatgtccttgtagcccacgggtagttgtttgagtataagctgggcagatagaaaccaaaaacagaaagtaagaatgccatgtagatagggaatttcagtgggtaatagttaaacttacatgcttaagagtcagagaaaaaaaaaaaaacctcataacttaaggttgaaatttgcaattcaaattcaatccccctttatcctgttttctaaaggaattcacagggtagggaagctgagctcatggacttagcaagggccatcccagaaggaactgacaaccccgtcactgagttgtaaatggtaggtgggtggctagagtattgctgtctattgtactcacttacagcagccatgtgtctgagattccctggcagaattttaatcaaaataaatttaagccaatataaaattttctacccattttgtcacaaatggatgaacctggaggacattatgttaagtgaaataagccaggtacagaaagacaaatatcacatgatctcaactacctatggaatctaaagaagatgaactcagaatcagagagtagactagcacttagtaagggtttgggtggaagcagcggttgaggagatactggtcaagggatacaaaatttcattcagataggagaccagatgcagtagctcacatctgtaatcccagcactttgggaggccaaggcgggtggatcatgaggtcaggagttcaagaccagcttggccaacatggtgaaaccccatctctactgaaaatacagaaaattagccgggcatggtggcacacacctgtaatcccagctactcgggaggctgaagcaggagaattgcttgaacctgggagtcggaggttgcagtgagctgagatggcgccactgcactccagcctgggtgacagagcgagactccatctcaaaaaaaaaaaaaaaaaaaagaagaagaaagagtaagtatacttaacaatgtatacttgaaaattgccaaaggcatagattttaagtgttctcaccacaagaaatgataagtatgtgaggtaatgcatatgttaattagcttgatctagccattcacaatgtgtgtataattaaagcatcatgttatatataatatatatacaattttattttttcaagtaaaaattctaaaacaaaataaaaaaaattctatctctgttctctagatgaccgaggtgctcaaatttttgtttcagaaaacacggtcaatatcatatcatttttgtgtgtgtgtggcaattgctggcaaataaatagttatatatcttctaagcttattaaaatgaactgattaaaaagcaactgcttctataaagaaagaattctttcagtgtttaaatgaaataacaatgataataataatacatagctcctatggagaagggaacttctcagtccaagttcagtaagtagatactgtatgcaattcaacaggtcacaattataatgtaagactctcaggggcaggaataatgttttctatatcacatccctatcaccacacactgcacaacacagaaggcattcagcaaatgtccaatgctggtgaatatgctgatgctttacctctgatgacactgggagtgagagtactgctgaactacttaactattcttaagtactttcaacagaaaacattttttaaacaagtattttggcaccatagacataaagcaaaaaaccaataggatatttgcacagaagataaaagcaccactaaattgattttctctcttagaaaatgagattttgcacgcttatcctttaactgacaccccctgccacatgcatcttctcacataggagcaaatcaacttttaagccataaatagttgtcttccctaagacaccctgggaatttctggtgactcaaagactaactcccaatcaaggtactctattcctcccaccttcttccaaccaggggttacctaaaagaagagctcgaataagatgcattaactatactacttttgaaagtcagacataaattacatagttaattctcttgggagctcatgtcagaaaagagagaagctccacctatttgcacctaaatggaacttaaggataaagcaagaagactacacttcttctagtacctgctgtctctagtcaggcaaaactcagtgcatagggtagggctgaattgcttgaggatttgtactgaagacatttttgctagtaatactgtcctggtatacttttcgacattaaaactattatttttatccctaacccctcaaagtggcaggaagctatcacttgaggtgcttctttgtcacatagtgggatgtacattctgacaaaccactcacagcctcagtgggagtagagaagcaaagagctacttggcgaagacagctgtaatcctgccagatgattcatcttggtgagagaggaaaggaaatttagacaaattaacaggaaataagtatgatcctcaaaggcaattagaaaagtcagaatatgtatgtgaaaaagcaacagaaaagtgcatccaaaacctgggtaaccagtttcttcatgcaaaatctctgtgtttaaagaataataaactggccaagctgtggttcccatgacaaatggctctcccggaaaagctcttccaaattaatccaaataaatagtcttctagatttcaccagtagccatcttagtgttaggcaaccaagtacatcttctgttgccacaatcatagggaggggaaagtagaaaactgagcatccactgagctggatgctggttccaggtctgccactcgtaggtggtatgactttggtaaagctactgggacatctgtgacatcatttcctcataggcaaaatgaggtggttggatgctggaggtaatatttagctctgagagtcagtgacttcaaattacctgtcttgtcttctattcctcctcctgagcacctaagacttgctgaccatcctgatcaccccacatggtgactgacccgcctgtgtcacactacagctctttccttagaaaccagacagaagctggccacatggtgcacatcaacatgacaatagtcgggaaacatggcctgtggtcttggctacacgaataaatgtgagattatccaacctctctgaagcggtcctcgtctctaagatcctggatgatcactttatagacttctgcccacaacaaccctgaagcattctggcaataactcccactaagctgtaaggatgctgcctggttctccgtgtctctttcaacccagcaaacttagcagtcctgtgtgtcaaagattatgccagacactgatgggagagtcagaagcaattatggtttgggccactctagaaactcagctctacacgtaaggctttgaacttgtggggctgagaagggttcactgtgagaatcagccctgcggcctcgctgcccacatcctctctgccaagcttccactgaatttccagggcctgtcatcatgtcaagaaaaaagtctcagtttcgtaactctctaacacttgctaattgttcaacttttaataaaggaaaataggcctcaagctcagttagcaggcaccactaactaaggcgaatttagagtcctgtcttttttttcatttaggccataatgtcctcccactaatgcagatgaaatgattttctatttctaggaaggtttttccagcagcagggttttcctccacactctgcttcttcagacacctctgctatttctcacccacccagtccagtctagggtgtctgaacagggcccaccccatgccctagtcacttttctgagtgacccactgaccttgctgccccatgcctacttcctccccagcaacgagcttcctaccaacccatgcttcaaacatttctgggaactcctcagagccccgagaggttaagtaattccccaaacatcaggccgcttgtgagtggctgctcagtgatgatctgaatctaggctgttggcctctgaaggctttaaacttatccaacattctctgcttcctctcaccagaatacccatagtcctctgctttcttgcatcacagtgcccataaccctctgctgtctctcatcagagaacccacagaccaaaggatactcccatttatctgaattttactccttcaaagaccaactcgactcccatcttctccagaagctttgcatgtctcctatgcagaatgcataggctggccactctacagtagaggctggtgttgggttagtgaaaatgagatcacagccatgagaccacagccacaggaagctttcacatagtgagcaagaaaaatcagccaagccttgcagtacaatgattttttttttctttttctttttctttttctttttttttttttttgagacagggtctctgtcgcccagactgtagtacagtggggccatcatggctcactccagcctggacctcccaggctcaggtgatactcccacctcagcctcccaggtagctgggactacaggcatgcaccactatacccagctaattttttatatttttttgtagagacggagtttcaccatgttgcccaggctggtctggaactcctggactcaactaatctgcctgcctcagcctcccaaattgctgggattacaggtgtgagccactgcacccagcccgcaatgattcttaacccaggcttcatattagaataggcctgcggaaatttaaaaaatcctcatgcccaggccacaccccagacccattaaatccttagggtggaaccagcacattagtgtttttttgttttgttttgtttttaactctccggatgattccaaggcacagccaaatttgagagtcactggtgtagaaagtaattaatgccatgcttgcaagatatgggacttggaatcaaaagatcaagtccactcccagcctgactcactgtatgacctgaaaaagtcaactgcctgtgtcaaacaggttcttcaccagagagatgaacttgcactttctgccctttctatttcaaaaggttaatgtgaggttcaaatgagatgatgctgcaagagtaccctgtaaactgtaaaacactttattattactgtgtcaattttcactaccagtcccccagtggtgatgttcaaaagctcagaagaaaaaaaaaggtaataaaaatgcacagaaaagaaaaatacaataacagtagggttagaataattaaatacagtgacccaagagaaatatagcctattttatatcttaagggtatgtttataaattatttttataagtacaataaaaaaggttgtagcaggaaaggaattgtattcaggtgaccacttatagcagaagcttattaatacagaacaagggataggcttggccttaatggggagaaatgagtttcctgtgctaatttattaatttaatgtggaacaaaatttattaggggctgaggtgggaaacctaccaaataaaacacagaaaaaagcacctgtacattttgtaataagaaggttgttagtgggaacttgagagctgtttgttacaaaacaatggaatcatcatgaatgagattcttggctcttcgtttaaacaaatgaagtgaaaatataagccatcataaaccccaattcaacaggcttgttcccaaagcccctttgaacctggtttgacacttggtgcatcccacagaaggcatgcagcaaatagccctgagacagcaggccaggccctcaacattgacttaagacataccagcctcaggtctggatcctgagaacatgagggaaggaggacagagaggatccacagtttctctctccttttgcatgcatgtggcatgtgacaagccctaaaatgagggttataatttgtaatttgcatttacttgcttttttcctcacttctgtatccctatgctaattcctaacagctctttcccccggttcacccagggaaccattaggaattagtctattgaataagtctaaggtttcacccagacttattcaatcactgtagaggattacaagctcctaaatcactttagggaaattattttcctgtctccttccccttcgaatactatgtcctaaattcccgttttctgagatgggttgatacagcaaaccctcagattaactggttcaaactaatatgtgaatgatgctctctgaagtatctgtcatcttaatttcttttgctttggaatgatgctttatggaggagatttcagaaaaacatatctaagtgaaaaatactggtagctggagtatggaaacaacagattgtgcagtggaagaagacagcaccaaaacagcgtctcctgcctaggaatctgaccctgggtttggcactcctgaggtgtctacatttctcacagcttcatgattttctccaatgctaaagctttaggcttacgaaaggcatccgtggcactggccatagaagtacagtaaggtgaggcaggaagaatttggctatgtgaaggggaagaacagttaagtagatgggggattagctgtataataatgataatatctactgtttattgaatacttaaaatgtgctatgcacgctatcatacattatctctgattgttaaatgaaattatgtctaaggaaccactgggaaaacagaaatctttccctttagcctcactatacccactacatagaagaggaaagtgcaattccagctaattaggttgccccaaatgacaaaaccaactgagggagaaagctaggattcatttccaggtctgcctctccctgaaactttttctcatttaaattcctcttcacaaattccccaaccagcacctcttatacatgtggtctttaagatgtgagggactgctgggacttcatagcagtcttttaaaaaaatataatttcagcttttattttagatccaggggatacatgtgcagatttattacctagatatattgcgtgatgctcaggttaggggtatgactgatcccatcacctaggtagcaagcatagtacactatagcttttcaacccttgccccctccctccctttcccctatgggagtccccagtatcttttgttgccacatctatgtccacaattagccattgtttagctccttcttataagtgacaacatgtggtattttgttttctgctcctgtgttacaggataatgtaggataatggcttccaactgcatccatgttgctgcaaggaacatgatttctttcttttttatggctgggtagtattctgtggtgtatatatacaacattttctttatccagaccaccactgatagggacctaggttgactccatgtcttttcatgagatgtctttccaattgtttgtgtcatctctgatttctttcggcagtgttttgtagttttctttgtggagatcttctacctccttggttaggtgtattcctaggtattttatggccattgtaaatggaattgcattcttgatttgcctctcagcttgactgttactgatgtatagaaatgctactgatttttgtacattgatttcatatcctgaaattttactgaagtcatttatgagttccaggagtcttttggcagagtgcttagtgtttcctaggtacagaagcatataatcagtgaagagagatagtttgatgacttcttttcctgtttggataccttttatttctttatcttgcctaattgctctggcaaggacttccagaactatgttgaatagaagtagtgagagagggcatctgtttcttgttccagttctcagagggatgcttccagtttttgccctttcagtgagatgttggctatgggtctgtcatagatggctcttattatgttgaggtatgttccttcaatgcctagtttattcagggtttttgttttaatcatgagggatattattgaaagcttttcctgcatctattgagatactcatttaaaaaatggtctacaatttccctttcatcagattatttcttccctatgttaatctagctattgcatggagaaaagaagaaatactgagtattgtttgcctctgtgtttgaatggatggctgacagactgacatgggagtcgggaggaggggggcaacttcaatagacttctctactatctccaccctttcagggcctaggagctgacaaagtcctgtgcagggggcacctctggatagtttcacagctggcacatgcctaaagtgatttaggattagatagcccttcccctcccaggccacagcaaataattattagtggaagaagaaacaccctttgaacttccattgagcatccacattctcccatgacctgtaagtcaaacttccttaagaatattctatggaaaactaagcatggtggctcacacctggaatcccagtgacgttggaggctgaggcagcaggactgcttcagcccaagagttcgagaccagccagagcaacatagtgagactctctctctctctaacaaaagaatcttctccctgtgcccttcctcatagagttgagctgtccagaaaagatcttcaagatcatggagttgactgatactcacaatcatagcaatggtatttgcatcacctggggaaaatgtttaaccatactaaggcccagtctcagctgccggagactctatggaactgttctgggttgaggcccaggtgggttgtgaaccccaatccatcacagcccaatcccttgtcttacaaccgaaagctgtaaaggggaagatggccacctttctagacccagaaactgctccagagggcccaggaacaagcttctaagccacaaaggttgtggttctgcctcctcagatatgcctgtcaggccaattaacacctgaatcttgcaatggcttaaatgccaacagcagacccctggccagaccattttcctttcaccccacacctggcaatttctcttcatcgccatgctgtgctcgccgtgcagacaaaatcaataaggacaatatagctaaaaggttaccatatagcagagatctcagtaatgaaagtgtatgtttttttccagcaggcctgttccacttctttcttaactatttcctcattccaaaactatatttcctgtcacagcctattttctctccatttcacaaagcattaataagccaagttctaaaaaaacaaaagacagttttttagccacaagtgaataaaagtaaggtcaaagttcaaggactgatatcatcgtgattttgctctgttcaaattcatttgtttcttagaccaggaaataactgatatacctggttaatgatctagaatgccccaagtatttgctcaagctgcacacttactaaagggcaacatcttttggatggtagccacagaacctcctgacctgaaacaatattgggtattcaaaataaaggctggctctctgctgagatgagctggggaaacagcgggtacatacattggcaataaccagctcacctgtagtaagagaaggtgcttttccagggcaccattttattcacaggttatatttgttttaacagagagaccatattctgcttttacttggttaagaactcggttcagggtcaaaacgtctaataggaaaagcattcgtgtctgagcacagaatttaggtagaaattgagaacaagaaagtagagtcagaacccattaaaccagggattttaaattccggagaagaatgtacatatctatttcaactcttagtgatgttatttaaaactcttctattcctttcaaagtatttaacatgactttggatgtacgagacaaatactttttagttagtgtgccagccagcaggtgctctcaaatgaaactgttttgaaaacttctggatatctgggaaatatttctgtaggatgtagaataaaaaaattcaccttatagaataatttcaaagagaaaaggaagattcatcttgtttgaaagacattatttttgactgacctgaatctaagcacacactttggttatgagaaattccgccttctgtatctgaacttgttatatgaacagtggatgccacttaaaacaaaagaggaagaaagaaatctgcttcctcaaggaagagtttcagccctttaaatcttaacacacaataaaaatactcccattaccaccatcacccacttcagcagctattcgaagttcataacaattcatagaaaagaacaattgcttaaagcagaatcaaaaacccttgagacttctcaagattataggccacagacataaataaaagctctcaataaaaatactttataaccttattgtgtattaaaatgttataaataactgtgcaaagacttagccactctatcaacaaacagaattttagatttcttttcccagcctgtgtgcactcagtcactcaatgtactcactgccgatctacatatttacagttgtttaccacattttgttaaggcttaaaaaaaaaataaggaaagagaaaggaagcactttctaaagaactgtaaattacaattgagctctcttaagagttcacttatcttcgctgattaacttccagggtacttactgaaacaggtgttgtgtgtataaaaatcagtatagatgaatatagcatgtgctggagtgagactttgggctgtgaacttcacttcaactctattttaaccttttcaaaatgagggaaaaggttatggtgaaatgaataggtgttgatgtacctcactggttcctagcacagatctacggacaagaggaatcaaaatgatctgtcaaacctggaaacaacaaaaccaagcagagtaccagcccgcatcacttgaactcagtagatttaaggagatgcccatacagcagattctgttgcaagtccctcaggtgattctgatactcagtcagggctgagatgaactagtcaggaactttccagttcttgaaaaccacaaacacttcaattttgccttgtgtgtacatatgttcatgaaaataaaatctattatgttagaaatttggcaaatatacattttatactaaagatattgctatttaaaggagatttcttttaaaaaagatatcttttataattgatagtttaacaatataatttttcaaccctaacttttctctccagtgtatttaaattttggagtttgcttaaagtatacttaaatcattacaaggaaagaaggaagttgtatggcagacaaacctgacagcaataacttaagcataccctgagaatgaccctagggtgtaagaggaatgtgtgtttggagttccaaacttatgaatccaggagtggacaatccagggattcattccttatcaatgaggaacatcagaacccaggacccatcctatggaacacaggctggacaggtgatcgaggccctctgttttgggttagatgaaagttgccaggtggaggttgctaggcggagggtgctaagtgaaaatgctatataaactgcatgctttttgccagcagttgtggttctcctgtccagcctgcagccactagaccaccctgtatgtaagttccctcaataaatcctgtgtgtcctccactggctctgggtgtcttctttgtcttctcgaacatggtgctgtccctactgaagttaataggggtctggcacaacaaaggtaaagttcaaagtcaaaaatttcctgccacctctgttaagaattatagtctgtggaataatatctctgccaggcaagtcttgggcttcagtcaggaaggtctcaggccatgtcatgtgctttccacataccataaaaggaactggatatatatttcatgattgataaacttagggataactggaaaagggtctctttccccatgcttaattacatctaagagtatgtttaaagaattatttaaggaaaaagtaattatgatgttcagttagatcactttaaatggaaataacttggaaacatactacattgctctagatgcagactaagggatcaatgactgaaaaaaaagaacatctttggaaagaatagagctgggcccagaaaacacaacagctcagggctctttaagaaggtgggataaagaggtagagagaaccaaaaacttggacatcactgaaattttgctgatcactatacttaacctctctatgctctccactggggcaatgactcaccaagcactccatttttatggcagtctacccagctaattaaaagggtgcaaaggatgtcgagtgacctaacattggtaatgtgtaactttgggccaactatttaatttctctgtgcctcagtttcctcttctgtaaaataggtgaaattacagtaactctttcaaagcgttttatgaaaattcagtgagttcatacctgtagaatgatcagcagcatagtgactggtacactgcaggtgctcagtaagtgttagatagtattaattaggtcagataagtggtctatgctatacctcatgtagtccaggccttatagcattgggaagagtagtgccaaaatcccagcattctaagagcaagaggaaacccttgaagttattgttctgttctaagggtttcacttggtttagcacatgtttcaatcattctacatacgtaatcccagcactttgggaggctgaggtgggcagatcacgaggtcaggagatcgagaccatcatggccaacacggtaaaacctgtctctacttaaatataaaaaattaaccaagcgtggtggcacacgactgtaggcccagctacttgggaggctgaggcaggggaattgtttgaacccaggaggcggaggttgcagtgagccaagatggtgccactgcactacagtgtggctacagagcaagactttgcctcaaaaaaaaaaaaaaaaaaaaaaagccatcacttacagactaagagatttcccataaaacttgaaattgtatcttcttgaaacatgtggcgatctttctgcactggtgtgtttctgggttgtctgaatctgctgccactgagctgtggctgcttcccttagggcagacagaggctctccagcctgccataggccccaccagtccctcctgtttctctggcattaaatcaggtgtgggttgttatggcatggctttcaaaagcaaggcttttgcctagtaataaaaaacaaatgacaaaagtgctctgtatttatttctttatcaaaagtgaaaaaaaggaatgtaatcccctagagggtacttgatttttctcatatctggcctactttagctatttacattaattggtgactctaaattcccttcttttaaaatatgaaaaacaaagaacccagagactttaagtgaccatctgaggccataagtcttggtagtcgcagaagctgtatccatagttgggtccttttccccccagttaccatttccacttgtccattcaccttctttctaaatgagttagctaatgtgattcaattcatattccatacagaaaagtaggaacaagaggaagcatggcggctacaatgaagaagtgcagaaggtagctatggacatacgagccctgtaaagggggtaaccctttgttagttctgtgattatttgcatcttactcaggctgtccgtgtttaaatattttggcagatgaatgtgatggaatgatgcccctctccaatgggttgctctattttctttatgcttaattgccccctttcatgtctaattgtaatttttttctaacataagttccctaatttacttaattaaatgaaatggtggtgtgagtgacacaaatatgaaacataacacatatgaaatcctaaaacacctagagagaatgagctggaaagacaaagcagtggggacccgggaggtgcttttccttccttgagctccctaaagttaatcttttcaggtcttcccttctccctaatgaaatgagtctatcctaggggcatatgtcaccttccctgcacatatgacaatatttctgtgactcatatgcttgtcacttcctcagggggaatgagaatcgaacattttatagcttgttaatatatctcagtttactttattattggatttttaaaatattgagacagtgactttgtgacctgagattttagactgtgcctactttccaccacaccatcaaaatattccacagataactgctcagtttaacttcatatggaaaatctgtgattaatttatagttctaccacttggcatttgcgagttcatcctcaaaagatacccacatcccagtccctgaagatttgagacctctacgagctttgccataaaatgagcctgaaaatatctcctttagtggctattggaagaaagaaataagatccacgttgtgtaagtgctttgcaaactgtaaagcaccaagcattgagttccatgttccataagtgctttgcaaactgtaaagcaccaagcatatgtgccctgacaatgagacatggtcccagaacactgggaacacaagatgctctgagaaaggcaggccgtggaactcatgaggaagctcatgactctcatgtccatttcaagagacaaaagagactaaaagagaagtggattattaaaaataagcctgagttaggaagcagagtctccaaggagaacagtgggtttcatgacacattcctttgtgccctcagaatgtgtggaagcttatattttggcttctattacgttgttgaatatatatgattatctacctgccttccccactcccgagcatcctataaactgagcatttcaggaaaagacctgtgtcaggcatctttgcatctctggtacttagaccaatatcttctgggtacttccagcctgttaagttaacatgtgctgcttagtgtgacagaataatacctatcctcaaaacatgttcacttcccagtccctcaaatctgagagcacatgttaccttattttgcaaaagggacttttgcagatttgatcaacttcaggatctcaagatgaggaaattatcctgaattatccagttgggctccatatcatcacagggtccttataagagggaccctagagaggacaatgagatgtgatgatgaaataagaggttggagagatagactggaaagatagaggcaagggccacaagctaaggaatgctagattctggaaaaagcaaagaagcaattttccctggaggcccccagaaagaatgcagcctgaccaatactgttattttggacttttgactttcagaattataagagaatgaattgtgttaagccaccaagtttgttacagcagcaacaggaaactaatacacttagataagaaagtacatgaaaaactggcatttgaatgaatgaatgagcaaatgaacagaggaattaatggaaagagctctagatagaaagcggaaaggcccaggttcagatctcagcatagataataagcagacctatcatttaacttggggcctatagtgtaatctctctggaagtcctcagcataagagctaatgctgtggaatcagactgaccagggttcaaaactcttctaggctacttcttgattgtacatcctcaggcaagcacttgcctctctgagcctatgtccacatctgtaagacagggatagtgccagcacctcctgcacaaaattgttgtggagactgaatgagctacagtctagtcacatttgatggggctctgaactaggtaaatttgaaactgtggtcacatgaaaatgttattaatgtcacttcatgcacaaaacttgaaatcatgcaaattccccaattaaaaaaaggtcaggaatggcaaagctggtaaattgtaaacctctgattaccacatagtgggaccgtctcagttgctgaacagaaaacacccattgtcctttgagagaatccatgttgaattatgcaagctataaattacacaagcaacaaattatgaaaggcctttgggaacacaccccctgaacaaaatatgactacctttaatgcatgcaaagcaattagcaggggcctggaacacagaaagctattactctgctattattatattagctcaatgataaaagactcagaacaaacactgctaccgcagtggaaaatgaaagtaactccagctttcccaggggcctaagctttacgtgggcctctggctcctttcagagaaatcttgcaagttggaaaatctgagacaggtgtgctaatgacaccccatattatgaagcaataaatttcccagctcttgcctgaaacgcagaatttggccgcagggaggtgttaactatgtgctccactagtatcaccacgcatacatcatgcataaactattttgccgctattagccttatttagaaaaatagaatttgtgagatgaaggggatctccctgggacttggcgccacccagcatcacctgcccttctctcttttctcgtttcttgaatgcccagggcacaaggctgtccctagtgcatatgagaagttcagtaagtgtttgttaaatgcacagtgacctttacagttcatgtaacccacctccctttcccattttacagataaggagcctgaggccaattaaaggaatgactgaaatatccctatcatgtgacattaattcaagttaatgactgtcttctccctacagggaagagttcatttcccaaaacgaatagactgggttatggagaggtaatagttttaaaacacgtttcttaaagcatatctgtttttctaagcagctttccgtttcgcaaaatgaatgctgctgatgatgttaagtgtctacaccacagatgtggctaataattgtttaagagctcagaagagaataagcaaaagaaaatatgaatctgaatgaaagagatccaccatgaagaaatcagatgtagcctaagaatgatgcctgattatttagttttaatgaagccaggtgttacatgtgatggggaacaaataatttacttcacagattcatatgaccctttcaggctgcatcgaaccattcaatgcagaatcgagtcgcattttttacttacacctcaactttgtaccaaagcagttataatatctatgaagaattcagagctaggaggactaaaattttttccctttctttaggtggccacatatcaggaaacgctgagcatgcattccctttgtcaagaccaccctctcaagaagaatctaagccctttccctagaaattgatcttagtgatttttccactgtctctatgaagctaactttaatttcttctgaggtagcttaagtcaactctttgcattatattcactgcacatgggaaagaattcttactaccttcttgaagtagccctgtgtagatttcaagggtcaacaatttaggatacagcctcgcctcttaaggttaactgtggccagatttcttaacttactttgatacttttacttgtattaacatattcctcccaatcccttttcacaaccagttgggttgcagagcccacaaattcaggtaagctaatgccacattatgctaatcagctgggttcctatgcttgctttctcaaacccactggctttttagccagcaaaaacctagggctgcccagtgatgacctcacatttccaccaatgtccttgctttttaaagcttttcatacatagttgtgcagtggatgctgggtctctatttgtgatttgaagtgattttcagtagaagtcctaaatttatctatatacagtgtctgtgctgtttctattgtatttcccttttccaccataccacagccttctcatctgtacaggcaatctggaccatactcagattagatgtcctgcttcctggcctggcagctttgctggtgttaaaggacagtgggataagggctatcagaagaagacaaagacctgttatttcactgactgcttactctctttggacctctttagactccttgttgcctgagatgcaaggccagacccaggaggactgcatacaccccagaccccatccagctcttccctgtactctcagtctcactgtaactttttatttccaggacattacttaattatctggagatgcttattctccacaagcctgctgtgaagattcacaccactgcactttacctaggtgtcccttctacctggaatgcccttcatggagttctctattccacaggcccaccttaaatgtcacacctctggcaagtatttattcctcacctcctcagccaagatgaggcattctctctcctgtgctcccagagaatgttgtacacacctctcttttagtcctggccacagagtactgcaatgcctatacaagtctctctcattcaccacaaacttattttttgcatcttctagaatcaaatctacactctgtttcacagtaggagtttatgaaatgaatgaattgaataaacgtgtatgattcctcaaaacagaggtgactaggtggcttttagcactggggtctggaacacaccttttatttatctctgggttagagaggacaaacctagagaaatacaagaaaaacaagcagaccagtacccagccaagaataataaacatggtgtacctgatagaccattatattaacagtttcttcttttttctgctctggagatccttgactctgcaatagatttcgtactgtttcttccatcctgagaaacaaaaatattaagaatttcttaaagaaggtttctaattaacacggatccactcgagttgtagaaatcactcttctatgcgtatttcccaagcttcaacctggaaatctcttttctctctacttcatcttctatcagttatctgtcatgaagtcctttgcaaccattctttgggatgcctctacattctctttctctaccattcaggtctgcctctttatacttggacatctaaactcatgcacctatctcccaatatccctcttcatttccaatcacttctttttaatttgatacagtatcactacatcaatcttcccaaaaaaccactttcatttttaaacaccaattttcaaagttaacacatattataggaatgcactcttcccattaatctactgtcaggtctttctgtgatggtctttctatgacagcacgtaaagatttacttcattcttctcaactacagtcatgcattgcttcataacaggaatacgttctgagaaatgttgaaatgcatcattaggtgattttgtcattttgcaaacagcatagagtgtacttatataaacccagatgggatagcctactacacaactaggctatattgtattacctattgctcctaggctacaaacctgtataacatgttaatgtcctgagcactgtagaaaaattataaaacaataatatttgtgtatctaaacatacctaaatgtagaaaaggtacaggaaaaataccatataaaagacttaaaatggtgcacctgtataggccacttgccacgaatggagctcacaggactggaagttgctctgggtgagtcagtgagtgaggagtgagtgaatgtgaaggccaggacactactgtacactgtgaacactgtacactctaaacactgcaaacttacactgcactaaatctataaaaaatatttttctttcttcaataataaaccttagcttactataatttttactttataaacttttaaatttttaaaaaactcgatgcttgtaatgacatttatcttaaaacataaacatgtataagttatataaaatattttctgtatgtccttagtatataagtttttaaaaattgttttaaaaaacattttttggctgggcacggtggctcatacctgtgatctcagcactttgggaggctgaggtgggtgggtcacctgaggtcaggagtttgaaactagcctgaccaatatggtgaaaccccatctccactaaaaatacaaaaattagctgggtgtggtggcaaactcttgtaatcccagctactcgggaggctgagacaggagaatcgcttgaacctggaaggcagaggttgcagtgagccaggatcacaccaccgcactccagcctgggcgacagagactctatctgaaaacaaacaaacaaacaaacaaacaaacaaacaaaaaacatttttgtctgggcacggtgggtcacccctataatcccaacattttgggaggctgacgtgagtggatcacctgaggtcatgagttcaagagcagcctggccaacataatgaaaacccatctttactaaaaatacaaaaattagccgggtgtggtggcaggtgcctgtaatccagctactccggaggctgaggcacaagaatcgtttgaacccgggaggcagaggttgcagtgagctgagatcgtgccactgcactccagcctgggcaacaagaacaaaactctgtctcaaaaaaaaaattttttttacattattttattaaaaactaaggcacaaacaaacacattagactaggcctacgcagggtcaggatcatcaggatgtcaccggccaacaggaatttttcagctccattatagttttaagacaccacagttttgcatccagtccacagttgaccaaatatcattatgtggcacatgaatgtgcttcctagtatgtcatgttgagaatgtaagttacttaagattcccctacttatgaaatttaaattacttcaaaatttttgttattccaaacaatcaacatctttacacatacctctttatacacatgtgtatttctacaaattatatactacatgttataatcttgttttgttttaaatgtatacctccagtgattccccattagctcaaagtaaagagtaaaggaaacacacccattcccatttccagacatttgcttatgctggtgatacttcttagaatgccccctccatttcatcttcctatatttcaaccctcttttcaaatttaccttaagtttcacttcctaagataactcctcattgatctcctgcttctttgaattcttatagccctatacttcaaaccatttactctatcacttaaaaatccttcactttaatgctcaaatattttgtatatgcaggtcttatcttctggaataaatgacaacatttggtataggactatgccatatatttctaatgtatctctctcaactgtagataaaatacatactcactagacattattgtatgaatcctttgctaattcattttttaaagtgtgaagtagttactctatgccagacactcatcctgtatgttcagactgtgtctggatgaccttgtcattggggcccaccatgaagattcatagacccaaactctgggagcaagaagcctgaactcaatgccctgaacacgatgctctctgtccagaacctgaactggttatcttttccaggcccatcttgaagcatgtatttgagtgactcagtatgacactggttgaagagaactgtgaagaaaagcaggctgatccagcttctccctcttactaagggcttctcgtatgacaaattaagggctctaggagaccagtgaatccgctgatgtaggaagcccattgcagtaggcaggataagacagttcaaaatgccacctttctaatatggcacgtaactactcagcagcagagtgaggaaactgcagacaactgggacaggccagacctagattattaattggagaaattctgcctttacagaggatggcacaaggactcatttgggttttcaggaagatggtgggcgctggttacgagtactctaaaaatgatttgtgaccacacatttatacaagccacctctgcatgtatccagctgagaaagcagaagctgttccctatattttcacaaatcttatgttattaataataactcaatctaatagtacttttaacttgacaaagaactgtctcatctgttcatcattataatttacttttaaaaaatcattctatctatttggtagatgagaaacctaaggtacagaaaggttagatggtttgcttaagagatcatggttagttggatagggagtttggatgaaatcatttttactgactctaaatacagcagcctctttctacttgaccttattggtattcaggaaaatggttttaaatgagtaagagtcttaactcctaactaggagttaccttggagaacaactttggtggatgaacccaagaaggcaacaataccatttctgacctggggagagcatgagaaaaactaagcttatgtgaaaaaaaaaaatcggtgcaaagaagtcacaaattctgaaataataagtgatcagaacccattgctaatacttgatttcattttatataaacaagctcttgagtggtatcagattttccatcatgtttgccgaactatcataaacaaggaagtaatgacaatggtcctaagacttgcccaagatcactcagcttgttcctggcaggtaaaggcctggtatcctggttttctaaatattagtctactttcttcccaccttagcacagaagctggatgtcttcttttaatccttattgcattcatttttaaacatctgacttaaaagtggccaaatagttagaactcggttaaaatgaaatcatattattttttactaagttaaaacacaatcttgtctcaatgcatatcttgctaaattatctcttctgtaaaattacaagctataaacacaagttgctggatcaaaaagaaaaatatctattcacctttcccccatttttcttggctttatacttaaaaaataggaaaaagtgggggtggacaggaaattgttaaaacaatcttgagcagttcagaacccttagtaatatggtaaacactcttctggcactactttatgattaatcaaaaccaattacatttcccacccaagtcttggaacagagtcacagggccccatcctaacccttggtaaaaaatcaagttgtcctatctttttataacctctatgaatcatgtcacagagaaaatgttataaacctgataagaatatgccattatttactccctgatgacatctttttttaaaaattcttatttaacaaacttctctattttcccaaaaatcaaaaatcaaagactaaagcatcttccattgttgtttgacgcccaattacattttgcttcattttattatttcgacggctaatgaatgaaagtttgcattactagccagcacatagtacagttccaccatctgtctccccaatatgattaagaaataagccaattcctccctctccctctggttcaggcttgggcagagttttgtgtgttttgtttgtttgtttattaaatagctggttgcaatttatccttaaacactcaccttaattcatgtcttctagctctccatctccttcccccacctgaaactaagaccattttttcccctaaatattggtcaagtagctgccataactaaaaatatagaaaccaaaattatacttaatgagttgtaataaattctaacgtacatcaagtgaactatttttaaaaagttaactcctaggacagccagaggaaacaaactaaatacatatatgcaaacagtatgtctcaggtaacattaggtataaatgcaggcattttattttattaaaatagattccattttttaaggtacacactatgtaatcaataaattcttattacactgtttcctctgggagaagcaaaaaccttgcttaagaagggcactaagttaaaattagggaaattgcatattaaaactaatgcatgagaagagtaacaattcaaaagcaccaaagagcaggatcagtgagccattttaactaaattctctcccagttcccaggggaccacctttgtcattgacctccttttaaaatacggaccactggggtacttgtcactggatctgtttccagtgtctcaagagctggtccgtctagacaccaaaggaagatctttctgaaagaaaatgttaaaacacagtggttttctgaactctttcatggtaagacaacacttgataatatcaaaggccttctttgtaatcagagactatggattggactttgaagacctggacttattcaataatgaaagcagtgttggaaaatatggctccaagctacattagaagctgattattccaacatgtaaatgactgtgggctttttcacatgctttccctccaaccccaacccaaaatctagccctctgttttgattaatgacactctagggactgatccaattattacaccaaattgttctttttcacccctatattcagttatttagttgagactaacttcatttttgacagaaataaaaaagaacagaaaacaagaagccactcaagaagttattctccccaactcacactgataactgatagggttcattcaattgaaggctgaaccaaattaaattttgtttttagaaaatattttaacatgtttacttgctgattaatcaaatacctacttaataatgaaattaaccatgaaattattcaatattccttaatattcttttagtcaggtgagagggtgcaagaagtgcccgccacattccctttgattcccccatgccatgaagtttgtcaagagctgctgctgaaacttgcaaattgcttttctttgtgtttcattgtatttgactcccaaacttctcactttgagaaattgtgtcgatttaagaaagggtcccaccatgactgaacttcatttaatgacaggaagaaagaggctgcagttaaattagaaagaggcagggggaatggggtccttgaagcatccctcccttaccctaggcttccctcctaggaaacctgacacaacacagccccatgtagagaacaatgctcatcttctagagccaatggcaacaaagaggaccagcatacttcccatattggctggaaaagaaggaatacttgcaataaaatactagctccctcatattggatgcctatgtagtagggttaaatatcaacacatacttcactttggatgttcaagacaaacaaaattcatttatttgtatataaccaaactagtcgttgcttgaacctccacaatatgactagcattaattactgtccaaaaccctagtttaaatcctaaccctagtctcttatgatggatttctaaaatttttaaattttttaattttaaaaattcaaaacaggtgtccatcaacatacaactatcctatgcatttcctgcagtggaatatataccagcaatcaaaaggagtaactgatgtatgcagcaacattgaagaatctcacaaactatgctaagttaaagaagccacacacaaaagacaaaatactgtatgatttcatttatacaaagttctagtataggcaaaattagtctatggtggaaaatttaagaatagcaattgccttgggtggtggcagggattgactggtaaggatataaaggaacttcctgggataagagtaatgttctgtaactctatagggatttggactgcacaggttatatgcatttgttggaattcagccaatgttacatttaagatttatgtatttcattgtatgtaaattttatcaaaaaaagagaactgtaaacacatatggaactccagttattgatatatatgtacaccttgggaatatgcctttgacttactttttttttttttttttttgagacagggtctcactctgtcacccaggctggaaggttgcagtggtgcaatctcgactcactgcaacctttgcttcccaggctcaagtgattgtccagcctcagcctccagatagctggaactaaagacacgagccctcaatgcctggctaaattttgtatttttcggagagacagggttttgccatgtttcccagactggcctcgaactcctgagcttcatgcctcagcctcccaaagtgctgggattacagtagacttactttgaaatgcatcaaaaatatttcatttcaattatttaaaaatgcatacattgaggttccatgagaataaggaactcattcaagatgatactcccagtaatagtagagctggtattggaactgtttgactccaaacttgtaatctttttctactgtgccacatcagcattcactcaaatatttaaaccaccctggcatttacttggctgggtatcaacattttctgctatactgttatcacgtggtaacatctggattgatgggttctcgttacttgcaaatgctgcacagttaagccctccgtatctgtgagttctgcatctgtggatttgaccagttgtacactgaaaatattcaggaaaaaaaaactgcacaaagttccaaaaagcaaaccttgaatttgccatgcactgagtactacattgaatccacatgaatgaagtgtaggcgtcgtattaggtattaaaagtaatcttgagatgattcaaagtatacaggatgatgtgtgtagattatatgaaaatatggtattataccattttatataagaaagctgagcatccccagattctggtatctgacgaggggtcctggaatcgatcccccatggaaactgagggatgactgtttttgcattagtcaatcttttctcccaatcagatcaaaattcttctagatccaggctttatgcacagtgatacagtagtcttcttagccatgggggatatgttccaagatccccccagtgaatgcctaaaaccctggatactacaaagctctatgtatactttccttttcctgtacatgcatgtctatgataaagtttaatgtacaaattaggcacactaagaaatcaacaataacaactaataatcaaatagaataattatgacaacacactgtaataaaagttatgtaaatgtggtctctccctctctctcaaaatatcttattgtacggtcctcaccaatttttaactggttgaacttcaggtaactaaaactgtagaaagtgaaacctcagaaaaggggaaactattgtgcattataacaactgttatttacctgttgaagcatttaagaccagctattcatggaaatatatgtcctgcccactgggtactctcaattccaccgaaatgccacagaaaacacagagccaagccttgacccgtcccttgcctaaggaaaccctcccttcatgttttcttaacactctgagctctcctcctgaggtcactgactcctccttgttgtttatgctatccataggaactatgcaaagcttagttattgggtagatatttgataaattctttgtggagtgaatgattgaacctaatggattttttacccttgttcattccctgcatctttacattttcacttcccatagacctatgtatgcatgcgactagtcagagaagtagatacagtgagaaatgccagcaagactgaaggggctatgtcttcacatgcagctaagatgcaagtccgctggtcagatgtaaaacaaaccaaatatctaactgttctttttgttacgttgaatgtctgtatgcttcaactcagctaattagctatggtgtttagaacattaccttaatgaggaaaggttctagattcaatccctaacttaccactgtcggctcctggcagactaatctctgccaagacagcccactgctctcctacttgggagagagaggataggacaattaccttaatgaagaacatattttgcattgcctcccatataatttgcttttaagtttctatttctcattctaattccattgccttcctcaacaaactatcctaccttcccattttaattgcaatgcaaagcttccctcaggtttgtgagtctaaaggaaagctgactaattttcaattccaagagcaaattgttcatgtggaaaatgttggtttagaactgggttctgcccaactgcgccacttgttttcttagaaatgagaatttcctcccttagaagctaggacatctaagcacgtaagcaggaacaatccccaggttggttgtcacttggatgctcttaacccaatctctgcttatcctcgctgcaatagttaggaacagtaaatctacagtgaacataactgaaaactgcactgaaacagaaacttactctggataaatgttggaggactggagtttcttacttctttcctagatgatatatatttttaattcagcacaaattttgcaagaataacagcactgcacagaaaccacagcactctaattcactcatgaggatgcaagagcattcataaacagatcgaaagatgctagtccaatttgaattactgcatcatattcactccagggccatctctatgtgaagagaaagtgacataaattttctcctaggcaggcttgcactgatcctgcttggggagctaactgcacggagagaggccgattgggagagggcagggaagcagagatgggcactcagagaagtcccgttttgcacatggagtagaaggaactcccctgaatgttagcaaacaaatctcaagtgtttttgctcaacagtggcagaatacaaaattgcatttatggattcatgtgtttgtagagttcacactcatccacaaagagagggggagggagaaagaatatctcacatgtgcaagtaaatgccacaaaggagaaatacacctcactggcttttacttgcctggttaacagtttgaaatcaggattgacactatatccagataatgcacaacaggtctacaaaatgggttatttccctaaatacagccaggttttaaattaatgtaataattataattatttatcaggggaaccagcctgcaatatttcaatgtaggttcttttctattttccctaagtgttggccgctctgagaaataaagagaaagagtacaaagagagaaattttacagctgggcctctgggggtgggcatcacatgtcgacaggttccatgatgcccacctgagctgcaaaaccagcaagtttttattagggatttcaaaaggggaggggtgtacgaatagggagtgggtcacagagatcacatgcttcatagggcaataaaagatcacaaggcaaacggcagagcaagatctcaaggcaagggtgaaattagaattaatgatgaggttccatgtcccactgggcacgtattgtcattgataaacctcttaacaggaaacagggtttgagagtagacaaccggtatggctagaattcgccaggctggaatttcctaaacctagcaagcctgagggcactgcaggagaccagggcatatttcaccccttatcttcaaccgcataagagagacactcccagagcagccattttagagacctccccctgggaatgcattcctttctcagggttattccttgctgggaaaataatttagcaatatttctcctattccctttctgcaagaagagaaatatgattctgttctgcccagccccgcaggcagtcagaccttatggttatctcccttgttccctgaaaatcactgttatcctgttcttttctaggatgcccagatttcatattgttcaaacacacgttttacaaacaatttttgcagttaacacaatcatcacagggtcctgaggcaacatacatcctcagcttacgaagatgatgggattaagagattaaagacaggcataggaaattataagagtattgattggggaagtgataaatgtccatgaaatcttcaaaatttatgttcagagattgccataaagacaggtgtaaaaaattattaaagtattaatttggggaactgataaatgttcatgaaatcttcacaatttatgttcttctgcctctgcttcagctggtccctccattcagggtccctgatcccgcaacaattattaatgtgattaattttattaatacatagtcaatagttaatatcatttcccatgttcagtctcatgagctcatctactcaacttcagaacctatccttgtcaaatgtgtccttaaaaaggtcttcaaaataataaaattccacaaatacatggagcattaggtctgctttttattttcttgagtaatctgaagcacaaacattctctgataccacgcaaaaaggactctgaattgccaagacagctactttaaaaataaatctattattttggggatagatctttacagcttagagttcaaatcttgggagaccttgaagacaacagatggctgaatttattattggcccccatatttatctttattggccactgtgtttaggaataatgaaaataatttatagtgaggatacaccttaaattctaattagaggccgttctcttctagaaaactaatgtaataacaacctggagcctcttttcccccatttgataaagattagtattttacaattttaccttggtgaaagaaaaataaaatatggcctggacaatcaaaatttcttctcttggctgggcatggtggctcacactagtaatcccagcactttgggaggctgaggcaggaggttcacttgagctcaggagttcaggaccagcctgagcaatatgatgaaattctgtctctacaaaaaataaaaaaaaattatctgggtgtggtggcaaaggcctgtagtcccagctacttgggaggctgaggtgggaggattgcttggactcaggaggtcgaggttgcagtgagccgagattacactactgcactccagcccgggtgacagagtgagactctgtctcaaagaaaaagaaaaacaaacagaaacaaacaaacaaacaaaaaaagatttcttctcttaatatgcaccatgcttttaaaagtttgaatctaatgttaggtatgccaaatgtagctcactttgcatttcacataagttaatatttctccacagttgtaactggctcttcatcagatggttacaatccctagaacacttactaaacaggccacatgctgtctgtcatgtttcaagatctgtatgggagtttgactcagagaaaattaagaattgaatgacttgactaaacttgattctcactggcaaactcactctaaatctgattcccattttctacatctcacacagtttttattttattttattttattttttttttgacacatgtttagtcattaaagcttggagaggtcaaactaacagtcacactggatctgaataatgtccaaagcagcacagtaagtagccggtgttaatctgttgctaatttttttgatggaggtgtaaaagaaaggcaagaaaatctaattggctgtatttgggataaaattatagtgttatattttctggacaagaagatggaacagtggcaaagagatgctttaagaatccacagtactggcccatctagccgtatggatgccaacagcacattcttcactgggcctgctatttaatttgcatgcttcttgtgacacttgttccatgatatttcagagtagcttctcttaaagaagcagatattgtaaaccacagcacatccagaaaagtcgctctaccaaatcctctttcagcctcaactcttggggccataatatggtcagtgtaacctcaggccctgtgctccctaaggggcgtaggtggagctcagcggaggccctctcaccactatgcaacttaggacagatcacatttcctgagcctcagttacctgtaaaatgaatacatcctcccagtcctacttacttcagagagatgttatgaggatgcaataagacaaaataaaaaatgctatatatgttgatacttgtttttattatggttttaaagatccaggctatctgaattgtaaaccttttggtgctgatgtgagaagggcagaaaattggcttcttggaagccccatccaatcaagttaacactttatgaaggcccctacctgctttgtctctttttgagaaagttcaaggggtaaagcacctctctccaagtttcagctagtaattggtttagagaataatctattatactagttgggataggctaggttatgctggagtaacaaccccaacctctcagtgactgacttactgaatttcttattgacataaagtctgggcaacttcgggtctgagcagcagggtagtcacttttcttccatgggtagggggtctatgtcctggtttcccaggacagttcagctcaagcttactgtcctggcaaattattaacaacacccctttcagtccaaaaatcgtcctggtttggatgataaagattataatcttcatatcaatggaatgactcaaatatttagcctgccccactctctcaatatgaagttttctctatggacaggaaaagataaactggagaatgtagtatggattttcactgcctcattcaacagctgtcacttcagtttaagggccactggccaggactagtcacatggcccaactcactgctagggtagctggtaaacttagtcttctgagtgcccagcaaagagaagagaaccagatattggtgctaatatgctgtcttctatgtgtgcattgtgaggactgaagatatatatgggactactactcagtgactggcagcccagcctcgctaacttttcaattgtgtccaggtgactcagggccgaaattcaagcagggcaagtaagtgttgctcttggtggccttttcccattgggtgttacttttttcctccgttggttgactgagctgtcactattgaggctcttctctcacctcccagctagatattgattgtcactctcctttccctcatgccaaattgatcgccagcctacacaattactttccctgagatctctgaattgtccacatatgcattccctctggtccggaaatcttcagacagacaccttcaaagtctgttttgctttgaaaaatacactatcaagccttcagtaagacagttaatagacatgtttttgatgcaggctattttatagcaaatatctataaacatggaaaagcagcctgtacttgcaaaaaactttataaccttccaagattcactggcaaggaaaatggaagaggtgatttctgtcctggtttcttgtagtgttggtaaaaggatacttctaatgtttcactacttttacccaatatttattgtttaaaatacgcaacttaagacacctcaacaagtagcatgcttgatctttaggaacactggagtatgaaagtctgtctagatatttaataggtcaaactaaaaactgggggaaaaaaagtcaatttaaaaggctgcctctatgttagattgaaaacaaaacaaaacaaaacaaaaatgaaccctgagagtaatataatttacactggggtctcatgaatgtggattttgccaatcatcaaaatcatctggtatttggatagaaatttttctgccagcagctatgagaaaaatgagattccttctcttctccccttgcctatccaaacatcatgcatcctccaggttccagcttaagtcccatctcctgtattcctgacaattgtggcccactggagtgtctccttagtcctgaaatatgttttccctggaacatttgcaggaagacactgaggactcttgctaaaagtctagattcctaggtctacttgagacctagtaaatccaaatatctgagagtagaggccaggaatctgtgttttaaataagaatattcttggacatgaactatgagaaactccattctaatgttctcctaacttattcatagactaccctggcatggttacatacgaacaaaatgatttcatgtatgggtttcttagttaacaactattctataagctcattagggactcttatgcatatctcaagttttttcctactacccacatcgcacagttggttaactgtttatcttgtgtagatggaaattccctaaattaaggagctatatattgatttacctcatttgaggcgtattagatgctgaaaaataaaaggaaaagatgaatctaattttacttccaatgctggaaagcttaaaaataacaccttatgtaatatgaataattgtttcctgatgtattcattcattcatgtatcccctcatccatttatctgttcctctatttgataatcatctgttgaatgcctatgataggctttgtgtggtaatgagtaacttgaatgaagaaaaactgccaactgtaggagacgggcagacccacaatgaccccacaatgtattaatgtattaagagccagaagaggatgccaggggcatgaagagagttgagcatcaacagaggctctctgggccgggcgcagtggctcaagcctgtaatcctagcactttgggaggccgaggtgggtggatcgtgaggtcaggagttcgagaccatcctggccaacatggtgaaaccctgtctctattaaaaatacaaaaaaaattagcagggcgtggtggcgggtgcctgtagtcccagctactcaggaggctgaggcaggagaatggcgtgaacccgggaggcagagcttgcagtgagccgagatggtgccactgcactccagcctgggggacagagccagattctgtctcaaaaaaaaaaaataaataaataaaaaaaacaaacagaggctctctggagatgctgatgtactgaagttttgaaaaataagttggacttagcttgatggaaagggaattttcaaacataactaatgatcttattcgcaaattttaaattgcttattatgattttcttcataagaaatatgctttaggtatgtgtaaaatagtctctctctactgaaagtaagagcgcttcattttagtttggtatacatgctggcattttaatcaaacacaaagcattatagatcattgtcagcccacctacttaaggttcttccaatggaattacatgcacttaaagttatgttcactgctacatacatcctacatctcaatatcaaccaggcctcaagataatgctcctccaatgtgtacatatgcatatttgcagcccctgtctcattataatccatgtatttgtgcatgtattcccaacatttttgggtgctcaggtttcctttagtgtttggaatatgttcttcttgaccttggatgtctataaggatataaagaataaccacatcagaatatctgttgctaagaaagaactgctatgataaaaccaataccaataaccacaacattccccaaccacaagattgacattaaacaatagtcaagtgtcttcaagtattttttatcatggaatacaagcttttatacagcacttttattgtacattcctgattaatgaaaaggattttggaaatacattaactttaggccaaaatagtgtccatttattcttaaattgtcaatggtacaaaaaagaaaaaagcaaggatacttgaggggaaagggcagagaatctatatactgaaactaatttttaaaaaaatgtctttgatatttaaaagcaatagaaaaagaagcacaattctcagataatagtataaaataaaaaataaggaaaattaagcattgataaacaccaaattcccaagtgataggatttttaagatgtaaagaatgagtgataatatactacattgattaagctgctacagaataccatgacactatgcacagatacacacaacattattttctatcttaaagctgtgctgcgggatttttagatccaggattgtaagtttttccccccatctcactacacaaacatgagaaactgtgcagacctttgctttctttccatccacagaattttactgtaatattgataaagacaatagtacctacgctatacagatgttaaaaatcaagtaataagcaagataacctgattccagttatcactgcctccctcaaaacaaaggactgcgctgaaagaagagcagatttaattgtaaagtgcaaagacttgccccagattggaaaagagagggaaagggcctgttttgcagcaaccagttagaacacggtcccctaggacttaattatctatatcttgttaggctataataggggcttaaaatgatattgcaggttttctgcaaccaagaaactgattagtgaagttgagtaaatcaattgtcaatcttcttatgagtgaacatggacagcaaccccagacttcaatagagagccttcattatcacacagcagttaataagcatggctatttgaagcacatcaatacagaagaaggagcttgtatccacatcaactggcagtgtgtttggtgttgctcatttcctgattttcagtttggacagaagggatgattatcattctgtgaaccacgttgctgatctccttgctttgacaccatactcttcaggggaattcaatatgttcctgattatctcaatttcaaagccaattagaatatttacagatgcggaggcccctgagccctcttttgcatggctattgctggaccccttgcttccattctctcttttctcttctggacctctgctttcatcctgccctcttcatagctgtttttatctctccaccggatcttctttatcagatggcaagcaagtaaatttatcctaatggatgcctcctttgtctcctttctcccgttgcaatctattcctcttttctcccttctccccactacctgttataaaaaggaatttatatgttctgctttcacgtttttcctcaacaaatgaacctcaacaactaacttcaatctgactttcccctgatcactatacttacagtggtttattattttatttgttgagacagagtcttgctctgtcacccaggctggagggcagtggtgctatctcggctcactgcaagctctgcctcccaggttcccgccattatcctgcctcagcctccctagcagctgggactacaggtgcacgccgccatgcctggctaagtttttgtatttttagtagggacgggggtttcaccgtgttagccaggatggtctcgatctcctgacctcatgatctgcccgcctcggcctcccaaagtgctgggattacaggcgtgtcagagtggtttcttatcatcaatgggcctgaagtcctccccttcaatggctttttctgcatctttctggttatgtatgtgcctgcactggccaccccttccctcctgaagttttgctctcccttgcctccatgactgccttctccagagtcttctccttcctatctcagttcctacttccctcttccatcaactacagatggccacacccctgtttaggatctcagtcttctgtttgccctatctgctcattctgtctctcaaatcatttactgccccctttccttcagatttccaaacctaaatctccaagcctacacctgtctttcccattacctactgggcatactcaacatgggccccaccagcaccttgctctcagcacatctacaggtgccagtcaccatatctcacacaggctctctgccttctctcgtctttcttatgaaatctggtactgtctgccagccctgggcagcattctcaccccttattatgctttccctggtggttcaggagtataaagcctgggaactgcattttctgactccactgtctacattcaggaactgttaataaggtgcaccagcagggttttgaaagctgaaaacaggtgacatttttcttcctctgccaacagtggtgggattagcgtgtgctttggcaacattaggttttggcacagctggctggactctgcaccctcctttttgtcagcaggctgcagggctgctgggctgttgtgacactcacagcagctccacacattttccacctttggtagtgtattagtccgttttcacactggtgataaagacatgagactgggcaatttacaaaagataaacatttattggacttacagttccacatggctggggagacctcacaatcatggtggaaggtgaaaggcacgtttcacatgaatggcagcaggcaaagggagagagcttgtgcagggaaattcccatttttaaaaccaccagatctcatgagactcattaaccatcatgagaacagcgcaggaaagacctgactccacaattcaatgacctcttactgggttcctcccatgacacatggaaattgtgagagttacaattcgagatgagatttgggtgggaatacagccaaaccatatcaggtagcatcagcaagctcctaattcagggaccacagctcagcctgaacttgacagccattagaggccctctggacttttgctccttgaaccctttttttgtgtgtgtgtaggcacctacatcctggtttacatccttctgtgttggaagtgtcttcacaggtctctattttcctgactgacaatgataccaccccagtcacaggatgaatggcctggagcatcttttcaactgctttctctttcccatcaaaatcccaactcttcccaagcactgccaattccttccaatcaacagcttcctctttccttgaccaatgcctctatttcctgtccttgaactgctcttaaagtcttctaacctgtttccctgactagtgagtcactccatcatcctcacccaatagcaggtccatctcttcaaacaacaatttttatcatttcaattatttgattgaaaaccttccatggacccatccttactgtccgcaagacaaagactgaaccacacagcaaggcatttgaaacacatacttattcctatgcccttatgtctccctgttcttcctcatgtactatatgtgcagatagccatggatacttgggattcattcttaaaatatatgcctttgctttcctgcctccagatctacttctcattttccctcgtagaatgtgactcccatccaccaccagtgaagctattcaaattctgcaagaattagtccaaaagccactagaaatctccatctccaaatggattcctgctgcattttaaaacctaatctatatgattcatcccattctcagttttgcacctcaacaggtgtgttgtcccttatggcacaatacaggtaccacttaacttttagttgaattatactgtctatgctgggcttgattttttggtttatcaaactttgaacaccaggaaaaacattagatcaagttcacttaccatgtttgtaatccaaactaaaacttaaccttactgagatctgggtgctgtggtcttatcacaatttcagccttacgttttcaatattaaatgatgtactccagtgaactgcccaagcctctttggcaaatggcggttttatagagactactgcttgaaatcagtggatcatgagatgataaacgttcccatgtataatgttttccattgaaagactttctaatttataagcaagatctaagattctaaatgggtaaatacataaagttgattcacatagaattgctgatatttgatcacaattgacctataaaaatgacagttttatatggttcaacctaataaacacattaaagtaaattttgatgcgtagtatttgttttcacagcagggctcactttatctaataaagcacaatgaacacatacactttataacagataagccagatggtaaaaggctttaataatgacagcagtaatcatgattaatattcattgagcacttgccatataccaaccatcatggtaagaatgctacataaattatctctttttttttcttatcacagctcaattttaatcaccatttgatacatgaagaaatgtgctgcttaaagtggccaagtaatttgtccaaagtcatataggtactaatcggtgaaagaatttgaaataaagaagacctcttcaagagttgtcatttttgaccagataaaagaaccgaactcttttttttttctcctggagacattctgacttttcattttttggtccctatactaggaggaaggatgaagaataaatataactcatggaagagctcaaatcccaactcctccacaaagccttccttgatcacacggctctgatccctctgttcattgtactactccatggtcatgaacatgtctgaattttccaaataatgataaagcttcatcagggtagtgagcatgttgaatgtgcatcatctcctggagcaaggagtggacattgtatttccatccaaacacaatccattcattcgcccactaattattgagtcttaacattgttgggtgcaaacaatcctgagatacaagacccagtctctactcaaaaggaacttactactgcttaatgaggagatgaacaagtgtgtcgacacaatagcatgcagtaagtaccatgaaagaggtagctagactgtgctgagaggagagatgtgggccacctggaagtgggagggcaggggatttacagagcttttccagaactgaaactgttgtggtgaagcctggaaaggtaagaagtcctcgccaatggaaggacttaagaaaaggctgtccaacaaaaacagcaggtacaaaggcacaaaaaagcctgcaatgtttgggtggctgtgagtactggcatggctctaggacatgaacaaaaaaaattagaaaggtgggagagagaaaagaaataggaaggagaaataaagaaagaaggaagagagcaaatttgctcttgaatttagcaaaattcagatgacagtaaaataagtagccccatgctccgcagtaaaaccaaataaaatccgagctactgtccggtggccagatcaatgccaatgaccctgaggcccaggcctacacacaaaagagcttggtgtgtgagagcacatgaagtctgacgatttataacagattttgcaaatggttggtaatacagtgacagtggcacaaaaaaaggtgatgaaaatagagaagtttctatttctacctgttttgataatagcggctctttagctgaacagatggtgcatttcaccaaaatctgatggaaacaaatctttacaggccttccgtgttaagaaataatttcatagccttcccaagagatttggaatgttctttgtctaaataaatataatacaaagaaaatggtcttttggaatccgtaattaaatagtgttaatgctatagaagaaagcgcggtctgacggctatctaaaatgaatcataataaaatgagagaaggttttccaagtctggacatgttcctagcaacattcagtgtaaggaaggatttcattatgtttcttttaaaaagtttgtgtctgaaaggttccagaaaggatagctgagtctggccaatagaacagagctaatggccacagccaaggtgatcaacctcaccaagaagatgtcagctttcctcactaaaaaaaaaatgtattttgatggggaattaatagatgtggcaatgcaatatttatggattgccactcaaatgaaaacaccttttaatatgtaactgagacacataacaaatttataatgccttctacatttcaaaatttgcattgaataatggtaaagggcaaggaaactagcccattgttaactgattgataggcagtgtgaaatgtgttcaatatttatatcctttccacaccaaccttctatttttatttatatgatcatttcctgacaaacataatatgaacgatgtctgcagaatttttattaacaaagtgcaaagacaatacctctgtgtctatacaaaaccatctgctaatgtctcatgtcaaaacctatttatgttattttctttgttcttcctatgttttctgaaggcaactatttgccattaaattaatcctgtccaccttcgaggcatttatgcattcttctggcatttcacattctttgggaaacccttgggtatgcagatttcattacaaaaattcttaaaacaaagcagggtcagggtttagaagtataatatacctttcctttcctaatgtagaaccagaaggctatgcacaaatacagtatttcattttgcaattaagttcaggtgaattattcaaaacttcaaaatgtgaaatatgccatgattatcattattcaaacccctgtaattctccaatatttttgaatggaaacatggctgaaggtgcccgattagtaatgaaaaaacaatggtatagcattcttgcctgtagattctgaaaaaaaaaaattgaacactttaaatcttcctctctttactagactgtacattcattcaattgacaaatcctcatgcatgccttgggacttttctgtaaggcaagttcttccccgcccccccactgtttccttctctccccagtctccccaaacacatgaaagcagtaacacaaaagagatttccctggactgaaatggaggccccagaacatactttataatcaagatcatactttgcaatgggcaacacttctcccctgctacttaatttcttggggttatacaagatggtaaaaaacgaaagagcagcaaatcacagctcttaatggagggcaagcaagggcaaggtgaagagtcttttccaatcttcctcagtctctatctcaagaccatactgccccaggaagctcttattgaccttgcaggtcttgatctttttcatcctagcaacccctcaagaagtgatttgtgctctgtaacactattttatcactcacattgttgtctcccatagctttcctcaaatgtcctggggtgcctattctgtctatatcccaacccaaacagaatggtggtcaacccaccatgcaacctgggcggtgcaggggttctatgcaatgagcgcctagcaatcgggttgtcttaggaagccacgtagaagaggcctgagttcttgagggcacactgccttgtttttcttttggtttaaagttatgacccaccagaatactgacatactgtctactaaggagttaccctccccaagagacaatgattatttgcataaggatttcaacagagaagtagaagtgcaaagtagttaggacaaatagctctggttcagacagtctgggtttaagtcttctacttaaactagatttaatatctactacttagatttcatagccctgtgcctcagtgttctgactcctagaacagggtaagagtacttaacacattcttaaggtggtatgaagatgacatgagttaaaaggacttagaacacctagaactgtgcacagcaagtgctcttattgcctaagtgctccagaaatgtatttatcatttgtttggggatccacaacaattagcaggagaccttgaaatacaggccactaaggcttttatgcagtttgcttttggcagatactcagaggcaggaggaacaccaatcttttgccacagtaattctagggaaattttatctcaaaaagaagccagttcacggtcagcatgatataaagtcacagaacatgcctagaaggtgtgccaagtggagggtgcctaaaagactttctaccctttagccttgttgctatttaaaagtcaaccattagaggttcatttctctagctttaagttcttgcttactaaaatgcaatgactcttggatggaaaccatattaatgaagaaacaggcccaactatgggaatgaagacaaccctgaagtagattcctaattcttctacttttctactgtgtcctatgataccgtggatttcacttccttaaacttctgttttagcaactgtaaactaggaataacttactaagttgctatacggagtggcaattacagaaaactacatagcacagtgcctgggagataggaggcactcaatacgttgcagctctttttttgttattatcattcaactcactggggagtttatcagatttttcttaagcgaaaattaatcaatagggtattttgataagggataaagagaagcaaagaggagggcactggtcagtggtggggagaattggggcaggggaaggaaggaaaagtggggaatgataaaatggaagcaaacttcacctgctttgaatgtcagggcctggcctgcagaggactctgtctctcctgtcatactgttttacaccttaattaaagttccttaattaagaacagggaaacagtccttcacatatttatctctgaactctgattattccttgaacttgtatcccaagaaaaggggatgaagccacataagatttggcagctggcattttcattttccccttattgccatttgaacactagacctaagagtgcattggatgtatctaatcatattagaaaagtggagaaaataacccaaaccaaacctaagagaaggaaccttaagatttgaaaatgcagctaactatagataaaaatcataatggaggattaaaatttaacttcctctgagacaggcaataattattgttaaaaacaagctcacttatatcctctggtttacccttccttagtgaaatctgacaaggcctgtgtgggtcggagcctgcacactgctatgggagagcactggggcagctgcctgccttctcctccaggcggtcactcaccagccatgtggcactggccagttgttacctccacacacttcagtttcctcatcagtaaaatgtgcttgtcagaaaatagttactaaataaatgtcaaatccaagctaattataactgaagtcatttatgaattcaatatttattatgcatctgccacatattaagtgctgctgtagacattggagccaccaaagacgacatcatgggaatccatctttgttcagctaaagacaggaaggttgctaaggaacacagcataaagaacattcaaatgataagctgtagaatttggacttggaccctactgctagatgagaaacaatgagggtttacctaacaaaagaggtgtttgaaaagctgagtcctatggtggtcagctgcaggcaaggcaccaccacttagtccagataagggatgagcaggacccagactagggcagaaaacagaagaggagaataaaagacatgcataaaagatatgttttcaggagtcaacaggacttagaggcaagtacatgaatgcatgaagacaaggaaagccagaagaaactttggggttcaggggaagtggtttcacagtagcatccacagaggaacttcaagaagagatgctggttggggcacaggataatgtgtcttttgtttttaaatttcatttcatcctattaaagcattctgtcctttaaggactaaaaatccgggagaatagaacttgttcaaaataaatacactgtggtgagctgcgtgcaataacgcacaagacacaggctaggaggaaggcggctgtggtaaataattctaccctaccacatcagggacatcctcacaacacaaggtaaaatctaagtgggattgtgaaaggtggagaagcaatcaccaaacggacaaggggagggagactagtccagggacagggaagaataagagcggagcccatggagtggaaggtgtcagggaaatgcctccaggcaccaggacggacaatgtcagcagttacctacttgtggtaatgacacaaatgccaaaataacctccctctctgcccgggaacacacactaaccctccattcagcacaccccctcaggaagacctggcgaaatgaaaactgtagactggcctttttttatttatgttaggggaaacagattatttagccatgacagaagcaaatagtttccatgcactatgcattttaacatttcagaaagcagtacccttagaggaaaagcaggttacggcatgcagagattatattggaaagaagcatagacatattcaatgcctagagagctgggtcccccaggaaggagcgaatctggggatcagtaggaggaaattggatacagtgggcctggagggaagggaggcccagaaatgaacaaaggggtccttagcagggggagtggaatgggaaaaaatagatattcttccacttcaaatttttcctggggctgaatatatgttagaatgcttatatctaaagccttgaagaaaaagtttctaatatatctctgtgaatgatgtgtgtgcatatacacatataagtgcatacacatctactcacatatgtgtcagtaagtgtgtatacacaggcacacatgcacatgatgcttaatccagggatatgtttgctattgtgtaaactctagtttttttattgttgtttgttgttttttcagagacagagtcttgctctgtcgcccaggcgggagtgcagtggctcagtctcagttcactacacctctgcctcctgggttcaagtaattcttgtgcctcagcctcccaagtagctgggattacaggtacatgccaccacgcctggctaattttttgtattttagtagagacgaggttttgccactttgcccaggctgttcttgaactcctgagctcaggaaatccaccctcctccacctcccaaagtgctgggattacaggagtgaggcaccatacccagcctaaactctagttcttaagcaagggaatggacaatggtatgtacacttctgagatgatcccaagggatcattatgatatattttctcctttggcagaggccggacctagcatctggcttcagccaacagaaaacagcacacttgatgggatgtcacttcggtagttacatgaggaaagagtgtgacttccatcttactagtgttggggctaagaacacgtcacctcaaaatatgactgtaggagactaggatatactagccccaaatatattcctctgacatattttgagctggttattctgagaaaatgcagacacaggagtagctctgaaaacctctccttttgtaaaagaaattgacatctacaaaggaaatcttcattagtagaagtatttgtatcaggaagaaggctgctcattatagaactttcattacttgagagcaggaaatgccattccaaaatatgctgctttgaaatgctgattacttcaaactgagggcacctaggaagggaaggtgcagggaggggctgtctctgggctcccctttatctgcctaaagatggatcctccaggggcggctcagctgtcatgaatctcctctctgggaatcttatcaagtagggaggtctgactcatcacagagaaaaccagagttggacacaatgtccaatcacctgttcttcggagtgtccattcctcttttccagaatcaattactcccctgtaagctgcctaaatgcccctcctctatcccctcggaagatggtaatatgcttctagatctcactgggtttggggatattcacttttccttcctttgatgccctatgcatgtaataaatgtgtccaccttttctcctactcatctgtcttacatcaatttaatttgtagctcagccaaagaaccaagaaggatgaagggaagccatcttcctcgcccctacactagcaaactctgtattaccttctctgctggctcactttgatgaggcaaactgccacgttggagaggcccatgtggcattgaactaagagctgcaactggccattagggagtgaatcccaccaacagcaaatgagcttggaagccagtccttctccagtggagcctcgaggtgactcccatcgcagcccacaccttcagctaagcctctgagaaatcctgaagcagaggacacagcttacccatgcctggatcccagatgcacagagattgagacaatcaatgtgtgttttgtttgagggtaaagatttgaggtaatttgtcacaggacaagagacaactagtacaagcaccaagtgttaaacagcttctctccattcaaacttttaagttttctccatattaatgttcaccagcactttttcatactgtctcttagacctgtgaatattttttcatattattttaacatatacatatatttgttctattataatgttcttacatttcttcatcctgcttctgtttctcctttaagtaaagcttggttgcaaattatctttattgattttttataattgtacatttattttagatttagggggtacatgtacagatttgttacatgggtatattgcataaagctgagatttggggtatgaatcccatcacccaggtactgagcgtattacccaatgggtagtttttcagcccatgcctctccctcccttccacgtctagtagtttccagggtctattattcctatctttgtgtccatgtatacgtagtgcttagctcctacttgtaagtgagaatatgcaatattcgattttctgttcctgccttaatttgcttaggataatgacctccagctgcatccacgctgctgcagaggacatgatttcattctttgttatgggtgtgtagtattccatggtatatatgtaccacatttttaaaattaaatccaccattgatgggtagctacgttgatttcatgtctttgctattgtgaatattgctgtgaaaatcatcttatttataatcagcaaggaacttattccctatcagtccttacacccaggactggctctcctgcatatattcaatatatagcctttgcatttgagatatgtatgtatgtcttaactccttctcactgacatgaatgtaaactatataaaaacattaaatagacctaaccataaagtataaacatctatgacccaaatagaattgtgtgtacttcacagttcttcaatgcatattgggattaagtttgcagatatagtacaagctcttccaaagaaaattcaaaggatactcaaaactatctcacaaaaaagaagttaatgtcatcacctactgtatatatttgaaataaataagttgcatgaaaacaaactgtacacagacacatattttagtagactataagctaagaatgacaactatcagacctttacaagatatcaaatgagaataattcaaagaaaagttttactcatatcttacatagcactaaaatgtaatactcattatgcaatcaaattatgaatctgaataagcaaacataaactatggcattttatttaattctgaaaatttagagttaacatatctttcattaaagataaaacatttttaaaagatgttcaaaacctcatttacttgtatttagtacactaaatgtaggagaaagttatacacttattttaaacaattataatttccccatattgaaaacaacagctgtggaagaaagtaattaacatgatttactatataatcattctatcattatatgctatttggaaatatagaagcaaaactgagtagctttctagcttgcgctcataaagaaacctgttttctcaatcttctcctcttatttatcaactttatatgaataacagttttgttaatttaggagagaacattttatgatatgtttccttggatttgggaactcagtcccagctgcctagcatgtgtggctagagccacacaccatgttgcaaagagacccaccacacatcttccaggagtgataatgcatttgactatatgccatatagaaaatatgatgatggatctgaaaagataaccaagtcgtatagttgtctactatttttgactatgcttttaggtgttttgaaaagaatgataataccagatgaattagtccaattaccaccctagagaaacggacaaagaaaatgtgcttcctctcttcactttaccatccttattaccatccaattttctccaacttattcctcctactatcttttgtggttgaagtatgatgttgcaagaagatttaaaactaggcaacaatccaaaactttttcctacattggggaaaatgatttccagtacctagatctctaaacatgactaaatgctagttgatacatacaatgtaaagctactaatcagtcagcatatgtttatttgctttattttggcttcggagaaagaaaaagcttctactttgcatgcttccaggaagagaaaactacgatcatgtcattcaatgaaagttagctcactgatggaaagtacaggtgtaggggctggtgaataaagtattaccgcttatttctgagtggattaagcatctgtgagaggtgtgaaaaattgtcaaaagttactgttgggtgctgtgggtagaagtgagttttagaggagagcctgacactttgttaattatggcatcaacactccactaaatgttagcaaggagcagacctagagaaagacaagaccaagaggagtgaattcagaactttccaaataactatagcctgggattagtgaacagattatttctagcacagattttagtgatatttctatctgagccacaaaagattcaagttcattcttaagctccagggattgtagtcatgatgagactgcccagaaagggtagaacatattattttaaaaaatttttaagatccacagtacatgtgcatcatgtgcagatttgttacataggtaaatttgtgccatggtggtttgctgcacttatcaacccatcacctaggtattaagcccagcatgcattacctatttttcctgatgttctccctccccctctcctccgacaggccccaagcctctgttgtttcttggctttttaatacctgctattctgactggtgtgagatggtatctcattgtgattttgatttgcatttctctaatgatcagtgatgttaagctttttttcatgtttgttggatgccataaatatttacttttgagaagtgtctgttcatgtattttgcccactttttaatggtttgtggtttttttcttctaaatttgtttaggttccttgtagactctggatattagacttttgttagatggatagattgcaaaaattttctcccattctgtaggttgtttgatgataggttcttttgctgagtagcacatattcttaacatggtcatctaaagtcacagtcaactaaatctgttctagtgtttttttttttttttaagaacacagtcaaggatcattgtggattcactctcaggaaacttccctggccttaagaataagaagaagcattccagaaggaaatcataatgaaaaatgttcaagaattcagaaaatcaggcacctttcaacataagcaacattttgctgctattctgaacaaaccataaagacttattgggaggaaaagatgtgaccttcatttaaactggctttattagatttcccttctaggcccaggcatatttagtcaaaggagagcttggatcagagactgaactgtttttgagaaagtctgtgcgctgaagccttgcagggaactatccttggtgctggcctcgaattccttctgccaacacctctcttacatgctaatttgatcctaatctttctatagacaaagttcctatcactgtggtccattgtgctcattgagatacacttctcgcttgatgaatatttttagctatggtccagccaggattcagcgagacctctagcatcacatgcaactcaatgctagcctgtctcttctgtcctgctctattcctgtctatgtcacccaggatacccaccagggcagttcattccaatgcgcccttacaaagtgctgtgagtcatgctgttgagaagggtgagagactcacttccaagggagtaaatgcatcagggagggcaagacattctgcaactggctactgtagctatcctttcaagtaataatggcgtctccctgtacctacttcccccatgacctggtaaccattaatatgactatgacaagaaaacatgacaagcgtcaaggtctgatggttctaacgcagacaggtcagttcatacacatcaccccagcatgtaacacccatgaaccatatgacaaataccctcgtctcttcttttcacttagtgtagctcctaatttaaaggattatagattatatgtcactaaacaatttattggtacctatattccaaaccccattttaagtgctttgcatgtattaactcatataattttcaagataataatttctatgtgtagttatcatacttctccccaataattagatgaagcacgtgagacaggcaggtcaagtgactagctcaaggtcacacagagtgtaagtggtagagctggaatacaaactcaggcaatttggctccagcatccattatccaaactgcttcatgacactaagggtatatagggagttgtaaaggggactcctgtctcagaggggaggctggactagaactgttaggttccttccagtttgaaacttctgtgattccaagaagaaacatatttttcttatacaaatgatcttttccaacaatgcatattatatgctaacatacaatttataaaattataattcatttagaaattatttttggctcaattgctcaggtattcaatttttgcagtgttgcatatgtttatataataatatttgcatagtatcactttgagtttctacttgcatgttaaatttttaaatctcataataaaattcctagagggaattatttaacatacctctgaacatgttttctcatggacccagaaaagttaatataaattcaaaatccaaaacgttttgagcatcgacaagatatgcaaaggaaatgctcattggagtattttgtatttcagatttttggatttggaatgctcaaccagtaagtacaatgcaaatattccaaaatctgagaaaatctgaaatttgaaatacttctgtttccaagcattctgaataagggatacttatcttgtattactgtccttaacatttttttattcttagaggaataaaaaataagatatttcaagtacatggattttccagataaattattagctgcccattcaatcaagcaaacttaaaaagtgtggaaattactttccagaaatgaagcatattcttttaagtcttcttggtatgacctgaagataattttacttttccatgatcatttagaataatcactataactatcaatgctgagcatatatcataaatttcctgtccctttccttaatgtcacttgtatgccactgttattgccataggtacctctaagagtaatttatatccatacaatactcctcttgctgcattgctatgaatttagaaaccttataaccaagttggttagcaatgtaaaacaaggtaggagtacactatttataagtgagaaccacagtcctcaaaaagtaaagcacttgcaatttagtacatggatcctaaggcaactgctttaacaacaaaacctttttaatttctttttagattttgatatagtttagatatgtgtccctacccaaatctcatggtgaattttaattccaaatgttggaggtagggcctggtgggaggtaactggatcacggtgatgaatttctcatggatggcttagcataatcttcttggtgctgcttagcacaatcctcttggtgctgttctcatgacagtaagcaagttctcatgagatctggtcctttaaaagtgtgtggcaccttcccctcgctctcttgttcctggtttcaccatgtgatgtgcctgctccccctttgccttccgccatgattggaagcttcctgaggcctccccagaagcagatgccactatgcttcctatacagcctgcagaactgtgggccaattaaactttttttatttataaattaccaagtctatagtatttcttcataggaatgcaagaatggcctaatacaggttctcggctatgtcctagggaattgaggtcatgacagatgagtgactctcccatacattttacagcaacataggcagttgtaatttttactacagcaatgaggcagataggtatcttatgtcagatgctgtggtaagtatatcactgtggtaagtaagtatattatgacattttcttttgccacaattttctgaggtaggcattactgtccccatttgtagacaatcagatcacagagttaaagtaacttgccccagaccaatcaaaccttgatagaggcaaaattcaaacccaggtccctctcacccagcgtaccactacatggggagcagggggaggttcatttaaggaagaaaaaggggttgctagataacaccattgtggatccaatctagcttgtataagtctttcaaaaatggttcatatttaaaagtagacatgacatctagggtgctatgatcggacacctgcaatcagtcaatatttcctgaaaatctattacatggatttttataagtatctattacaagggatttcccagtcccctgaaatgagcgctacttgccacatgtaatggtataggctaacaattatccccaggcatatcaggctgtgctaggggacacaaaaaagaaaaggaaattggggcagtgaacatcagtggtgccagaagatgctccctgactattcactctcatttattttcctgctccaaacaagctataatcgattttggaaacccattggacaaaaagaaatgtttacaaggatttttctggttatatagctaactcctttagaaaagaaaatatccctcaggccctggtaagattggctgcccaaatcaagaaaatcctctcagttactacgcagctgtcagtgcaaacaggcacttgtagaagctgttggtcaaaaccccctccgacacagaaacagtgtttcagaaatgcctctctagtttacacatgtagaaatgccgtcactggtatagattcggtttcagggaagaaaataagaagtttaatcactgagaaatttcccatcaaatcacagaatcagaaaattaactgtgagatgggaatgaccttgggggtcacaggggccatctcatgatgaagtattctggggaggcacctgttcttagggtgatggatgggcacctcacactcagtgcctgcaagggctgggcaaggaaagcaagttgagggacaggccaagggagcagcccagccgccgtgtttgtctctatctgaccacgcctgctgggcaccatggtgagcctgtgtcgaaaggtctctcagttctcagaagaaggtgtaaatccgaactttatagatatctccatatttttaaatggtggaaaggatctgggggctgcatgaggaccccaggatgaaagcttcacctctgattggaaaaacaagtgactcaaggtaagtacaaagcattctgactggtcatttggatgaagctaggttgacatgtggaaatcttaagacataaaaactaagttattgcaaatattattttttatcataaatagcggatacacaggcacaaagtgaggcttggggattatctcagttcaggctgctgtaggggaataccatagactgggtggctaaagcaacagaaatttattctctcacagttctagaggccagaagtccaaaatcaaggtgtcagtagggccatattccctccaatgcagcgggaacctatcccttgtctcctgcagcttctggtggctgctgccttccttggcttgtggctgcatctctctctctctctcacatcttcacattgcatcctcctctatgaattctgtgagaggatatatgcattaagggaccatctggataactcaagataaactcctcctttaagatcaataatcagagtaagatggtggaatacaaggctttgccgattgttccccctacaaggacaccaagttaacaacttcatatacagaaaaaaaaaacaccttcataagtaccaaaaatcaggggagtattcacagtacctgattgtaacttcatattgctgaaagaggcactgaagagatttttttaaaaatcctgaatcactgacaccatccctcccctacccccagcagcagcagaggcatggtgccaatagcatctcttggtgctgggggagggagaacacagtgattgtgaagcatcaaattcagtgctatcttgatagagcagaaaggaaaaccggaccaaactcagctgctgcccactctgagagggagcatttaaaccagcctcagccagaggggaatcacagatcccagctgttggaacttgagtgcctgcaaaccttgccactgagggccacattgctccatgtctccgagtaaacttgaaaggcagtctgggccataaggattgcaacttttaggtgagtcctggtgctgaactaggcccacagacagtggtctgctggcgggtgggtggggcatgtgactttctgagataccagctggggcagccaagggagtgctggcatcacccctcccctaccccagctgcacagctcacagctacaaaagacaccccttccttctacttgaggagaggagagggaagagtagggaggactttgtcttgcatattggataccggctgagccacagcaggatacggcactggtcagagtcatgaggccccacttcaggacctagttcccagaccacatatctagaaacactctgggccaggaaggatcccactgccttgaagaaaaggacccagtcttggcagcattcctcatttgttaactgaaaagtccctgggtcctgaataaccagcagtgatgcccaggtactatgtaggtaaggaccttggtgagcctctgagacttgctgacttcaggagaaactcagtaccttaccagctgtggtggcaaaggggcaaaactccttctgcttgagaaaagcagaaggaaaagtaaaaagggctttgtcttgtaccttaggcaccagcacagccacaggggagaaaagcaccaagcaggctcttgggtttcccagttttaggacttgactcttggatgacatgtttggaccttcccagagggaagggcaatgccctgaagggtaagtcccaggccaggcagcatttaccagaagttgacctaagaaaccttgggccttaagggaacatttgctagtttggcagtactcctcatggcttgggatggcagtgggtatgggtgaggctcctatggatttggaaagaagagggaggaatgagaaggactaggtcttgtggtctgagtgccagctcagccacagtacaatagaacaccaggtagacttctaaggtttctgattctagtccctgactcccagatggcacttatggacccacctaggggcctgggggacctcaccaccctgcagggaaaaacacaggcctggatggctttgccacctgcttattgtagagccccaagggctttgagaagatacaggaagtagccagggagtggttacagcaggtctcgggcgagacccagtgctgtactggcttcaggtctatatgagtctgttctcacagtgctataaaaaaacctgagactgggtaatttatgaagaaaggaggtttaattgactcacagttctgcaggttgtacagaaagcatggttggggaggcctcaggaaacttacaatcatggtagaaaggcaaaggggaagcaagcaccttcttcacatggtgtaccagtggggagagacagagcaagcgaagggggaagtgctacacgtttttaaacaaccagatctcatgagaactcactatcatgagaagagcaaggggaaaatctgcctccatgatccaatcacttcccaccagctcctcccacaacattggcaattacgattagatatgagatttggttgaagacacagagccaaacaatatcaaagtctaacctgcacagtcttagtggtggtggccactgaggtgtgctggtatcactccactcccagctttaggtggctcagaatagagagagatactttgtatgtttaggagaaagtaagggaagagaacaagagactctgcctggtaatacagagaattttcctgggtcttaattaagaccatcaaggtggtacctctatgagtctgcaagaaccacagtgtaactgggcttggggtgcccccaaaggaagatacagcttagatcacaacaccgaagtcctttcaaatatcaggcaagccttccctataaggatgactacaaataagcccagacagtaaagactagaatgaatacctaactcttcaatgctcagacatcaaagaacacctagtaggatcaacaccacccaggaaagcatgacctcaccaaatgaaataaataaggaaccagagaccaaacttggagaaacagagagatgcgatctttcagaccaagaattcaaaatagctgcgttgaggaaactcaaagaaattcaagataacacatataagcaattcagaattctatcagataaatttagcaaagagattgaaataattaaaaagaatcaagcactaattctggagttgaaaaatacaattagcatactgaagaacacatcagagtcctttaacagcagaattggtcaagcagaagaaagaactagtgagcctgaagacaagctatttgaaaatacagtcagtggagatgaaagaaaaaagaataaaaaaacaatgaaccagacctatgggatctagaaaatagcctcaaaagaacaaatctaagagttactggccttaaagaagaggtagaaaaagagataggagtagaaagtttattcaaagggataacagataacttcccaaacctaaagaaatgtatcagtatccaagtacaagaaggttatagaataccaagcagatttaacccaaagaagactaccttaaggcacttaataataaaactctctaaggccaaggataaagaaaggatcctaaaaacagcgagagaaaagaaacaattaacataagctgaagctctaatatgtctggcaacagactgttcagtggaaaccttacagaccaggagagagtgaaatatttaaagtgctgaaggaaaaacacttttaccctagaatagtatatccattgaaaatatccttcaaacacaaggaagaaataaagatgttcccagacaaacaaatgctgagggatctcatcaataccaggcctgtcctacaagaaatgctaaagagagtacttcagtcataaagaaaagaacactaatgagcaataaatagtcatctgaaggtacaaaactcaacatttatagtaagcacacagaaaaatacagaatattataaccctgtaactctggtgtataaactactcttattgtatgtagaaagactaaatgatgaactaataaaaataataactataacacattttcaggacatagtacaataagatgtaaatagaaacaaaaaaattaaaaatgggggaacaaagttaaggtgtagagtttttattaattttctttttccttgtttgtttatgccaatagtgttaagttgttatcaggttaaagtagttggttataaatagtatttgcaaaccctatggtaacctcaaactaaaaaacatacaatgaatacacaaaaactaaaaagcaagaaactaattcagatcaccagagaaaattattttcattacaggaagacagaaatgaaagaaaaaagagaagaccataaaacaaccagataacaaataacaaaatggcaggcaaagtccttacttgtcaataataacacaatgtaaatgtactatactctccaatcaaaagacatagactggctgaataaacgaaaaaagaagacccattgatctgttgcccacaagaaacatatttcatctataaagacacacatggactgaaaataagggatggaaaaagatattccatgccaaaggaaatcaaaaaagagcaggagttgctatacttctatcaaacaaatcatattttaagacaaaaactttacaaagagacaaaaaagtcactgtatatgataaaggcatcaattcagcaagaaaatataacaattttaaataaatatgcacacaaccctggagtacccagatgtataaaggaaatattattgcagctaaagagaggaataggcccaatacaataatagctggagattgcaggccccactttcagcaatggacaaatctttgagacaggaagtcaacaagagaacattagacttaatctgtactatcaaccagatagatctaacagatatttacagaatatttcatccaagagctacagaatacacattgttttccttggcacatgtatcactctcaaggacagcccatatgttacgtaacaaaacaagtctgaaaacactcaaaaattgaaataatatcaagcatcttctctgactacaatggaataaaacttgaaattaataatgagaggaattttggaaactatacaaacacatgggaattaaacaatatgacccatgggatcactgaaagaattcaaaagaaggaagaattcaaaagagggaagtttatagatataagtggctatgtctaaaaagaaaaaaaacttcaagtgaaaaatctaatgatgcatcttaaaaaactagaaaagcaagaacaaaccaaactaaaattagtagaagaaaagaaataatgaagatcggaacagaaataaatgaaattgaaagaaaaatgcaaagtatgaatgaaacaataagttggttttttggaaagttaaacaaaattgacaaacctttagccagactaagaacaaaagagagaatatccaaataaataaaatcagaaatgataaaagagacattataactcatattgcacgaatttaaaggattattaggggctactatgagcaactatatgtcaataaattggaaaaatctagaagaaatggaaaaattcctagatacatagaaccaagattgaatgaggaaaaaaatccgaaacctgaacagaccaataacaaataacaagatcgatgccacaataaaaatcttcccagtaaagaagaacttgggacccgatggcttcactgctaaaatctaccaaatatttagtgaagaactaatagcaatcctactcaaatgattctgaaagatagaagaggagggattacttccaaactcattctacaaggtctgtattaccctcatacaaaaaccagagaaacacacatcaaaaaagaccacaagccaatatctctgatgaatattgatgcaaaaatccttaacaaattagtagcaaactgaattaaacaatacattaggaaattcattcatcatgacaaagctgtttttatccctgggatgcaaggatggttcaacatatgcaaatcaattatgtgattcaccatatcaacagaacgaaggataaaaaccacatgatcatttcaattgatgctgaaaaagcatttgatataattcgacatcacttcatgataaacaccctaaaaaaactagggatagaaggaacatacctcaacataataaaagccatatatgacagacccacagttagtatcatacttaatggagtaaaactaaaagcctttcctttaatatctgaaacatgacaaggatactcactgccaccgctgttattcaccatagtattagaaatcctagctggagcaatcagacaagagaaaaacataatgggcatctaaactggaaaggaagaagtcaaattatccttgttggcagatgatatgatcttatatttggtaaaacctaaaggctccacaagaactctattagaactgataaattcagtaaagttgcaggatacaaaatcaacatgcaaaaatcagtagcatttctacatgctaacagtgaacaatgtgaaaaagaaaaaataatcacatttacaacagccacacataaaattaaataggaattaaccaaagaagtgcaagagctctataataaaaactataaaacacaataaaagtgattgaagaggacatcaataaatggaataacattccatgttcatggattgaaagaatcaatatcattaaaatgtccgtactatccaaaggcatctacagattcaatgcaatccctatcaaaataccaatgacattcttcaaagaaatagaaaaaatcctaaaatatatgtggaaccacaaaagatccagaatagccaaagctatcctaagcagaaagaacaaaactataggaatcacattacttgacttcaaattattctacagaggtatagtaaacaaaacaacatggtactggcataaaaacagacacatagaccaatggaagagaacagaaaatctagaaacaaatccacacacctacagtgaactcatttgtgacaaaggtgctaagaacatacactggggaaaaaaactgtgtcttcaataaatggtaccggtgaaactggacatccaaatgcggaagaatgaaactagattcctatctttcaccatatacagaagtcaaatcaaaatggattagagacaaaactcaaactatgaaactactacaagaaaataaatattggggaaaatctccaggacattgttctggtcaaacaattcttgagcaataccccataagcacaggttaccaaagcaaaaatggacaaatgggatcacatcaagttcaaaagcttctatacagcaaaggatacaatcaagaaagtgaagagacaatccatggaatgggagaaaatatctacaaactacccctctgacaagagattaataaccagaatatacttgtcccagttaaaatggcttacatccaaaagataagtaataacaaacgctggtgaggatgtcaacaaaagagaacccttgtaaactgttggtgggaatgtaaattagtacaaccactaaggagaatagtttagagatgcctcaaaaaaactaaaaattaagctaccatatgatccagcaatcttactggttggtatacatccaaaagaaaggaaatcagtatattgaagagatagctgcactgttgtgtttgttgtggcactgtttataatagctaagatttggaaggaactgaagtgttcatcaacagatgaatggatacagaaaacgtggtacatgtacacaatggaatactattcagccataaaaaagaatgagatccagtcatttgcaacaacgtgtatggaactggagatcattatattaggtgaaataagccaggaacagaaagacaaacatcgcatgttttcacttatttgtcggatctaaaaatcaaaacaattgaactcatggacatagagagtagaagaatgattatcagaggctgggaagggtatcagggcattgggagggtggggatggttaacatgggtacaaaagaaaatagaaagaataaataacatctactatttgatagctcaacagaaggactatagtcaataacttaattgcacatttaaaaataacctgaagagtgtaactggattgtttataactcaaagaataaatgcttcaggaaatagatacctcattctccatgacgtttttatttcacattgcatgcctgtatcaaaacactgcatgtaaccataaatattgatatatatatacctactatgtacccagaaaaattaaaaaaaataaataaaatcaaaggttaaaaaaagatcaataatcaggtcttttgccatgtaggtaatagtcacaggttctgagtattagggcatgacatgttttttctaagagccgccatacaacccactatagatggggaactggggaagatagcagagactgcaaaaatgtccaaaaacattgcacacatcacaggatcccagttctgggaaacctggggaggcttatacaatttcaacaaatgaattcaatgggcaagacaaggatgtggccaccaacaccagggcaccaatgtgactggctctggaggagaaggtttgagcggctccagcataggagtcctacccacatcctatttacgagggccagaggagccccacagaaataggaggacacagagtgatgggtttttaagtgtctcagcaatgggtgttagatcaccttgacttctaggtaataagccaaatgcaggtgaaaccgatattactgacaaatacatttgataatctattacaaacttcaatagttggccatgggaggtaatattttaggtgatgatatattgtagaacaaatcaagataacttctagtttagtttagctagtaaactggaagtaaagatttattttaagtcatttgcaaacaaccatcagcacatccatgcagcttaaatttccttttaggatcagagtctttgatcttgaatttggagcaatagcccagaggccttaagatctttcacaactaaatgccactacaattgctgcacactctatcatctggcaaggtttggcctaacctaggagatcaaagaccatgagattaggaacacattatcctacagcctgtacataaacacactaaacttttgagattataatgctatgacataaaccaacagcccctccaggaccaggtctggcccatgtagtgctaaagccccagaacttctggctctagccccagaacttctgattctgactcaacaagcactccctaagcaattctgctgtaggtggcccaggaaccacactccggaaaacactaccctaagagagatgggcattagaaaattaaaagaattattttaacatatctatgcataacagggcagtattacatattaatgaaccataaagtgaagctgttgatcatatacatgagctcaaagattttaaaaatattttaaacatatccttcatttggaagatcaatgttttgatattactttctccaaacactgattttatatcctgtatcacctttactcagaattaacatcctaaacatttacagagggaagtatttaaactcctttattcattcagaagcacatctagcatgccttattaacaggactggaaatggaggaaaatgtgctacaatattcctcaaccttcaacttctatctgataaaaatttatctgctaatctccagcctgtaacttctcctttctcctccaactagactgtctagttcttgcgcttttatattaggttggtgcaaaagtaatcatggtttttgctattaaaagtaatggcgaaaaccacgaatacttttgcagtgacctaatacttctctagtatttcttacatcccacaccatgacgcaattatctgtgaatgtcatctaccacattggactacattttctggaatcagagacatggcattatctgaccttgggcatgtcctcagcacactgctataaacaaggttggtataaaataaaagtttattgaattcaatggaaaatatgtatgctctttttaattccaggataattacataattcattatataggtatacagttatattttaaaaatctatttacatcaaccagtgtggttctgataaaaaactgttttcaaaaatgagaggaaaaataataatgtatccaacatattgcaaacttttgaaagaataatgaaggttaaggtagaagggcatcttatctcaggcatctaggcataactagacagcaataagaatgagttactttacaaaagggaattgatttagatatatttgaaacgggaggttgtgcagagttgggctggtctatatttcagacatgcaatacaggcagcattattgcttgcatgcaatttctcttctttctccaggtcatgcaaaattaattaaaagttattgaattttctcctggataatttctgggctgttcattcgaatttggagtagaaagaggttcggaatggcctgagcgcaaatgacaaatgttagcttatgcagaagcaacatcctaagaatagtgatgattttgtaaaatacccaaaaggagttttgcatacttcggaagttttgcacatttaatggactacaaatgtgtattccacatggggtgacagtgaatttttgaactggagatgctctttgcctctctctgatatgctttggaagtaaagctgggaaaagaaaaggaaaactctgttaaagtataaggagtgctgaggactcagtatagcatctctttcacatacttgacctggaagtgaaaaataagcatgtcttctctctacaggaaatcacaaagccagacactataatgaacaaggactgaatgactacttcagttagaattctgatgatgttaatgtcaataggaggaatttcacaagtagttttcatttgttgcacgaattttgagaatattcatatcagaaaattgatttcctattacctatacagattcaaaagacagatactttgaatgatatatttatacaagagaaatatgtaaaaatatttgcatatagcattgatgtggtcattagtccaaggtatatgaattggaattttctttcttatctgagatgaggtttaacagttcaatttcacaaaaggttgccttgcttcgtctgccaaatgaactcctaaaaaattatacgagatgaaatacacacctcaggaaagaatcatcttgattaaacatttgaccaatgtactcaacagtgaacatacacaaggtcctttgttctatattgattaaaagtgcaaacattgactttctaacacctttagccacacaagtaaaaaggaaagaaacaatgtacattttttgtaaaataaaggaggatgcttaaattttgttagaattatttttttctatcaaaaattctcaaatagcattatgcctagtataatttaaattctgtcaatgacaaacacaccaaagaataccatattgctgctatgtgagaatgctatcttgaatagcatatcattgatttgtcctatttttatgacatacttgatgatttgattaatcatctgaggattaaatatcatcaatttttattatgcatggatttgactgagtttttataatagaagacaagtttttattacagaagaaaatcatacaacttaactttatgctaagctgtttttccaccaatttccaagtttctatatatattcaacagcttaaacacagtgaaatggcaaggtatagaaagcacccagtccaaagtctggcaagtggagtgggcattcagtacttccttggtgcctcactgagtagcactgagtagatactggtaaataatgaaaattatgtagcctgggtgggaggatgtatgcagccagccaggatttcttttctagcctacatgttaattggtttgagatgtacttccaaaagaaaggtgagcagacagtaaaacaatttctacatgaagccaaagaatttgtttgtgaaaaatgaatagaattgttatttaaaatatctatgataggtaattgtatctgacaaacttaaacctcttttaaaattgctctatattaacatgccaaaatttgtattcataatagaaatagctactctataaactgatctagatgttgtttgtgtgtatgcacacacacgtgtgctttctaaatttctcataattaaggactaatattaattaagaattagatgaccttactgattcagccatgtttggacaacttgtcattggcattatttaatttaacccccactaaatagaggagtaaaaatcagccatttctttaaaggtggtcttttctctctatttcatcttgtgtcattgctcttttgtattggagaaaccctagattgtacacagatataaataattttatatgattatcaaatatgtcaaaaaattctgaagaatttcatctgatagttgcaaggttatttttttcaatgacctcaaattaaggtcctgagaggaccaagacctgggatttgcttccacattaaccacacagaaagacctgccttccagtgggtggggcttcccacttgaagtccacctggtttggacaaagaattctagagaaccctgacaatgctcctgttgggttcaacattttatgccacaaattattctgtgaaaaagagcagttttctatagaactaatgtaactctaggcagaaatatagatttagaagagtttaaaaatacccaagttaattcagtgccaagtacttatactcctgtttgcccatcccataatcacactctcccttctttataaattaataaattatgcatagggtcaaacatgttcttgaacttctctagtacttacagactaaaaagtacaattaaacagaaataaaatttgcctgaacgtattctttaattcaggggtttccaatctttggcttccttgggccacagtggaagaagaaaaattgtcttggaccacacataaaatacactaacactaatgatagctgatgagctaaaaaaaattgcaaaaaaaactcattatgttttaagaaagcttacaaatttgtactgggccatattcaaaaccatcctgggtcacatgcagcccaagggccacaggttagacaagcttgctctaattgtttcataagagttaacattgaatacctagaaagattaactcctttaagcttctcacaggatgcctagctcagactaagtacgtaataaatgcttgttccttgcttttccccatccgtcatgagggcagagactttgtttcatactttattctcttattgaactccctgcactgtttccagttcaatgctgatcacacagcttggaattctgtaatagtttttttttttttttgattgactaaaagatagactgattcagtgatactgatagtacagcagtatgcttaaaataataaaggtgtagttcctcacaaatggaatattaaatctcattaaggattcagatgctacagaaggaagagcccaaaaacagacccacatacatctgaaaacttgatatgtgatgtaattggcattgcagaccaataggaaaaagataggctgcccagtaaatggggctggtaaattgtttattcacaaatatataaaaagttcaatgcttacagtacaggatatttttatgaatctaaggttgtaaatattccttaagcagaatcgcagaagtacaaatagcaaaggaaaagtctgataaacacaactgcattaaaataaaatattctgttcatcgaaagacgcaaataaaaacatcaaaaatgcaagacacaaagtgaaagaagatagttgcaatgcatataaccaaaaaaggactggtatcccatacatcaataagaacccaacaaacaatccaaggaaaatataagaaaaacacatgaacgggcacctcaaagaagaggtactttaaataaagggcccataaacatgtaataagatggtcagctccatttaatgtgtaaattctaataaaaaccacaatgatatcatgtcacaaacaatagatggaccaaaaaaaattaagtctggcaaaatcaaaacttggcaggatgtggcactctgggaatgtttaagcaatcctagtaggagtataaatcggtgcaaccattctggagagaaatttaataagacctagtaaagttgaaaatgagccaacaacccagcaatttcactcctacttatttatatgtccctggagaagctcttacacatgcgcttaaggagacatgaccaagacagttcttcggaccaggcatgttggcacatgcctgtaatctaatcccagcactttgggaggccgaggtaggaagatcacttgagcacaggaacaaaatgtcaccccatctctacaaaaaatggaaaagttagctgagtgtgttggtgtacatctgtagtaccacctacttgagaggctgaggcaggaggattgcctgagcccatgagttccaggctgaagtgagctaagaaggcaccactacacccagcctgggaaacaaagcaaggctctgtagaaagaagaaaaaaaaaagaaagaaaagaaaaaaaaagaggagagataagaaaagagaaaatgagaaaagaaagatcttagcagcactgtttgtaagagccacaaagaaatgataaacaactgaagattattcacatgatggaacaatgcacagcacagaaaaaatgtgctatctccataaacttcacacacagggtccagccagaaagagaggaacagaggaatacatacagtatgttatcagtttatgatgttttataaatgaaaaacaatactatgtatagacttgagacccatgaaaatgttaaaaagtatatatatctatatctatctatatatatatacataattaagagagactgaatttaagattagattaactctgagactgaaaggaggaaaatcagatcaaagagaaacatgaaggtggccatatttctatttgtaatattccatttcttaatctagatgttgcgaagacaagggttctttccattagtcttcttttatttataggggatgcattccaaggtgcccaggggatgcctgaaatagtgaatagtatgagaccctctgtatgctaagttttttctacatacacttatttttgtgataaagtttaacttacaaataaggcacagtaagagattaacaataattaataataaactagaaccattataacattctgtaataaaagttatgtgactgtagtctctctctcaaaatatcttattgcactggactcacccttcttcttgtgatgatgtgagatgacaaaatgcatttgcgatgagatgaagagaggtgaatgacacagccgttgtgatgtagtgttaggccactatcaaccttgaacacaagcactgaaatactggatgccatgacagttgatttgataagcacgtggctatgcaatgactaacaggtgggtagcgtctacagtgtagatatgctggacaaagggatgattcacatctcaggctggacggagcaggttggtgagaaatctcatcaagctcctcagaagagtgccatttaaaactgatgagttgtttacttctaaatttttccatttaatatttttggaccatggttgtctgtgggtagttggaatcttggaaagtgaaactacagataaggaggcatggctgtatatttagtcttcatacaacatgcacagaaatatttaatttttcaaaatttctgcattccaaaaactcaaatatattttagttttgcttaactgaaaattctaaaatagttttaaattcttgaaacaaatagctcaaaaggagagtccctccaattcagatttttattgttatttattatttatttattttgagacagagtctccctctgtccccaggctggagtggagtggtgtgatcatggctcactacaccctcgacctctccagctcaagtgatcctccgaccttagccttccaagtagctgggactacaggcaagtgccaccatgcctggttaattttttaattttttatagagacagtacctctctatgttgcccaggttggtctcaaaatcctgggctcatgcaattctctcacctcggcatcccaaagtgctgggattacatgcatgagccactgcacttggcccagatgaagtttcatatttcactaaagagaaactacctagcttctaagaaatcattgaaaaaccatataaggcaataggcaaagcattgccaattacgtagatgattttagaaaaagaaaaaaggaatgtctagaaaggaaaagattagcataagggttcttcagaagggaagaaacataaggggtcgagagaacaggttgcaattttcgttggagttagtgtatccagacatccttgaacctgcctttcctgtcgttggttctatctccacaatccaagtaaattggcaggttggcttatcaaaacaatgcatacaaaaaatatttcagagtgatttgcccttgtttccttctttgatcacagaaacccacttaaagagcactattccacacataccttagtaaattcaatgacatttttttctggctgcttcagctgccatgatgattgcaaactgtacactgccctcaccacgcagactacttttcatgcctgctatgtgaacacaaagctttgttttttttccagtcccaagtcccttattcaggaccaaattacaaacaatgctgtgttagacacttttcagaaacctctggataaacgagtctcagcagccccctgggctcgaccccacagaatgtaatgcctgctcatgcccaaaccactgcttccttgtgagctttgaatagtcattaacgttgccaagactggcaatcatccttaaaagtcttcctatgaagggaatctaatttgtatatgtctgaaaaagacaatgaaagaaaacatgctggactatgaactctcaaggtatttgttcctctggctaactgaaatgagaaacttttgaaaatatatgctatcattttttgaaaataatgattgtgactttaaacctgaaaagcctcatctgtcccacctcctcctaattgcctggatgataatgatgtaaatgcagttataattacaaagaacttcaattcaatttaattttaattgtttaaaatttgtaaacactccagaaaaacctcattaagctggctgaactagcttgttttcaagagggaacagggagtcaacattcacagttattcatattacaacatccattcacttacactaaccattctgattaaccagtaatcacacacatttggagcaagcagcactggcaaagcttgttacagcttttaaaaaatgctttgcaaggttgcatatataaaatgaagccccacattcaaaagcagaactttggcatgcatgcacattgaagaagggagaggaaaatcctcacaaaatgcatgcatcaaaaagtttatacttctaaaactgaggtcttagaatcccgaaagattcaggttcatgtctccttttagtatgagatgatgtggtctgcataccttccacagtgtctcactgtggtgtgagtttcacagtcaaaggaggacggcctaagtcctttgcacaaagtacatctttataaccaattgccctgtaagcgtagcagtgaaaagagcactggattggactgggggaacctggcacataaaattcactacttgtgggaactggggtacatgttctagcctctctaaattggttttcttagtaagataagccaaacctgaagagctactgcacagagttttggggacaattaaatgtgcctggcatatagaaggtatgcagtatatgtagttcatagtatccaaaaggctgaaacaaaaagggttcacctttggttaccttctgcataattactaacattctagtgattgatgattgaatatattttagctgaaatcttaagttttcagaactcatcaccaatggtttataatggatacttgtttgtatcatgtgaaggccatatgtggataatttttagaattaacaaaatgttgtcttatgtcacaattctctgaactgtatgagggtttattggacaaattaaaattcaatctagtaatataccactcatattgtcacattttaccagacatgttttcctctgttattgaaattttagcacttcctgcagatatttggaatagaaatagaataacgacaattgttattactactcatttttacaaagggcttttcaatttctaagatgattttaatatacattgttttggcttgtccctatagcttgcagatttggtcccaacactcacagtgactaacaatgttcagagcagtgtaatcattggataaaagcagcagaggcctaagggcaggggtcagactttgaacccttgctttctggtctcaaatctcatgctcttttctggatgttgaattctcccataaacacactacgatcaaccagaactccacttccattcatttataagagttaaaaaagtgaagcctccattatcatctgaagtgtaaagagacatcagatttcaaaatgatggcaacagggaagagcccttgccaaactaactattattttaacaactaaatgactgtgtaatcactgtacttgctgcaaaaacactgaattgaggtttccatttgggtgtttgtatgttctcaagtccagcaaacagagctctgaagaatgtgagcacaggctgcctgggcacggtggctcacacctgtaatcccaacactttgggaagcctaggcgggtggatcccgaggtcaggagattgagagcatcctggctaacacagtgaaaccccgtctctactaaaatacaaaaaaattagccaggcgtggtggcaggcgcctgtagtcacagctacttaggaggctgaggcaggagaatggtgtgaacctggaaggcagagcttgcggtgagccgagatcacaccaatgcactcaagcctgggcgacagagtgagactctgtctcaaaaaaaaaaaaaaaaaaaaaaagaatgggcacacaggcaagtttttcacagtacacctaagcagtcagtgatcatggggtataagtggtagaaaatactaactggtttatttcatttcccttaggaacaaattcatacagtgtaacccagccaagagattcccagagattctcatcctgctcatctccgtcaccaagacgtgtgcttgtgactccagtgctccagcatgcgattgtcactcaacctaaatcccaggtcatctttcaaaatctgagccaaggaagccttaccatgaacactgaacatcaaccatgcctaattccctggcctagtgctagagccaaaaggtgtatgaacctggttccaagaagttccaaaggaatggggacaaaggagacattcataaatacataactgtcagtttggcccactgtgctaaggcacaataagaaaagtgagataatacatccttttgagtggaagggaggtggtcatcacctaccatgctggcctttcccttttctaaccacccattgttcttcctggtaatacaatttagcacctgctgggtttcttacaactcctcccatgttctttctatatctgtagtcaaagtgtaagccacttgaggatacagatgtgtgtcattcttctccaggattccccaaaacacttggcatagtcttagttacaaaaccagggctccatagagacatattaactgactgtgtatagaagattcagtgggtgggaaggggaaaagactaaaaacaaaaaaaaaatgggggagaaaacaaccctgttggaaaaggaatgactaggaatggtatcttggtgagggaaaaagagatggttttatgttaggggagtttatttaggtaggaaaaaaaatgagtaaactttgcacgatttgaaatctgcattccactggctaatataaagtaatctttcctgtttgtaaaatgaaaaccatgaaaagatgataacacactttgtactaaatctacttggggaaggaacaacaacattttctccctttgctcagttcagcctggaatataatagatgaaattgtaattcagagcacattatcaatgctgctatttattttctgaaacattagtctaggtatatttttctacatttttatatcaaaatatgccccttaagattcagacatacattctcaagggagctggtctacaccagttttgtaaaatgttgactaactatttgagtgatgaactgaataaaaggtcacttactttcttcatttatcacccaacagcctttgatggttgaaaatatttgttaacctttctttgtctcgattttatcaccaaaaagaaagagggataaaagtgcttgctttgaagtatatgcgcgactgaacgcatgtgtgaaattctttgagattctcagatggaagtgctgttggaatcattaaaatttagagaactttaggaatttgaatcctttaatactctgaaggtaaagtaatcagattaatggattttttttcttaatcttgtcaagagtatgggttgttcaagatcagatgtttttcacttctctactgaagaaaactgacttgaggcttggagtagagaaataaaagccaacttcctaattattccctctgtgtggtcctcagagactactgctgatctggggttaaacttattctttaactaattaaactctttttctttaattaagcagccctaacgaccttactttgtagacagctggcttcattacaagcagagtaactttcttatactgaacacaaagtaggtgaggaataaccaaaaaggtcttagaaaattacttttaccagaaattatttttcatctcattttgccagatgaaacatttagttaaagggttgctattgagcaacatgaaaggaacgtgggctggaacagtcccaagattcacttggtcaaaattaaagcaggtgctgggctccacaagtcctgggtaccacggaaggcaggcggtttgctagcattcacaggatgccgaacccaggcctgcaacgagttttcatgctgagcacctcaaagcaccaacagagacaggatatgtggattaaagcccatgaaaaaataaccaataatttattttccaatgcactgtgaatatttaaaagaataaaatcatctgctatgcctaaggtgatttatgttttaagatattcaaatatatctcccataagttactatcaaaaatgtttaagcatgggttctagaaaatggtaggctctcaatacatatatgtagaatgcttcatagatgaaaatggttaaaagataacttattgatctgattcaataccctccatttgtagatgagagaagtgaggtctagagagattaaatgaaatctccaagctgacacatgtatttttttcaataaacctttactgacagcctacagagtaccaagaatcatactaaaactgggactacaatgatgaacaaactgcactttctctgtgcctactagctacctctcctagaatatttgtaacaaaacatttgtcattggttgtcattggcagtacaagttaaatttcttggtttacaagttagagcttcagaaaaccttgcttttacttttcatcaatgacaaaataaacacaccattaatccaaatccacctctgtgccatctacagtagccaaattaggaaaccacggactatcatcacgtaacagaactcatactctgatctggagctagtccgcagctaccaagacattctgacaccaaagctgatagtgggcaatgaatgcagggataaagggttggttttctacctttctagagaagtatattaaggtggaggcaggagatgggcaaagagtatgaaaactggagagtttgggccgggcacggtggctcacgcctgtaattccagctctttgggaggccaaggcaggcagatcacctgaggtcaggagtttgagaccagcctggccaaaatggcgaaaactcatctctactaaaagtacaaaaattagttgggtgtggtggtgggcacctgtaatcccagatacccaagagactcaggcaggagaatcgcttgaacccgggaggcagaggttgcagtgagatgagattgtgccactgcactccagcctgggcgacaaaagagaaactctgtcacaaaaaaaaaaaaaaggaaagttcgatgtaaaaaacaagtatatttaatctcagtatgaaaaaggtctcttttcttccttgaattgataaacaattgtttatcaacaatagaatatttgttcaactaatgtagaacattcaacaaatagaataattacattaaagtagtctcttttgaagggtaaaagaaaattctaagaaagcagtaattaaacagaatggtagggagaaaacaaaataaaaaaatactcctaatgttttggcatcctccttgggatggcatgagagggggagataaaaaacatagaaaagtgggaggaaaaaaagcacagtctggaggtatattttagttcccaattgcctgagctataacattcagagtgataaaaccaagtacctgctgcccctcctgcccttcatttggttagctggtaaaccattcttcacagctttttgtctgctcagatccttgaagattctttattcgagagcagtcaggtctaacaaccattcctccaatagctttagttttcatgattagaataacactgtccagaaagaaagatgctgtctcctggaggagggatttgactcctggctggaagtttgccatctctggtcttgttttatccaagatcctcaagaaaatcaaagtctttggtctagtggtaaatggtaactagcattccagggacgtgcttgctatctacttgcgaactatcctaatcacaactctacttccagactctttattttacaattaaatgcttccttctgaaatatagcttggctaaagaaatgcaattttaattgtatgactttgtaaagcgaccttcaaaaattcaaaggttaactttctttactttctgaatcctactgtgccatgcatggccatgcaaatcagcactagtctaatctgtttcccttaccattgctactctctttcgctaatttccactttattttttcaagtccaagttgcttacagggtaagatttcaaagcaagctccggttcctggtgtctctgcataactttggttttagttactaaggaaacacttctttgctgtgctacactgtaaatcctttaattctcccttttcctaattcttaagtaatccatttaaactgcaaaagcaaatactatgagagcatttcataaaacacactgcatgcaatccaataaacaagaaatcatatataatttaacttcaaaatttcatattaattgccattagaaattcaaattcaagtactgtatgcagggtaaatagatgaatagatgcagtgtatgatggatgaagccagcccatgttccataattctatggtgtttatcagtatcaaggaagatggcaaaggcaagtcagaggctggtacaaaatttaaggctaaaagtatctaagcttgcaagaaaaagcaggcgatatctaattatacactaattctaaaatgctttgttccaaagtgtttacccagaaactcaattattccttccacaaacattgatggagatcacaccttgtttaataaagtattagcaatatgatggtatgttacctccccaccccagtagggagagaacctgtacagaaataaccatagaacaaagccaaatatgctaaggactaaagaaaggcacaacgttctatgagagatctatcagagaggggtttactgctggctgaggtgttagagaagctctaatgtagagacaaacattcctgctgggccctgttagcactgcaacatgccaagagggagcctgggagaagaacatgcattccaaggaaccgtgtgagcacttggtttgcctctgagtgtttttaaagaatgtcaagctggctaatgtcctaggggaggtagatggagtgaagtcacaactaggccaaggaatttgagttctgaaattaatctactggtgacgaagagaatttaaagagcttttagtggggttagaaatactaaaaagtgcaaagaggaaattcagaactagaaagtaaagtatcctcacatggtagaatgacatatgcccactcttatcaaatccagtttgaaattttcttggcaatcagatgtccagggggccaccgtggttcattgttcaggaaaatcacgagtcatatgctgacatttattagagttttgacctataagcaggtaggcactattgctccatcaaacaaaatgaaaaccctgatgaaaagtggctacaaaacagcctagcaaaaatctcaaatttacacatatctgtataaggcctcacagttgtctattgatataactcttgaaagtctattttgaacattctgcattttcttgactcaaccattataattcagaaaattaaatggggagaaaggagtgagtagtggtggtatcacaaaggaacaaactagagaaaggtgttgttctctaagagtcttgagttgatactaaaattagggcgtatactagtatactgatccaagagtcaagggagaactgtagtccaatcagccaaaaaggaaatctgagtgaatcatccaaaaaacaaaaaaagaatagaaaacaggtatcaaaagtgatacaccgagccaagaattagggttcctggaagagaagtaggaaggagctgagaacagagagtgagttctagttttaaataacaatctgaagcagttcatttttatcttaaagtatggaatcaaataggtcagccaccttgaaaacgccagaagatggtgtgctgcgagatatcagtttagataaactgtatatatatatatatatagtttatatatatatgaatagtttatatatatatgaaagaactaataccaggaaagaataaataagctattttatatagatttcaacaaaaattattaatgtcaaaataaagcaatataacaatatagacataatgggtatagccaatttaagctctgaaatgcacacacagaggatgaaatgagaatgttgggcatcatttgttgcattatttgatctatctactagttattttgtctccacatctcattataatagccagatgcagagctgtaggaaaacatgactcccagcaatggcacctgtccttttggtgagtaattcaaaaataaaactggtctttttggagagatctctgaattttccatctggccaggctgctcctgagctttgcctgccttgcttagagggtgtttattttatcatgagctttaattatgggaacaataaatgctttcttcttaaaattacttacaagagttattaaaagaatattacaagagagggagaggcacacacttatccctgtgccaatgtttccatctgtccctcctctccctactttcctcaacattaacttgtaggtcaggcaggaaagttatatgattgaatattccgtctgatgtggattattttgtctgtaccactttctcgatgacctgctcaactgaaatgcttgtttcttttatgcctatccagaacatctctgtcccctagtgtccaggtcaactctggattctgcctgaaaactttccccaaagctgtatcctcttcctaaattccaacattcatcatccctattttaacaatttacctttccttataatccaacatattattagtttcaaatgatcttattatatagttccatatttttctattgctctccactgcacccagaatggtatataatagttatttaataatatttactaataaattgtaaaatttcttctttaaaacattaagagtcaagtttttaaaatgctgatttgcttctcttactgcaaaatcttaaagtgtctgtcttcactaattttcattttcagaggagacctgtgccaattacacatgaaatgctaaataaagctagatgcaggactgtgctaaatacgaccaggatagttaaaggctacatgggcttcttttattctttaaaccaacaagtatttattaaacacatattatcaatgacaagcaggaaatcttttccttggatttttaagttacaagtactatatgggagtgcacatttgataccgtcataacttttttgaagacagatcattcaggcaattttgtttgaaaatttttgtcaattacacttagatctgtagctccaaagttgaagcacgcaaccatgccctgttttagtgtacatcattttattgtgctttgcagatttttttttaaacaaatcaatggtttgtggcaactgcattgataaagtgtagtagcactatttttccaacagcatgtactcacttcattgctctgtcacattttggtcattcgtgcaatatttcaaactttttcatttttagtacatctgctatggttaactgtgatcagtgatctttgatgtgactattgtcattattttggaacaccacaaatcgtgcccatataagacagctaatttaatcaataaacgtgtgttctgactgctccaccaattggtcatttccctgattcccctatctctctctcctcaggcctcccaattaattgagacataatattaaaataaggtcaattaataaccctacaatagcctctaggtcttcaagtgaaatgaagagtcacaggtctctcactttaaatcaaaagctagaaataattaatcttagtgaggaaggcctgttgaaagccaagacaggccgaaagctaggcctcttgcaccaaacaggtagccaagttgtgaatgcaaaggaaaaacacttgaaggaaattagaagtactacttcagtgaacacatgaatggtaaggaagcagaacagccttactgctgatatggagaaagtctgagtggtctgtatagaggacaaagcagctacaatatccccttaagccaaagcctagcctgcagcaagaccttaactctcttcaattctatgaagcctgagagaggtgaagaagttgcagaagaaaagtttgaagctggcatagagtagttcatgaggtttaaggaaagatgccaataccataacacgaaaatgcaaggtgaagcaccaagtgctttaggtgcttttatatgaaaaactacagcaagttattcagaagatgtagctcaaataacagataaagatgactacactaaacaatagatttttgatataaatgctgatagaagatgccagccaggactttcatagctagagaggtgaagtcaaagcctggctttaacggctcaaaggacaggctgactgccttgttagagactaacgcaatgtgactttaggttaaagccagtgctcatttaccattctgaaaatcacagggcctttaagaattaagctaaatctactctgcctctggctctatagatggaacaacaaagcctggataatggcacatctgtttccatcaaggcttagtaaatgttttaaacccagtgttgagacctactgcttagaaaaaaaaaaattcctttcaaaatatcactgctcactgacaatgtactaggtcacccaagagccctgatggagatgtacaaggtgatttaaattgttttcacacctgttaatacaacatccattctgtagcccatggatcagagttatctcaactctcaggccttattatttaagaaatattttttataaggctatagctgccacagatagtgattcctctgatccatctgagaaaagtaaattgaaaaccttctggaaaggattaccattcttcatgccatgaagaacatttgtgattcatggaatgaggtcaaaatattcaacattaacaggagtttggaagaagtttattccaaccctcatgaatgactttgaggggtacaaaccttcagtggtataagtaactacagatgcggtggaaatagcaagaaacctagaagtgaagcctgaagatgtgactgaattgctgcaatctcatgataaaacataaacagataagttacttcttatggatgaaaaaagaaagtagcttcttgggatggaatatactactgtgaagatactatgtagattgttgaaaagataacaagagattagaaatattacataaacttagttgataaagcagcagcagattttgagaggactgactccaattttgaaaaatgttctattgtcctgtggataaaatgctatcaaacagccttgcttgctatagagaaatattttataaaaggaagagtcaactgatatagcaaacttcattgatgaatttattgaattatactaaataatttaaccttgctcaagtttcagcaaccaccaacctgatcaatcagcagccatcaacactgagacaagactctccaccagtaaaaatattctgatatgcagccaggggtggtggctcaagcctgtaatcccagcactttgggaggctgaggcgggcagatcacgaggtcaggaaatcgagaccatcctggctaacacggtgaaaccctgtctctactaaaaatacaaaaaaattagctgggagtggtggtgggcacctgtagtcccagctactcaggaggctgaggcaggagaatggcatgaacccaggaaggggagcttgcagtgagccgagatcgcgccactgcactccagcctgggcgacagagcgagactccatctcaaaaaaaatatgtatatattctgatatgctaaaggcccagatgattgttagcattttttagcaataaaatattttgaaattaaagtatgtatggtgggccattacagtggctcattcctgtgatcccagcactttgggaggctgaggtgggcaaatcacttgagcccaggagcttgacaccagcctgagggtgggaccctatctctacaaaaaaattacaaaaattaacaaggcctggtggcacatgcctgtggtcccagctactcaggaggctttggtgagaggatcgcttaagcccaggaggttgaggatgcagtaagctgcaatcatgccattgccactcgagcctgagtgacagagtgagatgctatttcaaaaaaaaaaaagaaagaaaagaaaaagaaaaaaaaggtacgtacatttttaaaagacataatgctattgcacatttaatagactatagtatagtgtgaacctaacttttatatgcatggagaaatgaaaaaattcacattacttggtttactatgatatacactttattgaggtagtctggaacagaacctgcaatatctccaaggtatgtctgcatcagaaatgactgttttactttgaccaaattacaatttctccagaaaaaaaaaaatgagggaggaaagagaaagttccctcaccaacaaaatcagctgaattaacctggtgactaacatgatgacagatattgcagccagagagccctaagctcccaggacaaacaatgggatgccaagcttaagataaccccaagtaaatgcataagaatatacattcattctttctaagacatcagtgggactaggaaaatcatctcaagagctgaactttaaagctattttagacagacacatttaatagcatatttttttaaatcttgtgtatgtcatgacaagttcttttctttcataactctaaatatcacatacaaaagtagcaggtgtgaaatgtgttttgggtaagaaaaatatcaagcttctatgaaagacccttttgggaaaagtcccatactaaaagagtcctagagaatatacccatcatgacacatctcttcaaagctaaaaaacagcttacacaaaatcccagatatcaacaagtataaacactatgaaagaaaaaagtattcaatgtcaatatattttatagctgcatgtttatgtatatattttcatggactagattgatcaaaatataagaggctgtctctctcccgttttctagccgtccctgaaatccacttcactgccaactctaatccttgccccctttttatttaaatgccatcaagaatctgaagtagtaaaattgaatggagatttcaacggtgggccaattttcctttcttatgagctatgaagataaatgtacacacacgagtaaagaatataagctttgcccaagaggtacactgggcagaataaagaaacgtctttcttttcttagaagggaagtgaagatttatgaggaggcagcatattgggcagccttctgaatatcttataatttttttgtgacatgctcttcccctagtgggcttcatcattcaggctgctctcctcccctcactgatcagagcttataggccttctgatgaatccatcctctacaagctatggggacggcctgcattcttgcctacgaagctgcagctaaatagaaaaagcacatccagaatgaccactaaaaagagaaaaagcaaaagcagtttccagatccatgaatcccaaaatattaaaaaaaaaacaaaacaacaacaacaaaaaaacctatttatatattaaaaatttgcttcattactagactgtagagaaatttgattttacattggattcaattcaagttccaatgcatttggacaaagaatttagagtattacataaacttagttgataaagcagtggcagggtttgaggactgcaattttgaaagaagttctactgtaggcaaaatgctgtcaaacagtattgcttgctgcagagaaatatgccattgacagggcccccacgctaggcaccgtactataggcatttgtaaatattatctcatttaatcctcaaaactcgcattctagaagaagtttttttctgcatttcacctgggtgatgaaataacatgtacaataaacccctatgacatgtgtttacctatgtaacaaaccttatcatgtaccatcgaacctaaaagttacagaaaacaaaaagaaaactgagattcaaagaagggagtaatcctccacccaagtcacagaaccagatcaagagcacagctaggacttgaacttaggttttaaacattaactgaggcaagaaccagatgaacacattgtctgacggaactgccaaacctcctctttcgatttgttggggaaaataaaaatggaggggagaaaaagaaagatacaatttcagaagagagagacaggtcataatcaatcataagctttcttggagaactgagcctttgccattagtacctggtggctattgggccactatggcttccccaccttagatcaacacacttgagcccctcaccacctcctaaacacctttctccactccccaaccactaggtttcatttaaaactgacagtgcaacatgcccacattttttttggtaagttcaaatgaaaaaaaaatgtatcttaagtcatgcttgctatgcagaatatttttcaaatctcttactatgctttcattttctgaaatttctctgatgatgagtactaaagataaaatgtaaataattctagagatggaacaagccaagtgctatccatagccctagatgtaatgctcctgtaaggaattataatggacatggtaaaacctttaaaacaaattaaatgttcaacttcagcctccatggtaaagacaaaaaagccaaatatttacgcttggaattttgatctctggttaaaaaggaaatatagaacaaacaaacaaaaaccaaaaagttaacgtatcactatatgaggcttggccttgtgtctcctgttagataagagatgaagcaacactctttggcgacatatggtgagtcatttaagtgtattatgcagatttggagtagagatattaaacagcattttcaaaagaataatacaaggactatgactgaagaaccattgacaaaacacaaaagcacagcttgaaatgtgaagactcagcatcatcttaaagaaataaatacttctatattcttcaattgagctactcaatagttgtgagaacaaagaaaatcctggaggtaaaaatccatgcaataattctggctggtcctctttgcagaggtactcaggtgtgtgatctggtagatggcctgctataagtttaatagcagggttatagatttaaaaatatatttaaaagatagttcacatttaattttatttctggtgagattaatgtgttacaaagttagattaattaaaatgctctgggaaataattttcttggtgaatcgatctttataattcatttacttacaatgtttacatagaaatctttataaaaccaaagaagattcagtaaaaagcacccataaattgatttcatgggaaaaaaataacgagattaaattatcagtgtttttctgcctaaattacagcataaggatgtgaatgtattaggcacattgtaattggcccaatcctggctgctcttctcttcctacttcaaagtataaagaaagcactagaagaggcaggcaaaacccagctcccatggaaggcactagctgtacatattatttcagagaagcaaagcaaggttgatgcaatccacacaaaaagagagatctgagtaactccagattaattaatcacagcaggaggaagctgagttgccagaaatgttactaagttgccccctacagaatggatcaagagtgactcccttccttaggaatgaaatggagacatgattccaaacaccacactttggatttataatcaataattctattgtcatatcatttacaataagtgtgtttattaagctggcattgacagggcactcaatttattatctctgaactgtttgaagttacatatacactaccagcatgtatttatatatggcgaatccatctgcagcttctctttttctggtaggaagagttcacacagcttaccaaggagggcctgaccagatcataaatcaaggtgaagcaatttctgataactgaatatgagtttcctctaaagctttttatgtgacgaaaagctgagaagctctgtgactagcacaaagaaaaactcatcacatttttttttcccaataactgctggcctctttgttctagaataatctgtaggcttttcttggcattttaactcacatttgcccttatacccagggaggcctctgcagcttaactttctctctagtcattgctctcttcatatccaatattagctgagcaaagtgagttactaccaacttttgactcttcctggccaagatgttttcagtttgttcaaaagtagaaaaacttaagatatttaactgatatatttgtggggaaaacttgtaacatttgagagctaggaaaaaaccgttaacatctgccatactacagactaaaggaatggagactagaaagatctagtgaaccccttgctccttcaggaactgtccatggtgctgcaaccctccaaaacatcgtttcttagcagttgttgccacacaaatcagacccaacctcagcgactcactagtcaagattgctatttgacttctctcctcacagaggtgctgaggaaaaggagaaaggagaaaattctgacatgatcaaaaaatggtcgaactcacaccatctttgtcttggcatgggttgtcatcaccagctataaaactataaataaaatgtcatcagggaacaaaactgtatataaacaaatttgcaatgttctatcaagttagagtgcaaagcactgcctctcagaaacaacactgattataactggaaggtggatctttaagtatactgatagtttaagtgcagtgtttgtttcattatggtttgtgtaggagaagaaatcttcctaaaagggtctgctaacaatacaaaaatcacatacgtgccagaaagaatgctgaactgaaaacccagttttcctctaagcagataatgccatgttcacatgattatacaactgaaaaaaaaaacagattaagaaaaagtgttaaagagctttcttgtactgcagcaaaagcatttcaaagagaagataaacttacagagctattacaaatgttgtaaaaagcctaaggaagcctggtaaataagaaagttttaaattactgctcatataaaaataaatgttactgtccatcgttgctctgggtggggatacgcttggcataaggaatacttaagacaatggaaagaaaaaaggcagtgactgtgattctaatccaaacaccatattgttcgcaatagacagttaatttgccatctaatctctctctctgagcatagccccttagtaaccacattcatataatttgttttttcatttaaaattccactggaacttaaaagtttattaaagtgaatggactactccatctgagatgtaactgaggatatattagcagaagcaggctccttagcatctgattaaaatctcagtgttctaagcattggaagtaatactttttccaagcagcaacaaactggataaaaattatcagacccatgaacagagtcatttagcctcattctcttgttttaaagtgttgattgcctgtaagttagtagaataatctcctctcctctctagccaccagagtaagcaaaaaggaaacatctcataagtccacagcctgacaacagccatagttctaatggctctttgaataaggaatacttccacattagaaggaaaaacgacgacaactatgattctaaaaatggaaagcacacacacaaaaattaaaagctcaaatggtaaaaacagctgcgcaacagccatttctatagttttcctcttcaataaaaattgttggccaggcatggtggcttatgcctataatcaaaacactttgggaggctgaggcgggcagatcacaaggtcaacagatcaagaccatcctggccaacatggtgaaaccccgtctctactaaaaatacaaaaattatctgggcatggtggcgcgtgcctgtagtcccagctacttgggaggctgaggcaggagaattgcctgaacccgggaggcagaagttgcagtgagcccaaattgggccactgcactccagcctggcgacagagcgagactctatcttaaaaattttttttctctctcattaagttagtttacaccctcagggataaagaagtgtgattcagagaaagggtggcatggttcacactctaccagcaggcaagaggacccctatctcagtgcactatatggtcccaatgactatggccacgtcactgagagatcagcctcctcaaagcggtagtagagtcttgtctggcattttacttgtactctgacaacaatgtgagatcacatatgatataacgaatatttggtagaaaactgttgacaccagtgcaatatatagttcatgtagctattacagtttgattcattctccattcatcttaatgggaactgctaattctattcatcactaatgacacaggttcaagcaaaatctaaggaaggagtgtgtgagtgtatgtgtgaatgtgcatatacttgtgtatacatgctcatgtatgtatgtatttccctcatatgcctcattaagataattacaactgaaggaagcataattgatggctagaaaatttagcaggaataacacaagggaaatctggaggtttagtacatcaatatggtgaaagacaaattaaaggcttaattaccaaactgtagaagctatttaaaaattatgattcatgttagaactcacaattgagccagccttgtcatcatctttctctttgttttcaataagtgttccttgttcttatcatctaaaacccgtcttcttttttacccttcaaatgcttcttacaattctataattaaattcaaatccatcacaaattctctggataagtcagaatcttaagttggattttgccaattcaacttattaaagaataacagcccaagtagagaaattatatgtgtttcaaaatcattcatatctacatgcattctttctctcccttccttcttctattttttcctttccttctctctcacagaagaaaaacattgtaaacatgggatgctgagtgccatatgttccattacacagaataaaagcaaactcgtttcccatacaatgaataggaaatgtacaccccctagcataccaagtcctactttatatttattttggtctcagaaacgttagaatagccagtctgcaaaaatttttgcaatggttatgtgggaaaagtcagtagggaaagtcagtagggaaaaggaaatgttaaaatcaaagctaacttctaccacaagtgacctctccttggtatgatgtagtctagtggcatctatatttcctccagagcgattatctcaatttaggtgcaacagtggaagtttctgttttaaaccatttttgggttagcagttataacattcaagtggtttcttgagactctgagggaatagataacccaaatctgaacaggatggaggaaactcagtgccattttattttttatttttttatttttggtagagacggggtttcaccatgttagccaggatggtctcgatctcctgacttcatgatcctcccgcctcagcctctcaaagtgctgggattacaggcatgagccaccgtgcccggccctgagtgccatttttataggtactgttcaataaggtcttcaggatgcaacatcatcatattgttataagtgttattctgaaatgttgtggtgtctcacataagctccagttctatattttcaaaagcttataagattttccaactaagatattctaatgctacttaaatttatgttttaaaaaagaaaataccatttttcaatctgcctccaagaaaataggcaactaaaattaggaaagggtaaaaggaatccatgatcatgagaatgggaatggatacaattgcttaggttttagagctggcctatgcagtagtcactagaagcacaacacacagtgtggctggcaactctggcttggttcaggagaggctgatgtctgaggaaatccaatatggtggataggaggtccaagcaccaggggatactccaagtcaagtgggaaatgatctactcattcaaaatagactgtcttccagcctctgggaatgtagggaaaagttttagccacagcatagcatgatcagggttaggtaggttgcaaggacctgagaaggcaagctgcattagagaacatcattttggattttgttcattgaggagctgttgcagactgtttccctgggaaacaaactctgagacagagattaacatgcagggaatttattgcaagggatgaggggaatgctcttgaaattaacaatagaattgggtagcaggagctctggatccagaacagctctgcagaagtgtcctcaattgggataatacaaccagaactttattcccctcatgaattatcgattagatataggctgaccctaataagagtcatgaacttggacaagagtgtctcttcacctgatggcaaaacccagagagaggtagctatcttccacccatattcccagcagagaaaggcaaggagtcctgaaggggagaggtctgatggcacatccactctagtagtagatgcatctactacagatgctcataaaataacttagatagaagcttaatgctgatggtggggcttagggcatacctgaacctttgtgggcacacaagtgtccagggctcactcagatgtacaagatcccaaggctctaataccaacaggacagagctgcaaatgtcctcccagcttcccctcagagcaagtctcagaaatggccatgtgaaattacacatcctgtggcctttggatgatcagctgtttcatatggtctgtatttctctagtcaaaagaatagtagtaagatggacatggcctgaatatactggcagagacatgaacaaaggaagcagaaggcaatgggcaacacacttgtgctcaatttcaggacccaaaactacactgagcaaggggctccttctagacattgttccacagagaggctccctgacccctgttcaagctgttagagggactcgacctctgggtctgaaacataaaaaaccaaagtaggaaaagggaaaatcattcactgaggcatcactgaactcctttcaagtcactgctgtctgggtaaggctagaaacagtggccacactgaatctgcaccataacttacggttggctgactttttgctaatttgtctattaccccaagatgtttggaactaacttcttgcattgttaaatatttcagaatatatatagccaggaaagattcattctttagggttcaactaagagatttgtaactagcaaaatgatgaaccatgaatcaagctaaagagccagttagggacaaatataaatgtgaaacaaggcaatcttcaaacattaaaatttcaagtttaaaaccaggaatttatgattctggattatagcttttctttgcttactcaattggataatgaatgtaaactgtgacgttatggtgcaaaactgtaacccaaggagtgagcgatccagtactgacttgagaaaccaatattacactgtgagatattcacggttcaatggagagatggaaaattagatgccttaaggtctttcttccagcctaaatagaaaataacgtacaaatgtaaagcactggaaaataaaatcccttccagcccaaatagaaaataacatatacatgtaaaacactggaaaataaaaattttctgttgttgttattttattatctttctaagcccctttcctaactcttttccttctttgaagtatcttgaactccttttggacactaaatcttctttgtctgttccccagccagagatccctactaaaagagatagcatgctaaactgtaggcaatttacatgttccggactttcccctctcatttttcattccctcaaggacttcctctctgttaggcaattgaaattacaaaaattaggcattaatagccattgttgcttaatgggttacccatccccagtatagacagatgctgaagttttattccccagccttttagttcctatcattgtatcaaataagactagatgacggtatctccgtaaagccttcaatttcctccctggccccattagatgctctgtttgggttaaatgagaacagcttgcaaggtagttgtttgaacacgactgcattaatcagggtagaaaaaaacatgtagctgatttacagaaagcattagattaacaatttagagtaatgtgaggaaaaaacctcagtgccttataattatagataatatttataaatttcattgatttattaaaaatatatatatatacacacacacaaaacattcagattctagtatttgctatccaataggtacctttattttatattccaaaatgaaaatttatggtggaaatttcaactaaagtaggtatttaggcatacttggatagacgaactttgaaaatgccattaatatcacttacatatatggtggtaatcaaaactaaagctgaactaacttggcaaactctggaactgatattcatgtatggagtttgtcaatgagtaggaaaaatgtatcatttcagtgtgagtttatgacttcctttttgtaaaaggtggtatgggaacattgtctccttacttaatgaaaaatagtattagaatacacaagactgtcaggataattacccagtaaggataataactggaaactaaagacaaagagtaaattaaaaaatgggatgatatggctaataagatatgccctgcccaacagcccatcagactcttctcaccccaactcctgacaaattttcacatagctttggttgccaggagcctcaatacctgctccccagaaggtgcctgtgtgtcaatctctctgtactcaagggggcatgcagatgtttcctgtatcatatctctaggatatctaaggaccgactccttagttctcatttcctagggaggtcaagtctcttaccagaatcctttggggctggcaatgttcatcaccccatcctcagccctctaacttcagaggacagctgacttcttaaaggaatgaagagatctttttcaagtcactgctacttgaggcctcagcaaccaagaagttatacactcctcccacccccacaaattcacatacatgcagatagtagggtagactatacaggtgtgtgagtgtgtgtgtatgtgtgtgtgtatcctcctatatagaggcagaagatttcataaaatatatacatgagatatacatacatgattttatgtataaatacatatagtacacgcatataacattttacatatatatctcattttaaaacatcttgcttttgtaaaaattgtgtgagtatccgatcacaggaatacctttctaatcttaataatttagtggtttaaatgtacatgaaaggtcatcctagctcattataattctagaagagtcaatcatatatccatcaattactttggagcaaactaatggaatagttttaagcataataaagacaaaaggtgacactaaagaagcaaaaataagtctgttaatttccaggaagcttcaactatagaccaatcacattcacagggaacaacagaaaagtaaagctgagctgcagaaaaagtctgcactaccagggtaaaatagaaacaggaagattaagaccaagaaaacttacaaaagaatcacagtcagtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaacaaaaaacaaacaaacaaaaaaaaatcacagtggccctaacatgccaagattggtggaatctctatagcagaaactgtcagtctttatattattcttgctagtcaaattccactttctaaaagccagagaaaattcatgcagctgggtagtcctacagatttctgagattctctgagtatagagccatgcaggttctcctattctttccgagcgtctatattcctaagtagaaaatagaatttaagcctctttccaacaatcttaaagatacactagttttgaaattcagcaaaaaaatcagtacatttcagggtaccatatgctttgaaagggagaggaaggcagagaattaacatttcccaagagcctactgtaataaagacagaaaggcacattggataaaagcatagactaggagccaacctacctgtttcagatcccacctctgccattcacaagctctgccatagtgtattgagtgtattaaatgaactcataatattgaagagaaaaggaagtactcattatgaattagctgttgtttttgttactctgtgctgggcccattcttacaagatgcatggtctctcctgcctcagatatgtgccatgctgtttcatttatccaggcttttttttttttctttttttgagactgagtttcactcttgttgcccaggctggagtgcaatggcatgatctcggctcactacaacctctgcctcctctgttcaagcaattctcctgcctcagccttcatgagaagctgggattacagctgtgcaccatcacacccagctaattattgtatttttagtagagatggggtttcaccatgttggccaggatggtcttgaactccaggctcttctaactctcctgatcctttccctctctgccctcccttcatttcctccaacatctcaccttttccagggagcactgctgtgcctctccagactggaacaggtgccagccctccaccataacaatatttcactgtgtcctcccactatgtccctgagtgcagacaatttaagagcacccaccccactccccgatcgtctatcttagagccaggtacttacaaggactctatatgtaccaaagtcgtgagttcttcaagagtcccaactgttattttcttaattattgtataacacatgccatttttaattccctggctaacattcagtaagcaactgtgtgccaggactgttctaggaaatgagatacgataccacataaacaatgtctctgcctacatgttgcttatagtttgaaacattccaatcaaaaatttttgcttgtgaacaaaaattaagtatgtttcaaaaattgaaccaagtcacgtttgagaaacattacacatacggtattttaataattattataaaatatgactgtaggaataggaaaggaagcctcaaaacacttatttaaaaacccaccatggctccgaattctaaagaaatggagtaagcacactcccttgcactaactacaacaaaaaaactcctgaacaaaatacatatagcaactatttgagaactctaaaaataataacaataggtaacttggggagggtcagacctcaaagaatgactcataaagcagtcatttttgtgcttgtttcttgtaaatttcctggtttatattgaggacagccttgattttcaaactgtggaacagacacaaacagaaaatcaaggaaatccaatactttttggctaaaagaaaacggggtgtctgtaggctagagtagacagggaaatcttttttttttctttctccctttttttattctccctgccacgtactgagtcaagcaagtctcagcaagaactgaaaagtatgcaaggagttgcaaaaagaaaaaaactagagaaaaagatcccttaatcctatatatcaagtccttggctaacccctaaggtacacatgtttagaagtgacctgaagctgcataacaagagctttgaaaacataactagaatgtagaccatcgtgcaagtctcagatagtgccaggctggcacacattctgggccagtctgaacaggaccacaaaagttctaagagctaagccaacactggaaccacagctcacagaagggaaggtgaaactcatgttctaagcctaacccggctggctgattgctgaaaacaaaaagaatcatcaattagaggactttaacagaacccaaagtctctcaatgaaagacccaggatacaatccaaaattattcagcatacaacaaaatgaggacattttcaacagctctcgagtgtgaaacttgatcatccatattgggtcgtttttgtcattcttaattaaaacagagtcaaaaaaccagaagggaaaaaagcacccagggcacataacattgctccaaaaatgtaattcatttcaggactggttgctgaaaatgtctgctttaacctgaaaccagttgtatctaatggctactgaggcaaatggctgcaacttaagactagttttacctatcactggcactcaccaatgagagctcatgagcttcccaaaaccttaccagtgctgatatactttctcaaagagcaatagataacatttctcattttttctgtgtgtaaaacctctaaccatatctttgttctttggacatacaccaaagactactcagtttgtgtgtattccttgaattgcaattctttcctcccaaaaaaatatttgtctctatattttgactttgacaaaggagaaaaaacaatgaacagaaacaattcctgagatgatgcagatgttagaggcattagccaaagaattgaaagcagcttttgtaatgatattccatgaaaaaaaaaacaagaactttgaaataaatgaaaaaaagctttaagagaagaaatcataccaaaaaaccgaaaatttaattaattttttttgagacagggtctcactctgtcacccaggccagaatacagtggtgtagtcatagctcactgcagcctcgacctcctgaggctcaaatgatcctcccacctcagcctcctgagtagctgggactacagatgtgtgccaaccctccagctagttttttcatattttttgtagagaagggatttcaccatgttgcccaggttgctctcaaacttctgagctcaagcaatctgcctgcctcagcctcccaaagtgcaggtattacaggtgtgagccaccatgcctgacccaaatggaaattttagaattaaaaaatacaatcaataaaatctgaacattcactgaatcagcttagtagcagaatagaaatgggataggaaggaatcaataaacttaaagatggatgaatagaaattaccaatttaaacaatagacagcaaaaaagaatatggtctcagagacctatgggacactacccacaggtctaactaacacccatgtcactgaagtcacagaaaatgaaaagaaagagattggagcagaaaaagaatatttgaagaaatgatagccgaataccttccaaatttaacaaaagtcataaactgacaagtttaagaagctcagcaaatatcaagcagtaaaataaaaaacaaaaacaaaattaagaagaaccatatgtagatacatcataataaaatggttgaaaaccaaagacacaggaaaaaaattgaaatcagctagagggaaacaaaacattacatatttgaatgattcaacaatttgaatacctttagatttctaattagaaagcatggaggtcagaatagtaaaacggtacttttgaagtgctgataaataaggaactgtcaactcagaattttaaatccagtaaaactatctctcaggaataaatgtaaaataaagagattatcaaaaaaagagagagtaagttggcggcatgcctgttctaaaagaaatgctaaaggagccgcttcaagaaggaagatgataccagagaaaactgtggaacttcagaaatgagggaagagcaaatgacgaggtaaaatcgagataaatgtattatttttattcttttaagttcttgaaaatatgcttgactgttgaaagcaaaaaagaataacactttgatggggttttcagtgaaggtatgtgtaatacataataacagttacaggacaaaagggtcgtgcaaaggacctacatagttaaagatttatatgttccacttaaagaggtaaaatatcaactctaagtagaccatgaaaaattaggcattaatgttgtaatctttagagctatcaataaaaagtctactcaaagaaatacatttgaaaaacaatagataggttttaaattttcaaataatccaaaagtgggcataaaagggaaagagaggagaacaaaacagaaagcaaaagatgggagaaaaacaggccaaaaataaaatggaagacctaaatccaaacatgtcaaaaattacattaaaataaatggtcaaactacaataaggaaagagattgctggattagagagtaaaaacaagacacaactgtaagtcgggtactgaaacccacttcaaatataataatataaaaaagtgaaaggatacaaaaagatataccatgtaaatactaatcaaaagaaagttgggcaatgtttgtcttgttccaaagtttatcttttctgcatcccaattttggtaatgtttacacaattttatgtatttattaatatagaaccatacataaacaattaatttttgtgcatgcaaatttaaaaaataaattaaaaacctacttatagttctgccttcttaatttacttctttgtacactctatggttggcctccatatctgtggaattcaaccagcctcagattgaaaatacctatactgtatgtccaaggaactcatggatatagagggctgactggaggacttgagcatccaagaattttggtatttgtggaaggtcctggaacccatacctcagggatgactgaatactgtataatccaaagcatgaactttctaaattctaaataaatcttttacaatcacacgatccatcctacgtatgaaaaaaaaatgttgattttaaattcaaagttcaatattgcaattccatctacaattaggaacagtattcatctgcttggaacagaaactcaaattaacagtggtttacagaaattatggaattatttttgcattcacctaaaagaacactagaggtgggcagccccaggctgcatgaaccacctggatgatagtggtacatgataccttcagtgtctcagggttacactattactgtggtttgcaatcctcataactacttccatcctcaaggccatccatggtcacaggacggctactgctatatagccttcaggtccacgtacaaggaagcagaaggagcaggtgaagcagagagagcaaagagcctttctggaagttacatcaacaaattccactctccctcccactgaccacctctttctgcagaggagtctgggaaacgtggttttaaaagctacactcactgtcattctcaacagcacagaggtcttgttaagtgaggagaaaaaagggatagagaattactgggtaggcaaatgatagtctagttgtttaaaccactagccacaaatctggtactaactttttggatattcttattttagaaaagcaattcaagtcaggggaattcaacatgaaaaaaaatagacagcaatgaatttcattcatgtatttataaaactagaaccatgtttgtaatacttctgtgaaaggcagaatatgacagttattacaaacacagttgtttgaatacatactaacaagcacatcatatctcaaaattatggcatcattctatctttaggattccaagataatatgtttgagctaagtccaactggatttaaaaacggatgcttctagaccagaaaaagaaaagcagaaagacatgtgtttttaagctgagccttacttcttcatgagaggtttttgcctgctgaccctgttccggtagcttagatgcaggcggtgatgaaaggtcatttcacaacttcacatgttccagatggtgcctctttggaaagaatctctttctggtaaaagctagaaaaagaaacttctcactacttactgcttttagcattttgtttcctgccaacatgaaaacaagccccgatgatgggacaagacattttctcgtaatgtaattgtatccttcgaaacacagtggtgtagaaaacacaaggggacgcaaaactgaaaggaagaaagctgtatccaaggctaggcttttctgataaccagccattcaaactcctacaagttatttccctttagcttctgctactctggacagcttctgcacattttagaagaattctcaattttcttcctttttaaaatgaagcctagagtacagtgacttgtccaagactcagaagcagaacaggaacccagatctcctgactttcagggaaggtccttttccatctcaccaaatggatgatgcttttatgtctaagaaacccatagtcttcacttaaatgtcttcggcttctctgaagaaaaaagaagactgaaaagtgaggttaagagaccaacatgctggtcccagatctgtcaccaactagctatgggactttagggttcagttcctcagatgtaaaatgagagggctgtcccagactagggagagtgctgatgcccacatgtatctggccctgaactttgtcagatattttacatcacagcaggaactgttcttggatcaccttcttaggaaatgtgatcagtgcttcccaacatttcaagtcaggacacataaataaaatgaagatattaacattctacagtggcaaaaatggaagtggatgcttggagctgcaggtgaatctacctgggtgcaagaaggctgaggggaaaccagtgtctcagtgcatctgtaaactcacctgctgtacactgctgggaagtgggggctaagtgggagttcagatttttaatgttttggtagcagtctggaacctgtagctttacagtttttgtcagagccaactctgcatggggagattcccccaggacctctgctgctggatggtgagttggggaggaagggaaatacgggactggggtgaaggtggcaactggaagagctgaagagactcaatacagtgtgagagtagacagaaaagttgtcaaccctcaccaagacaaggagaatgagacaggcctcatgctccccatttatactaatcactcctcctatttagatcactggctgcctctttacaactccctttcccttaaacagtcttttagtattttctgttcacttcagatggatttcatctgggtaagaattttggcctatgaagcactataggatgtgttcggtatctcagcaacaagagatgccttggtgtgggccagtcagtacttacaggcttagataaatacccagtgctcatggaaagacatacagtctagaaacagcatgcttttcatattttatatgagatgaaagagagaaggaagacatgggatcataatctggaggaacgaggctcttagtaactagaaagttcaaagcactagattatttctattctctttccttgaactaagcaagcttttagaaaagaaaagaaatataacacaaactcactgacaccagggatttattcagccaagcaatttccagaggctatcctggaatcatttcacattcagctcaatactctgtatcttccacattcatatcttttgtcctatacaatgataattgatggtcagcattacagccctgaagtcttgcaacacactgaatcatcaaagggagattcaattatattcataagactggatgtgccatagcagcaaaggggacttggagattgagaagggttgaagcaaaagattttctggttaactcttagtaagccaaaattaactgaaaaagtttcagctctatgcaatatactggttgatggagaaatactttaatatttgaatgtgcacaaagaggaacatttataattttataaccaactcagcagcaatgttattggaagaagattttctatttttgcccagtagaaagtaatcctaaacatcttttcatgggagccatcttttattgtcagtaattttgcataattaaaaatatctcttagggttatttttgcttggttattttagaaaactatgaaatacaaaagcaaaaggatgaggaagatcttctgggaattctaccattggaaattccaaagtaattgctaatattttggtcaatatcattgtaatgttctttcatctatacatattaatacatttctaagtttcttaaaacacttgtataggtaaattttcacctaccttttcacttattacatttgaatatctttccatgtattcaaaattcttttacagtgtaagttttaatggttgtagaatattctgtcatacaggtttcagaatttagctgttccccattgttgaagacaagatttgttattcatttatctttctcgcaaacactattgtaatagcctatacctcaggctttgtttacttccatagagacccaatacctagcacaatgcctggtatgctgtaggccctgggtaaacagacagtgaataaattaatgatttcctcagcatactttccagaagagaactgatacatacaagaccatacatatatgatatgtaatactaaaatgcccccagaaatattgaaccaattaatactcctggcagcactgtgtgtatgtgtccagaataagtattacttttaaataacaacaacaaagtcattagttgattatcaaattctgagtaagcatcaaaacatcagtgggaatgtttgggaagatgtcagggcaactctggaatgatatttcttccttgaactggtgaacatcccatataatttacactgctctcagttagttaccctaaggttaaatggtatactcgagatgagagtttttcctgtgctttatttaaattggggactggtaaaatgtcacctactgtctgttttgtaaataaagtttaattggaacacagccaacccgttgcttacatgttgtctacagctgcttttatgctacaatggcagaggtgaatagttgcaacagagaccgtctggctgacaaagcctaaaatacttattatctgaccctttacaaataacatttgtcaacttctttaaaagagcacttcttaaaaaatgaaactaacactacaccataataaatcagctaacaagcatttattgaacactgtgaggcatggtgtctactctcaaggaacttgaaatataattgtggagtaaagcaaatacaaatgtaaaaattagccgaaaaaggtaccgtggcattaggagtcgagtactgtaatgaagtgaacaagtagtgaaagatttcagagacaggagggaaaaggtgggattggaaaaatggcaagatgtcactgagacacagaacttgaattaggctatgaatgaaaagaagggcttggataaaacaaagcagacagagcagactgttctggaatgaagagcatgggcagaagcaaagaagtggggctctgcacagtgtggagataccaggtgggactccatccaaaatgctggcggactagcacatcagaagcatgctatgtggtacagtatgaaagcaaagtgtatccatgatctgtgtatttcaaaggcattcattttccatgtaaagaagccctaaaatacattttttacttaagcaaaaaaaaactctcataaagcaaattaatattttacgctctcttcctacagtgcatattatctttcatctcctcacttctgattctaattagagttctatttcttcaaaaacttgaatgctgatgtaaaaactaaagtgaaagattaggaagactagaaagaaaataagatcagtatcataatacaacaaacaaaagcacaaaaggacaggcaaactgatgttcatcacttaatatttgccaaagcttcctaacaacacatttttctgaatcagttaaaaatacagtatctgcttattttctagtcccttgcatccaagctaacaaatgccattgtaaaattcatgtctttattttttgttgtggtgtatgcattttaaaattcaaaatgttttttaaagcttggaaagaaagatgtatttatagtatggcaattattattcaactcatctttacttagaagcacacttttacatgctacaggtgaggtgagatggatacaacattaaatatattctttctcaatgtcttatatgtaaaggtacaggtaaagatggccttttgggaaaatgtggagcatgggagaaacgttttcctccttttccaagcatagctccttcattccaaggtagtaacaatgacatctgccatcagattacccagacatcaagtgacacagaagcaaggcttatatagcactgtcacagttttaacattttagtttcaggggtacatgtgcaggtattttatatagataaactgaatgtcacaggggttcagtgtacagattatttctttatccagatagtaagcatagtacttgataggtggtttttcgatcctctccctcctcccaccctccaccctcaagtaggccctgctgtctgttgtgccccaatttgtgtctatgtgttctcaatgttgagcttctatttgtaagtgagagcatgtggtgtttggctttctgttcctgtgttaatttgcttaggataagatttcacagcagttttaaatgaagggtacattaataaataaatttatcaaaaatgccaccacagcatttttgatctcaatataaaatgtagcaggcattcctcccagcacacacaggttaaagactgcatcatcggttcagtccatgatttttctgttgacacacatctggtgaatacaatgtgctgaagcaatacaaaactaaaacaaggcttttgatggaagaggtctaagaatcataacatactgagtgtgtcagaggaagtcactcgtgctttttcactaaaagaagctttacaggtgggtgggtggaaggggatggagaacagttcacactctccatctcatcctgacctgggacctccttcctgtttccttggctggtgccagcatttccatctttcttacccacttctgccatgttgaagctcagctgggcattgtatccctggaggaacagtggacagagcaggggctttcctcttttgaggcacctacgtagacagactcactctctctactcggaaaataactgtccctggtgccaggttttggaagttgaaatgttttgagctaatgcctcctgtgattcccgatggcctactgtttaattgtgtaattatagacagttaaaaatgcatgatatgtgatggtgagaaaatagttggtgcttcgggagccattatggattacagtttttgaaaatttaaaacaatgcaatatttatatagacttggctgcactgagttattatgcaaatgccacatcccactctagggccagcattcctccccagaaacgaagaaaggcagatgagaatcaggagagatgccacagtgaccacatggttgggacaacgagcatcttgagtgtccagctgcaggataccctgtgagtttctgtgcctcagtgatgtctgtgcctctctttaagtggtgttaagaaaacccagtcaacaatatctaaataattatttgacagttgctcagattcgctgtaagagaattatatgagctttcttcttatggccacttgcatattagacagggccaaaaaaaaatcacaccaagccaaaagtaccttaggtattcccagagtcaaagcattggcttagcaactatttataggctacacagcttccttgaaggtttgatccactcaggggcttgctcagcaatggcctatctggtctatggacagcaatggaactggagtaatcaggggtgtgctggggactgaggagaatggtatcagtaaaaccaaatggttgtgacacaagacttaacagttggctaaaacctgaagctctggtgaaatattattcatatagggtccttgtacttatgccctacaagaactaggattgattccaaattgtttgtaaacctaagttaaaagcaatggattggcatggatcacgtatcttaccagacaggaagttatcagggtggtggtaggtgctggtgaccaaggcatagactgaattctgcagggagtacaatatacaaacagtgtgtgtgaatgaaaaagaaactctcactgttcattcattcactcgttcattcttttttcatccgtgtgtttgtttcttctgtcattcactgagtcaccgcaatctaaggtgatcccactatgtgtcaggatttgtgctaagtgctgaggatatagcactgatctttgatttcagttctaggaattcacagtcaattgaggaagaaaggcagaagaactttgtttctgactatcagagatatataaaagaacaactctggtgagttcagaggatcttgtgtaactgcctggaggagtcagaaatgacacctaagagaatgtgaacattgagatggtatcagaaggatgattaggagtttctgagcacagaaaacggggaaggcatccgtggcagaggctacagtgttcaacaatgcatggaagcatgaaagaacacagtgttttggagaactcacacattatccagggtggctggataaggaaaaagaagttgagggagaggaatgtggccagggaaccatgcacatgcctgggaatgggccttgaatgtcacagtaaagaaaatgaaacagatctggaatgaatggtgtacagtttcatcttgggacctgccatcatcatttagtgtaatgacatcatagaagtattcaccatgtgcagagcaaatatatacatgcaagaaacaaaatatcatggatagttaacattcagacaggcttattttcaaatctggattctatttactgtgtgacctagagcaagcttctgaaaccagcagaatctccatttcctcacctgtaaaacatggatgacacatatatggtgggcttgatttcatgaataaatgggatacagtgaggaaatgcttcactaaatgtcttcaccaggctctgaatctcattcttgcttcactaaccttaagcacatcgaaatggtataagcttctgagctttggttccaaaagttcagtctcacctctgcctttcaactgaaataaacttcatacatcaagctttccactactgaaagcctcctctttcaagagacttacagccaccattcatgacctcagcatcaggacacagaacatcctacatgcttagctgatacacttaggcatatgtttacatgttcccctcaaaaatttcaaatcgtttttcatatagagagacttcatcgccttaagtggaaggataatgttgaaggttcacagtaaatccaaatatgatcttgctgattacaaagtttaacaaagtttttattaaagggcctgatgtttaatattttaagctttgtaggccacataggtaggtctcctgcatattcttcttcttttataacaattatttaaaaatataaaaaccatttcttagctagttggtaatacaaaaacagtcagggtggggagatgggaagggtagttttggcctgcaaactgtagtttgcttacccttggattaggaaaataacataacagtatttgatagagctcataacatactgcttcagaggaagcaatggctaaaacatagtactgctaagaagtccccaaagtgtgtgaggctctcttagtaagcatcaggcacctaccacctgcagcaacattttagagatgatgcagcatttaatagaatcacaaagcagtaatggtctaggttgactttaaattgttttggtattctaaaaaataaaataaagaaacttcataataagtatggcaattttttaaacagtgaaacagatacataaccacacacaacatatatacacacacaaaaataaaatgtgcaagatttttaacagtgcttatttctgggtaatgggattgactgggggaagttaaaatgtttttcatactgttagagtttgaggtagcataaaaaaaagctgccagttccttttggtctggtcttggaatcaactgaaagagatatgtcaggtaaatgcagaatcaaatatggcctgtataagtgatgtggcagttagagcatgtgttataggtccttgagtgggcaagctggctaattaattcatcgctggtttccataaactggctcacccttggagaactgcaggtcttcgctgcagcagcaggacccctcctgtacagcagaggaaagatgagaatacacagaccacagtgaaaactagaaccagatgtcactccctaccctggggacaagtagatgagaaaaggtaaaggaagccaagagtccattacattggtaataagggtcccccaacatgcactgatttaccacagataagaaccaaccaggaagtgcaaaaattcccaagagattgaacaatcaatacttgctaccagaatcttcttctctcagtagtttctagttaaagaactgctacttctgtgtgactttggatcaatcagttcacagctctaactcatggttttcatgagcaagttgtaggagctgcactaaaaggtctattgaagtcctcttccgccattctttgtcaattactgagctctactgcataccaggtgctacccgtgctctgggaatacagttttggacaagataaactcagctgagaagttttcattttagtggagaaaatatctaaacaaacagctatttttatctgatgcccagctctattccattttccttctgaagcaaagtaaaataccacattaaagaaatttgaggcagaagtgactcacaccggtaatctccgcactatgggagaacgaggtaggaggatcacttgagcccaggagtttgtcaccagccagggcaaaataagtaagaccttatctctacaaaaaaatctttaaaaattaaccgggcatggtggtgtgtgtctatagtcccagcaactcaagaggctgaggtgggaggatcgcctgagcctaggaattcaatgctgcagagagctatgatcatgccactgcactccagcctgagtgacagagcaagaccttatctctaaaattataaataaaaaaaaatttctgatccattaacattattttgcttaattttctcaaaaataccagtagagagatcatacatgttttataacaacataagaaataaaactaacttttcatgtgtgtatcagcctgggaaacaactactaaagaggaaagagaaaaccggatttgttgaaagtttagggaacattgggggcaagaaggagatctgagatgattttagacacgaacattttatatttccatgcatcatctataatacaggtatatacttgccaaacagcaatgctatcatgttgacattgcttgagtaaatttttaaaaatctagaaaagtgatttttagatgagggagtgtgagaagcagaaaccaaggagaattctcagacacagaacttgttaaaacacctcatcttgagatctattaatctctgagtttaattaaaagtctgaatgaacaaacttattttatctgatttggttttccttctgataccaagttccatttggttttccttctgataccaagagaggttgctgaaactttctcacctatttacttgcatttactctttgtaattgagtgaagacctaatgtgcgaccccctggggcattctatagctaaactaaattactggtgaaatttacaaatccaatgacaaagtaacgcaaagaccaaaaagaacagtctaaaaaaattgctccttctctttttcaatcaatcctcaggattaaagggagaatttattgataaagacagagaagtaatctctgatggagcgagatggtgtatcagtgttctccatattcgttcaattaatagacttcactgtatgcaaactctgataagtggatgaaatgtgttgtttcttaatgatctaatttgtattccagcaggatgtaggctctgctagacaaacatttcgcttggctatttccctccaaacatttatgcctcttggtgtgctagccatttattttgacagtggggcttgatgcacatctctactgttaatagctctgcaaacattttacaacaaaaataccatacaactggaactaatctcattattttccatgttaataattcttacagcaacagaagatcattaaaacccagaatggtaatgcacagatgtttaatgtagatgttcaagagctcctagccaagtcattccttcactgcttttcacaacaaatatttactgagcaattactctgttgcaggcactgtgttgtttgtacatatttttaataaaacaggtatgatctccttctttacggagctgccattctagtgggagagagatcactgagtttaacaaacaagtaaatgactactcataagttgggataaattttaccagggctgtattttccctcaccataacctcccttaacatgcctcctctctcactattaaaaggcggcttctatcatttgcttgtatgatattcctaccacttacttatttttcatctccagttcaaagattaactgtagaatcttcacaccgatctgatgtgtaagaatcaagtaattggctcctagaattccaaataaatgaagataaacatagcccatgcttcagagttggcacgggcactaaacaaaggcatacctcattcacatttttgcagaagccccttgaatatttctatggcctccagtagttggtcctcattctcccactttccagtcttacctcatttgtcccccgtacgtgaagtacaatagctctttctgcaccaaacctctcacccctcttcttttcaaatgaacctcagggtctctaacaccaagctgttcctgtctgaacaagctctcctgccctctcttaattctccttataccttccttaccatacctcctactctaaccacccagagagagaatgctgccttcacattttaaactgtgtcatataatttatggtagtgttttccaaccccatcagatgcaatgttccattttataacaaatattatgtaatgctgcctttactatcctgaaatgaaattaacagataatataatttacctacaacattatttcaagaaaaaaatcaatatgctgccctaactgtaatacaaaggagaaataaaagggaagtcatctgtaataaaacgatatgtacagagaaatgctattctagaatatagaatgaattaagcagaagctcgcacctacctataatgaataattttgtatttaaaagaagaggattatttttgaacttccatacaaggcgtacaagaacataaaagaacacaagtagaagctgacactaaaataaaaactaataaaacagaccagacttatctgtatataggaaatagagggaaaccaccttaaataaagtacagagaagatgcagagacaaattacagactgtcaaaacagagatgtgagaaaatatgatgttcctataaatgacccaagacatatccaagtcttaacattataccttgagtatggcatgcaacagggtagtgataaatatcatagaaaatgtatctctcatcttaaaatcccaccacctgctgaagtttccattcagtctatagtactcacaacactttggggaacatactctttagtgggccattgcacataaaacatgaatgggaatgtgacaagtacttcatgtcaaaaatgagaaatatttttaaaacaagctttaataagtttcaatgaggtctattgagtttcatgtgtctccactaatttaatactgtttgattctaagtatgtgaatcatagtttcccatcttgtttactacatatttgtatgtggcaactataagtggagactgatggctcaaaaaaaagatgtcttcttgttaacttggatggttcaaatgatgcccctgttgagggcatagtctaccaaaatggtgaaaaacacttgtcatgctctgaataaaacaaagtactcttcatttacaaaagagatgcattctaggaaaattcaatgtacattgaaactatggaaaacatatcttgtgtctatacaaaaaacagagttaggttctagacattcatttgtacatacacaagtgtccagcagaaccaggggcaatttttgtttgggaatctttattgcatgctaaaataaccatggctttcctggttcccacatattaaaagatcataacacacccatgataactgggatgacaacaaaagttccggtaagctttcaatatattgctaatgggcagtactttcctagtcaagacctttgttttgtggagcgtttctacagaggagccaaaatctcatactattcagtcttttctttctcccctatagcttagaatcttcccaggtgtccttcaaaatgccttgctaccatgttctcacaaaatgcaggttctaggaattccagatctggcaggctggaaaatgacccctgaaaaacatatctaactccaggccaggtatgtgtctcatgcctgtaatcccaacactttcggaggccaacgtgggaggatctcttgagcccagcagctcaaagccaactggggcaatacagtgagaccttgtccatacaagaaaattaaaaaaaaaaaaaaaagaaaagtctaaccccagaactctttgcagttgtaattaggtaaaggatcctgagattaggagatgatcctgagatatctgggtaagctctaaatccaacgacaagcattcttataagagaaaggtagaaagagatttgagacaaaaagaagaagagaagacagtttctgcctccgtggtcacactgccacctcttcgttgtggaggcagtgggagaccatggaggcagaaactggagttacatggccacaggccaaggatggctggcagccaccagaagctaaaagaggcaaagaatagatttccccttcagagcccaagggaatgtggctctgcagacaccttgattacaaacatctggcctccagaactgtgagacaataaatttctgtccttttaagccaccaagtctgtggtaattggttatagcaaccaaaggaaatgaatacagcagatgagttagacactggccagggtagaagaaaggttaatatcatgctttgtttatgtgtttgttttgccctaagacttctacattctctgaacacggttggagacttggcgggggaaattacagaatagagaaacctctgttctatttcaaacgctctactcagcttccctccactccactgtccttcccaggtaatacctcgctgatgtggtttgggtctgtgtccctacccaaatctcacattcaattgtaatccgcagtgttagaggggcttggtgggaggtgactggatcatggaggtagatatcccccttgctgttcttgtgatggtgagtgagttctcacacgatctggttatttaaaggtgtgtatcacctccccattcatgctctcttcctcctgctctggccatgtaagatgtgcctgcttccccttctgccatgattgtgagtttcctgaggcctccctaaccatgcttcctgtacatgcctgtggaactgtgagccagttaaacctcttttctttataaattacccagtccaagatatttcttcataggcatgcaagaacgaacgaatacattcactcagcctatggatcttagcttgagatttccttccccatggaaacctttcctgtccctctccagctaagtgagattccaccacatgagctggaatagaattgttttcccattctgcagaccactcacctcattttaaaactaaacattgactacaatgagtcctcagcaaatattggtttaccccactagaatgtaagctcctctagataaagggccctgggtatatttcctcaccattgcttttctctgtggcctggcatggtactcacataaatattttatgaatgaatatttagatacagtcatttacagatgttttggtttaaaaaaagatgcttggccaggcgcagtggctcccgcctgtaatcccagcactttgggaggccgaggtgggcagaccacgaggtcaggagatcgagaccatcctgactaacacggtgaaaacccgtctctaccaaaaatacaaaaaattagccgggcatggtggtgggtgcctgtagtcccagctactcgggaggctgaggcaggagaatggtgtgaacctgggaggcggagcttgcagtgagccgagatcccaccactgcactccagcctgggtgacaaagtgagactccacctcaaagaaaaataaataaataaagatgcttgtcagtcagctttccagcagcagcaataaatttctttccaggataaagccatgttttgatgagtacattcttctagatactgtacttacaatacccatttcaatggtctcatcaccccaacctctgactcaatacttagtgtttgaacatgatcagttcatggccaccacagtgggttgaattgtgtctcctgtaaaattcatgtctacctagaaaaaacaaatatgaatttatttggaaataggatatttgtaggtataggcagttaagacaaggtcatatcggacctgaaatccaatggctgaaattgggcctgaaatccaattgggcctgaaatccaatgactggtgtcctaataaggggagggagatttggatacagcagaggaagatggcctcataaaaaccaaggcagaagttggagtgatgcagctacaagctaaggattgccggtaacaccagaagctaggaaggagcaaagaagaattcttccctagagccttctgaaggaactcagccctgccagcaccttgattgaagccatctagcctccaaaaccatgcataaatatatttctgatgtcttaaggcagtaagtcctaagttaacatttcaataggttcttggaaactgcaactttaagtgaaacaacatacagcaagtcctaaaataacataattttttttcaacgtcatttcattttaacattgatgaggaaaataactggtttcattatgcatcgttttgcctaaagttgcagttcccaagaacttatctactgtccttcattacagtggccctagaaaagtaatacagccagtaaaccactggtacgttttatggttttttgcccatgtttcttttataatgagtcacctcactgagatttgccttagtaacaccattcctttcaatcagttccagccattggctaatgagatggcacaatcagaattagaggaatataggggttcaattgtagaaaaagactgcaaaccagtataatctgagcaaggcagcagtactacacagaacagctcaggtgccaggtggttttttgtttgcttttgcagttcctgcctctttctagttacatgctgagctctgtgccttaccttcctcatctgtaaaatggaaataataataatcccttccttgtagagttgtgaagattaaattacatgctgcatacaaaatgcttagcatagtacctaggacaaggtaattaagcaataaatattagctgttactattgctagtagtggcaggggcaagggtcaaaaataatcatttcattcaattaaaaaacaaaggcctaaaccctaagtatgtgatggctgtggtagacacctgaaaaactgaatgcttttattccatgtagtgaagatcttatttttcttgcagattattctggagtttgactctaagagttatctttagatgcaaaaagtcatttcattttaaaacagcagtgcctgaataccacttatgttgcctgaatttgttcacattactattcacgaagcttgacatcctgcaatgacttctgcacaaaactcaaagtcagtaaaactttaggctacttaccatcaagacagggaacaaacccttctctctgcaaggtttttataattaaacatcatgacatctaatgatgtctacacagaaccgcttctcactagcacagaaaagttatctctaatagaaatgttctttctaaatggtaaaggagggagcatataaatatctctgcagtggtggcttctggtatagctggtcagagtggacaggacacataccaattactgttagggtttgcaaagaaaatagttcccattcatttactatttgatagaggagaagggatcaatgagcatgaaatatgccaacttataaattcatatttctaaaacctaaactaggcaaggagtaatgttcacaatgtataaccagtgaggatggttatgcctcactgtactgcccaatcagaaagagtggacactggccttaggcctggagcagtcctggaaggtccctaccactgcagatgtttgccctttacttgctagatagcaggaggtctgaggctctcagggagaggcaggggctccaagtcatacaggaatgggtaggcactccagttgactgaaggacacacagggggtttcaggcaatggctatttgccaagcaatatggaagtattttaatattgtaactgtgtggctctaaaggcaccaactagtgaacattgtcgccggataataccatgaagaattagactggcactgtgaaagtgaggtgaatcctaaggcagtcacaaagcagaggacagctgagagagatataggagggagccattgtggattggtgtatgcatggtgagttctacacagaatcagggagccggagggtttgatccctcaaattctattttagtatttggtattattttctaattatattgctgcagtaacaaaattcctttgttaaataattaaaagactccttttaaggctaaataccacctggctcccaaattttggtctactctccccggaaacaactccttattacaaatttagtagtctcattgcaggtatctttccatgtatacttatgtgcatttggtactgttttgggtgctatgtgtttacatatgtggtgggcggaattgtcaaatgctcccctaaaatgtcctctctcatccctagaactgtcaagatgatgagatatcacaccctgattatgttatgagacaaaaggaattttgcaaattagttaaggttactaataagttgactttgagttaatcaaaagagatcatctaagtggacctaatctaatcatacatgccctttaaaagcagagttttctccaggtggtagcagaagggaattcagagagattcaaagcataagaatttgatgcaccatcactggctttgaagatggaactgaccatgtgccacggaatgcagatgacccctagaagtttagagtagccccctctgagagcaagaaaatggggacttcactcctataacccccaaaaactgaatcctgccaacaatatgaatgagcttggaagcagattcttctcagaacctccagataagaaccaagcctggctggcaccttgatttcagccttatgagaccctaagaagagaacccaggtgagcccactgagacttctgacctccacacctgtgagatcataaacaggtattgttttaaggtaaatttgtggtaaactgctacacagtaacagaaaatgaattccatatatcatcctacaatttgttttaattcaatagtaagtcttaggaatctatgtgaattaattcattcctttgaactgttccatagtattccatagtatgtggtaaaccattttcaaggatggctgccaagaactgcccccatcactgtgcaaaccagctccttctcttgttattttcctgctcttagaatttgggtcaggctcgtgactggttttcatcaacaaaatctagtggaggtgacattcaagaacttctgaactcaagtctttacagaccttgaggcttctgcttttgcccttttgagattgaagaagcatgaataaaagctcaaactaacctactgaatgatgagaccccgcatggcaggggtgcagcccccagccaagcttcagataatctcaggagactctatgtagaggagaggaaccactcagctaagccgggcaacccagacaactgtgagaaaaactaaatcattgttgtctaagtcactgcattttgagatggttagtataactctctatgtgctcaatagagacataatagcacatacatcatgagtagataaattacgactatcccaattcatccattctcctattgataaacagtgttgtgttttccagtcattaaactggaccatacgaaattgccatttctataagtgaaaactggtctaatatcagcaatcttacaaacaaaccactgtgagtacttctccccatgcctctttgtacacacggtggacacatggcctcagggtgagaactaggcagaagaataggcatccacaaggttggcacatttaaaattttaccagatgctactaaattacccacagactgattcctatcagtgtataatacggtgttatatcccttgatctatacatctctagaaactccattataataaaaatggttatccaggcctcaaaatgcagcaaacctaatacgaaccaatctaaacctaaagcagtgttggcaaacctgatataaaatttctgataattaggccaggcacaatggctcacacatgtaatcccagcactttgggaggccaaggcaggtggaacacttgagaccaggagttcgagaccagcctaaccaacatggcaaaaccccatctctagtaaaaatacaagaattagacagatgtggtggtgcgcctgtgtcccagctacttgggaggctgagggaagagcattgcttgaacccaggaggtggaggttgcagtgagccaagattgtggccctggactccagcctggttgacagagtgagactctgtctcaaaaataaataaataaataaataaataaataaataaataaataagcaaataaaataaaatacagtacaattcttgataacccaaacaacatttttatttgacctttaaatattctgtggcaggtaattattttaggaaagatagatatggcttcctatttgtggaacagttaaatttatattaagttgagtttatcttccatgagtaggcctcccctaggtggtggaagtaaaactgaaatagggtatacagtgggagagttttagcagcctagaagttcatacaagttcaaaggtactagtcgctaatgaatgaagacacttcactccgcagataatagtgttatctatccaggtgccaatattgtgataacttggaggctgaacagtacaataatatttagaacatgcttattaaggggtgacttaataaacttttatcttaagcagagactctctatacaatacttatgtgaggtctattgtacttatgtccctaatgtaagttcttttcttcctctgcagtaatacaaatctagctgggcacctgaccacattgcccacgacatttggagcgaggcatagccatgcctagctaagtttgaactgacggaacaaggtgtgatgtgtcacaacttctagattttagcatgtgacacccttgacccttcacaatggcagggaggcaaggaggcatggagcagctgccttggactccgagatgatggctatgcacagagggtggcagtgtcaccccataagccctagtcatctacttctggatgctaaagtgagagacaaataaacctctctttttcaaatctctatagtttggagttttgtcattatggaagctttacaggtatcctgagttggatttcagggtttctagaaattcacacaaccaaccagcatcatctccatctctttacagattcctgaagttatgccatcgcaatttagtttctttggcttgtgatttccagcctctgatgaaatgcaagtatctcaagaaagagtaaaactgtaagctcctaagacattaactccttaatgttttcttgatcgtcagaacctttactcgggattcaataagaaagaaaggaaaatgcaagttccttgagtatttggtggatggctccaacagtaggggaacagcctcttaaaactaaaggaggctaaagacacaaagaatacggcaataatcaacacctgattcacagtgtggccacatgtgtctgatcccacagagactgcaaaatatgaacccaccttgccctagctgactgggagaatgctacgacatagagaggaaagaacatatgctgtggctagcttcatttatctggggacttgtcctcagagcttgtgttgtttgggattcctgatgagtaatacgtgcattttctacatctgggtgagtcctgttacccaggaaggctgctgacactaccttgacccagtgaaaaagctccatgatggcaggcacctgaaaagtcactggcttttggcaatctttctattatatgatctcctcaaaagttgcatatgtttagaaaacacatcaatttgttttcctcaaagcaaatatgcagaaataaaattttaagaaaggcacaaaagtaaatgagagctattccaaagatgaaaccgaaagtgccttctgaaataccagcataaatacctaaagtaagaaaatttccaacgtaatgtgtttttaatcagacacatcaatctaaagtttctgcaacatctgcaaacttgaatgctattgttaatgtgaccaacgccttaaaataattgcattagggtttttggcatcactttataataagtggacagttaattgttgctaaattacagctgaatctctgcagaattggatattacatccatattaggatcgaatgactccatcatgattaatgatactgcagtgagtaccaagagaattaaaattattaggcactaattttaaagtgttgacatttttccacaattttagagttatgtttcaacaaaacttcccaattaaacttactgctcgtggttactgggtaaaattccgagacaaatattccttcaaagatcaactttattagtgagtaaacattaaaattaaaaaaacattttgttgaactatccaccttatgtaactaatagcagatgatgtgttttacactctagttatatttaaataatacagccatgtaattaaagatagttggccataattaaaatattcataacaatttcctttcaaaacattatgtgcaattcagactgcatatttgtagtaagctagaaaaaagaaacacattattagttttagagaagtacatgcttaattatcaagggagtttctgcagattttaaagaaattaccaagagcacaagcataaattggtgtttaattgtttctggaagatgcttaggttataaaatatttcaaaatatttcctaggagacaacttggtaacaattcatcagacacagacttggcagtgtcacagaaaagtaatcatgtacctaaaaatgggcattaaacagacattcatggaaaatgacttatcttttacccactgttttagtattactgaatattagtttctaagtaccgtattgggcaagttactgtggttctttgaactagctattctaagtcccaagagtaattttgcaaatgaatgaaaaatgtaaataatttaagacagtaagaatatatagaaaaaaaagctctgagctcataatactaaaacagtaacaagttcaaattttgtattcatctctgatttacccagtggtctccacggaatttgttttctgcacctgaatttgattattttttttccagggtagtttcccaggtcaaaataatgtaaggaagataaatgagataatactgagaaaacattttaactattcaaaataaagctaatttatttcctcctgtgtttatcactgtgcttcaaaaccctgtcctgatattctcagaaactcaggtataaaatgaagagatatttaagtacatattggggtcactgccactaactagctgttgatctctgctaaatttgccccatgtagcttctaaaaacacaggtgatttctcaaacatctttgtttttgtggcccctaaaatgcctaccaaatgatcagatagatagtactatattctcaaaaaaacccttttcaggcttccagaattctggtagtcttcatcccacactcccctattgaaaaatcacaacttttttccttaaccatccctttttattgttaccccatcctcttttcttatttaattcactagaataggggttggccaagtatggcctgcaagccaaatatatactgctgtctgcttttgcacataaagttaagctgaaatgcagctcttcttttacctattgtctatggctacttttgcgctacaaagtcagaatgtctgtgacaatgatctacggcccactagcttagaccactcacactggctttttacaggagtctgtggacgctggtattgaatatgcgttctcagtgtttctgtgctgaggatctcctcctacctctctaaagtgcagttgaaaatgtctaagacaaaagttaacagggtagatgaggaattactctttgtgaaccatggggatacgtcaataacttccttcaaataatctacaagcatttcaagtacaccgaatctcccaaaagggagtccgtagaaaaggtaagctatggtcaaccacttgatctgacagctggagtggatcccactttaattaatcatgttagctactgattattaatcacctgataattatattttatccatcctattactctaagttcttttgctactctgcatcaaatattttatgtacattattttacttggtccaagcaataatcatatgtagttgggccattttacagataatgaaacagaaatttagaaggactttgttcaaggatggacaactagcaaaaagcagaactgggactgagccccggactccagagtccagacgtggtagggtaatgtcacctaggtcttttccattgcctctcaccacactatgggcactcaaatcaaaaaagtaaaaattgggttgtagcaacagcgtaagaaatcctttttggttataacaaacttggaagaagtatctcatttaaactccatataaattacattctcaaatgtaatttatcttttgatcaaattaggagtaatacttttcatttaagcagtttaaatgcactctcttctgtggcttggaaaaaaaaaacttttgtctcaaaatatttccttacaatggttttcccagtacagatgtgagattatagttacctttttaaaatattttgttgacgtttgtattcttaaaatatttttactatatgcagaagctctttagtttaattagatcccatttgtcaattttggcttttgttgccattgcttttggtgttttggacatgaagtccttgcccacacctatgtcctgaatggtaatgcctaggttttcttctagggtttttatggttttaggtctaacgtttaaacctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgcgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggaatgttataaagaaacagtgatttacaaacataaaatcattattttcaattcaattcaaaaaatacaaaaaacaaattctgaggcaggtagaaaggcaggctcttgatatcaaagtaagtttctggatgtaattgaaagactgttccaccaagtgttcacattcagatagtggtgtatgttgagctaagtgggaaaggctgttaagaagtaaacatgtctgacagggtgcgcaattgcagaatgtgatgaacctgactccgtcatgtagcatgcaaatcagtcactaacatcctcgacaatacataagccaggctcagcagagcactcccagattgtgaaaatttgggagaaaaaaggagtctctggggaaaaaaaataaaagactggaaaagtgattttcaaaactgtgtaaaaactaagcacataatgcaatgattataggagaaagcatgaggtcactaagaatgaattgtaatacactgattttttctttttttctttgttttttttgtttgtttgcttggtttttgaaacggagtctccctctgtcacccaggctggagtgcagtggcacgatctcggctctctgcaacctctgcctcccgggttcaagtgattctcctgcctcagcctcccgagtagccgggactataggcacgtgccaccaagcctggctaatttttttgtatttttagtagagacggggtttcaccatgttagccaggatggtctcgatctcctgacctcgtgatccacctgactcagcctccccaagtgctgggattacaggcatgagccatcacgcctggcctttctttctttcaatacactctttagcccaaggaaatgacataggtcaaagcatcagggaaggaaaaagggaagaaaaaaaccgttttgttaattagcttcctgaaaatattttgtaaactgctatttgtccaagatcattccgctctctcttaaggatctttattccaaagtccaggtgctttgctacatctccctccactactttatttacatctctgttacctccatgatcatgcctttggctctggcattgctaactggatcattcttaactgacaggttagacaagcatgtaaacacacacacacacacacacacacacacacacacacacacacacactgtacataaacacaatggctgcatgggttctgtacactaacaataacaaggctctgaagtggtatgagttcaagactgagctcccagagagctggattcaagtcccgtgaatgcaagaggagactttcgaaatgccaccttccctctttgagcctcaacctccccatctgaaaaatgatgagtttgaatccaaggatattcctttcagctgtaatattttatcacctagcatatcttctacttcactctatttctagagtgctaaaaactcatttcttttcatttttcccagtgagaaagatggatagctttcccttagcaatctcattacatatttttacatatttgttggttattatgttttccttccatcacttttctacatgaatgaatggtataagttatcttcatcttcaaaagttctactattctatgtttgactatttttctttacagttactttttgaatactatttcctaaaagctgtgtagggcagtggttaagaatgaaggctctgaacatagactgcctgggattgaagccacttgctcaaggtaaaatttcagacaggttatcaatatggttaaatattcttatttttgaaatgaatattataattgtgccaaactctccaacccctgagaattaaaagagagaaagcattttgagtgcacactggatgctgggcccataactggcattatttatatggaagctgttggctgggcttgattgcttatacctgtaaccttagcactttgggaggccacagtgagagaaccacttgaggccaggagatccaaaccagcctggtgaagacagcaagaccctgtctctacaaagttaaaaaattgactgggcgtggtactccagctacttgggaggctgaggtagggggatctcgcttgagcccaggagttcgaggctgcggtgaactatgattacactgctgcactccagccttggcatcagagagaggtgctgtctcagtcagtcaatcaatcaatgaaagctgttattattttgggtggtgatgctggttttggctcttcctcatccccacaaagtccgagagaactagtgctttaaatgtaatttaaccaaatgagcactaaaaaggcaaatgagaaataactctatcttcttaggtaatcatggtaccttcttttcaacaataaactgaggtgacttttttttttatcatgtcctacactcttatcttcaactcactgtgcccttaaagagtctttccatatttctggcccagagctgcccctcccaagtggggagaaggttcttaccttcttgacctgaaacaaaatcattacagaatggggaaaactatagatctaaaaaaaaaaagtataaggagtgatttcttaccaaataacagagaaatcagccagctccagcagcaccccaagttggacacagagcacagcgtcaaagagatgtggctacaaatcaaccagaactgctacctgctgaacacctaatttttgccaaatgtttaattgtacatcctggactatgtcctccatcagtgaacagaaaaccggagatgttattggtgagaccagaatttcactgtttgataaaggaactcagtttctacatttggagttggttacctcatcctgagcaaccaaattccttaatgaagccagtctgaagtgtggacttcagaatcttgactgtgcaaactgtacatggaaatgacattggcatcagtagtctgcaaaaggcagcagtgtgaattgccatgtttttcatttatatctcatgttttctttttcttccttaattcccttcagggcatgagcccatgatccattacattactgttccaacttcccctttgccatggccttttatatgttttacctacttatgcaataacaaaggtatccttattcatccacacatataattcctaaacactcaaagatcatttcactcactctggtgctccttcagctgtttcctttaggacttttaagtgaatttcactggacctcaatgatttcgacacattcaattattgaagtgtgccttaacctgcttcttccagatgtgaactcactcacttgttcattaactgttactgtattaccatccttttgctattaaccttccttgtgaaggctgaagcaaaggagctattaaggattttacagccttcctgccatgcgcctgctcacactctctcccgctaataagtagcaggcctcctcctttggggtaattctcttctgtcttgacaacatatgcaactactctgtttcacctcattttctaggaaatgcatccttttgtatcttttacttcatgcctttagtccttcatatttttattgtatctttagacaaacttcttatcaattacacctaaaatatacttatttcctcattaaaaattgttcatgaaaaaatgtatcctcataggagttattctttgtttttaacattcaaccactgaacacagatgcttagaattatttcatccttgatttgctaagggacattacttttttgtttacttgatggtttagaaagacaataaatacatggacataactactgtctttctcctctggttttagtttgggaaattctaattgttctcatctataagagaataaaatactaatttgcactcaaatctatccaattgactttctcactctacatgggagaatttcctctctctactcttttgaactctttatttccttccctctattcccttgcctctcaaaactggccttcgtctgtttttgccattttacttgcattggtaggttctccattcaaacaacccagccagacacagcccatccactgggcattccaccacactaaacagtgggatgacagaatctaagaggaccagctggtttcaatgattgaattcagtgagtgccgagtggtgttcaacatatgccctgataggcaaggagcaaatgggcagagggtctgaaggaagcatttaaatagcatctcttaaaaaaatgttgctgttgctcagtttaaactatctgcttatatattctgggattaagagtttttagtgattttttctccctcttcctaacatgtttatattgcgctttcacaggcatagaaataaaacataaagcctactcactgaagccaaaatattaccatatgtgctcttctcaccgacccatcctccttctacctaaacccgtccctcctttggaagctctcttctccttttattaaaaaaggaaaacttctgggaggtcgaggtgggtggatcatgaggtcaggagatggagaccatcctggctaaaatggtgaaaccccatctctactaaaaatacaaaaaattagccaggagtggtggcaggcgcctgtagtcccagctactcgggaggctgaggaaggacaatggtgtgaatgcaggaggtggagcttgcagtgagccgagatgccaccattgcactccagcctgggcaacagagccagactccgtctcaaaaaaaaaaaaaaaaaaaggaaaactacaggaagctgattgtattagagaagaagagcattaagtgtgggctatgccaggggatacgttttagtgggaatggagaaaggatcatcctactacaccctttagtaggcaacaggaccagaagcacctgctcagtgggcaattatttggggtgtatttataaggcatcagcccaaatgctagttcttccactctccagaggagagataaatgcttctcattcatgcagatcccgagtaaaggtcaccctgtttctgaaaacatgtgaagagtgatatttgagttaagtcatttctaagtaatgactttcttcttcttcttgaatgctattgggaagtggtgaggcagaacttgtgtgactgtaaaaacagcagtttttaaaaatatggttagactagactattggaagagggaacagagttgtggaaacagctgctttggaagtttgaaaaattttattgactcataaaatgttatagcgagaagtttattttagaaatgaggaaaccaagaccctaaagcattagagaaattattcaaggtcattaagctccttatttatcaggcagaatcagaatcaaaagtgaatggctggcaaaaaccaatcttgtgggttttccaatgtatgacaacgtctcccttcttttctaacgtgaatcttttccataacttatccttacatgggagcaatttttagcctgctccactgatgcctgcctctaaaatagtgtagagttgtaaaaaaaagtcatttttacatcatcaaaacttctgaaacactgagtcagaagggatcatctaaacgctcttctgcctgcaggtgaagctggagcaaactcttcacactagaccctgcaaagtccctcagggtagaagggaccacggccagcgcccactacctccttgtcatcatctaatcttcataacctaaaaagccaccaatgggctccaacagggtctgtgggtcatgactgtggctgcatgtcgagtcatggtctctgcactcacaaattttgttttgcataaaagctgtattactgtaaagttgtaagacttagtaaaattcacattttggacattttaattcgagctcaaaagcagcagagatccctatttaaaggagacttgcaataaaactacacaaaatgtaaatacatgtgttaatttaacgttagtaaatccatatgttcttttgctgaattatcatatttagaactttgtaaaatagcagtccatctgcatggagtgaagaaaatgcccttgaataacctgatcagccatgctagccagcccatgacaagcacctccaggcagacacttactgagagccactatgaggcgggtgctgtgccatgttccctagatacagatataaatatatagtgccttggacttgggaagctcaaatctggtaggggaaaatagacttttaaaaaataagttagggcgtcatctaaatggttttgttgggaatcatttcaccatcgtcttatttctgcccatcatgaaggcatattcctctaaggtaggaaataacctttaaacattatctagtccatctcactgaccctaggcaataataagatttaaccactcttgtcatttgaaaaactgagcctcttccaatagtctctaatatttaaccatctttactgttaagatatagttgtattacttacagcctaaatccctcatgctatttttcaagttcccttcccttctcttattgactctttggagatgatgataagcatttaataactctgctaatttaacttgaagatcatcttagtttgctgttttctgtgatccagagttctgatttataattaactaggcagtgtgcataattctcttctgtgtctgccctaatcagagaagcctgaatattgtgcacagcaggcattcagaaatacctgtcaagacaacaggcattccagataaggacggataagcactgaataagagagaaatgctagaggacagtatccccgatgcacataccagcatcccaggatagcacctctctttttaataacagtcttccacggagtcccttgagagactaagaaccatgctcctacatctccttaactctttcccttcatcaaacgcagtcactcgcacactacaagtcttcaatcaagttgaatgaataaatgaatgaatgaaaacagaatttcaactttcactattataatgaaccctgttagcctttccttacataaaaattcatttaacattcaagggacattatgtccttgccaatacttttaaaaaccttaactacagtcaccatgctatataatggctctccagaacgtattcatccttcatgagtgaaacttcgtaccctttgacaaacagctctccctttctctcactctccaatccctggcaaccaccattctactctgtgcttctatgagttcaactatttaagacataaaagtaaggttatacagtatatgtctttctgtgtctggattatttcacttagcatagagtcctctagcctcatccatgttgtcacaagtgggaggatttccttcttttttaatgataatattccattgtgtctgtgtgtatacacatattttctctacccattcttacactgttggaaatttaggttgtttccatatcacagttattgtgaataaagggcctataatatttatatgctctatactctttctccttcttccacatcttgttaaggactaaccattccctctcgggctaatttgtaaaagaagcaattccaccaagcccttcttaaaattatataaaaacttcccagcctgtacgatgaggcctcaaattatacaacaatataagcttcctgagcatcttgggataaacgtgctttatagaattaagataccacttacttgattgtaatatatcttagggctacatagtcaaacctttgaactcacatcaggtgatgcgtgctgcagaatatagaaacaagattctacaaagcagtctggaaataacatgtactactgaaaaacaaaaatactgtaaattagtataataaatcaaggaatcagcaactctctaccactaactaaatcagtaatgctttcttcaagagagttatgagaattatatttcccatgtggcttgcaaatgtaaagagatctattaagactgtctgatagttactgccgaaggatatataggaagtagaatactaggaagtattatattcatgacattgctctattttatttataatttttataagagcttaaaaatctaggtttcatttaagcattacttgtgtgatacaaaaaatatagtaatttagagtttgatattttttgaaaggctttttcaaataaaccattcttttgaattcaaatgattaagaggattaaaagtatcaagaatttatttcattaggcatttcccaatgggatcaagtttttctgaaaaaaaaaaaacttacgtaaaaccaagtattaaaacatttccactcaaatacattagggaaagtcccaaaatgaagcacagaaaaaataatggcaacataaattcaattattgtaccaagtaatcgcagaaacatgcagaaacatgggcattcaagtaaataaattattctgattttgctcctagctgacacaaattactcatttccttggacttgatacaagaaggcttcagagaaaaagaagaaatgcaatcaaagagcaaagcacattactcatcatctgccagccttgcagcaacagaggtttcctacagtccctccctgccacagccttgcaggatatgtctataagccagtctaatacatgcttaaatgttctcatttacagactcgatttccttttgcgggttcctgcaaaagttctcaatggtggtattgcaacttgcatccaatagcaaagtgcctgtagttatttgttactaataaagtcctgaagttttcaaatgacttgctttaaagaactgatcctggattatttctaaaatcagcaagggcaataaagtatttacaactagtagggcctggcatcaactaatcagaaaggacactggcctgagaagatgctgctgtctcaggtactagatggtggcgaggttcacggtatcacagaaggaatttgttagtgcaggggacactggggaggagggagagtcaggacattctaagctttcatcaaccaggagggaagtatttcggcattttaaaaacctagtgcatctgtctgttagggcgagaaaaagcagaatatcattccagataaattattttagcttcactcacatgcatcctggtgtgctttcttgagtggaagaaagtagatgaagtaacatgctggaaatcacacataacctatggctttcctcatttgtgaacccaaggaagcgtgccacatatagaaatacaaagtcagagttacaactttgcccccgtattctcacacgctgtgttagttaaggctgccataacaaaataccacagactggggggcttcaacaacacaagtttattttttcacagttctagaggctggatgcccaagagcaaggtgccgtcgttgctgggatctggggaagcctctcttcccggcttacagatggtaaatttctccctgggtcctcacatggcctctcatctgcatggccacagagaaatagtgttctggtgtctctacctcttgttacaaaggcaccatcagtcttatccgattaaggtcccatctataggtcctcctttaaccttaattacctccctaaagggtgcatctccaaatacagtcacatcaggggttaggggtcgaaaattcgaattttggaggtacacaattccatccataacacacaccacgtaagaggaaagagagaagccttctcccacacattttctgctttgaccaatttaagtgaaggtgaatttgtgattattactgtagacaaagaaccctctaaaagcagattgttgctgtagacctgccatatacccatctcaaaaaggacctcaccaaaccccaggccaccttggctaaaaccacacctaattactataactgtgcatctcaatgatcagccaacaagcactactgactaccaactatattcccagaaccaatggagagatacaagaagattcacatcatttggggtgaatgagagtatgcctgtgaattaccagtgaacaagatcaactcatttacatgtaatcagtggggatcagagccttcctgatggtcatgtagaatgtgcacaggtagaacctcactctacaaacacacccatgaccatcacctctctcatagccctctgccatgattctcatggcaacaagaacattctctgtcatagcggcataaccctaagcagactgggcccgggtaccttttggtgtaggcaacatccagatagctgtttctttctcactgtaatcatttccaatttcattcaagagcctcattcacactgggctgtgatgaacatttggctaacagattgcttaagtgaaaaacacaagagagtgaccacagagtaaaagataaattagtggaaaaaaatcacttgaaactttcactctaggaagaaagggacatagcacaggatgagtaatagaatctcccccagcccacagccactgccaatagatactaagattccaggtaaattaaaagaatacatgagaggtcactgaaacagaaatccagctgggagacagaaatgcaaaattctctgtagaagaaaatgggtagaccaagggcagtgcaacatatagaaaaaacatgaaactttacaattggaaaaatacacatcagaagttcttactggtcttatgaccttagccctctgagtcacagtttattcatctttaaaataggtatgctaggtatggcgtggtggctcacacctgtaatcccagcactttgggaggctgaggcaggtggatcacgaggtcaggagatcgagaccatcctggctaacacggtgaaaccccgtctctactaaaaatacgaaaaattagccgggtacggcagcatgtgcctgtagtcctggctactcgggaggctgaggcggaagaatagcgtgaacccgggaggcggagcttgcagtgagccaagatcgcaccactgcactccagcctgggcaacagagtaagactccgtcttaaaaaaaaaaaaagtatgctgttcactggttaactacaaggactacatgacaatacagaggcctgcaatcacacacaccctccaatgtctctggaacataacaaaaaccactataaatatctgttaacagtataattaggagctacacttccaatgttaacttgcagctgaaaccatcaactatcattcacaagaatggcaatgccatctgcagtaagactcagaagtattggaaacccttccaagcctttatgtagacagatgaggagcagccatttggtttaatatacaattattgtcagaactaccctataatttgcctcctacaaatatccaaatgccactaaatggggcacaaggtcaccgtggtggagcagactgtctcatagctgactgttttatttctattagagatgacccagggccagatgtgtgcatggaatcttctgctggccttacacttttagcaaatggatacgatgaaacgtgtccccagataacaggccatagggcagccagggcagttctccttgctgaattctgcttccagctgctccatgggatgaaactttgtgttctagggaagttttctgtcaacttgtcaaaacagtcgctccggccactcacacttacatttatgttatagggcccaagtgtttggacagtgaccctaccttgggtggtgctcagaatcctctcttcccctaaggatagtttacacaattggagtttttttttttttttcttgaatatgtttcaagctggtgttaattctacaaaacagatgggcagctaaatcttttgaagttgctaaatatattttgagagcatataatttttatacaactaacgttcagtttatatttctatcagctaaactgttattaatatttgcaaaagccaaatgtcaaaagcatttaaaaatgtcaaaccatgtgaacacgattagggaagggtttcttgtaagaattggaaaatttcacctaacggtattgtctctcttatacccaggcacaaaatgccaagctccaggtcctgagcttcagggggcttcactccgagcctcctctagccatccccttccaccaggtgtgggtttccctgcatcatggggttatgcccatgcagagtctgtgcctcccctctgcctcatgatgttcagggtatgctgaaccaggaatttgtttccaaatgggcccaagcctgcttccaggacctgctgggtatgtgtgcgcacccaagatccaaaaagtagccaaatgctggcagcaggcatgggatgtggacagagtatagacatgacagctagggtgtacacacatgtgcaccccaggcccttagtggtaatgggaacatggagctgggggtgagagaagaaagggagccaaccaaaccactgggctgcaagctgggtgttaggaattggctgcccctgtaccaaatgggccaaaatggaactccaaggactatgagaatgccatgcttgattcggccttccaggtcatgatgaagatacattcatcaaggagaacacattttacatggcattttattttgctgacttggtttataacttgtatatatttagacccgtagaatgtgggctgccatttatatactcttgttctaggccttgtaaatattaggagtaggactgcatcagagttaggtttagaaaattatagacttgcaaataagagtaattgtattaagttctgttaatttcttcagcaaaactaagattgcaactaataatctataagaaagcagcatgtcttggaggtattctcttcttttattttcataaaacattacaaacatctgcaaaagtaaaggttccagtataagaaatgctcacatgcttgattataaccaactcaaagccaattgagtttcaacattaactcctgatcctccctccaaattatttaaattacatcacacaagcatatcttttcagccatatttatgtcagtatggataggtatgtcttttaaatatgtcttttaaaaaacatagccatatgttatcacacctaaaaacatgaactatatcaaatattcagggagtagacaaatattccaaccatatcttcagattgtctcatttgttttcttttttgcagtattttcaaatcaggatccaaatagggttcacccaatgtctcacgacactattcttgatctataggttttctccccacctcttttttccttccttgtactttatttgttgaaaaaaacaggtcatttgttccgtagaatttcccatagtttggattttgcagaacctagtcttatagtgtttcctataagttgttcattgtatctacaggcttgatgagattcaaggttcatttttttggcaaagttgcttcatagatagttttgggtatttccatcaagagacacaagatgtataaatgtctctctctggtatgttagcactatttctgatgcactatttcattaaaaattgcaaaatagcttctaattatattcttctttctccatttattagctaaaatttcttacaaagggaaacttctctccactgaggatgatttagttacaggtcttaaagacagaatgcttctttctcattgcttatcaattttgaaaataaaaagttggtttcctagaatcccctaaaggttttcctggggttgttttgtattattataagtgaaaggatttaaacaaaagctgacatgctttaatacactgcagttagtattcttattgatgtatgaattgagctgtttttgattggtggaagacttttcaaattggatcctggacattttaacaacagcctcagactgctatgacaaaaacaatactacctctaaaaatatgaccactaaaagcaacgatattttgtggatttctttttgtcatgaatatggatcccactacaagtgtacaagcatctgttttcaagtcacttcaaatgattgttcactctgtagatttgccatcaatcacaattgcagttagatttactggttttgctttcaatctgggggaattttaaaattagatgttatgttacaattttattaaacatgtaagtatttataaagtcaaatcctcaaaacaaggtttattaagagaaatttagcttctattcttttcccatcccatcttctctctttctatttaaagttaacaacttcttaagacttacatcattcttccaaatacatctctttctgtatgtttgtttacatgtgtgtggacatacacacatgtacaaattccatttatctggaggtaaattgaagtatatatgtgtgtgtgtatatatatatatatatatatatatatatatatatatatatagtgttcacacacacacacacacacacgcccttctcaacctggtatggagattggtgatttgctttttccggtgattgattattttgttttacatgaaaacaagattgaaatattgaaaatgaggaactctagataaatattttttgtaaagtagtgctatggaaatgatgttgaactctctaagtcaccatatttaaatctaccattcacttcaaatttaactgaagatcaatttctccaattgttaagggttcattaatcaagtaattctggaaaagggcatattgatatttgaacttaattattacgaagttttataagttttagaatgaacttgaaaatgtatgtctaacttttttgtaacttacgcaaaataagaaaaatttgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaaaaatttgtcagtcatgcagaacatacctcaagcaattaataaatacactgatatattctcaaagacactggaagaaaaaactttagtaaaacggtatatatctaaaactatatacttgctccaaacataaatattgcactgatgcaaacactaaatttttgagaagcttaacatatattaatttttgtagtgtacaacaggaagagaacccttaagggacagacagacctgacttaaatcctgattcagccattagtggctgtgtggcctttgcaaattgcttaacctttctgggctttattttctttatttatcaaatatggatgctaatagttcctcactggtctataatcaataagattatttgtttaaagcatgtagaaacacaactggtacaaggccagtgctcaataatattagctcacttgttcttttgtagacaacatacatagaagacagtatgaataatggttaagacctagggtatctgagttcatacaacagctacaatacatccaagcagtatgaagatgggcaagttatttaactcatgggagcctcagtttcctcatctgtaaaggagagaggctaagaatatcttccgtagaggactgttttaagaattaaattacatgtaatattatagttcgtctaaaaggaagggatgcttatttgtttcatttcactgttataacactggtacctaaaatagtgctggcacttggtaattctccttaagtgttaataaaaaataaatgagataactgttcgaatctcacgtatttcatgttactttcaagttgctgcttttcacatctaagagttctttcctcatgctctgagacttagtccttcgcctctccggattttattaaatgatggatgttctcactgtcagtgtaatctccaaggtcctggcctttcctgaactggggtttgggtgcactgagacggtaactacagccttactaccccactactcaattctttactcaagagaggctgcttagaaagtctgggtctgcagaatctcatagtgattccaatctattagatctgtaggatatttccggataacatatcatgtgctttggtgattgtttctgaaaaggcaatagacttgtaagtgttctatgtgtcatgcatattggaagtacactaaatatattactacttcactggggactctcttgacaataatgtgaattgctgagggaacagaaatcaatttttaaagtgtttctgacatcaaaggtgaccgctgggcttcaggaaaagagttcaaagtaagattgacttcgtgattgagatattcataagactcacactgcaaaggtaggttgggcattcttccactgcccaagatgcaagcgaatgatgcaggcagattccaagctgagtttgctgagataagggcctccaaggaactgagttccggcaacatgcattgtgagtacccataccatcaggtctgtctttgtattctgttctctgaacctaaaatgccccttcttcagttctctattaaaccctcttcacctgcacatgcttcaatactcatctcaaatgaatccatttctggctggcagagtttttcatctatcatttttttctccctgtcttatagcaaatattggatcctaaccttagttattttcacatgtaactcttttttttaccctacgatccttggcaacaggggatatggcttacttatttctgtgtctccacaccttgcttagcatagagccaaaccaattttttttttaattatcatacttcaggtttagtagtatctgcaaaaaaaaagtattctttatacagtattatctaagtggaaattttattttaaaattcaatagaaataatataaattagattttttttaaatctcaatatgatggaccaggttggccaaataccatccacagtgagggttattaaacggtagattcaaacagcagcatggtccatcagaaataatactttattcatttacttcaccatttattgtgcacctactatgtgccaggctaaaatcataagcagcttacattttacaaagggaagatataatatgcagctgcaaaatgccagcaagaaaaaaatataattttgtgataaaagtctgtaatcaagtgagtaaagtagaatattataaaaggcatcagggagatggtgaatttggagctggattttgttagctaaacacatattgtccaagccaacagcaaagggaaaatttgggccatcttagctacattaaatggctacacagtccatgtcataaatgcaattataagttgatggtggtctatgtatttggaaacactgactcaatcttcagcaaaagtggtttgaaaatgaaatgggaaaatacactaagcaagcagagaccataaaagaggcactaatgacataaacattcaaccttccttacaaactttgaaacagaaaaatggtggttgcccagttttttgttgttgtttgtttgtttttgagacggagtttccctctgttgcccaggctggagtgcaatggtgcaatctcagctcactgcaacctctgcctcctgggttcaagtgattcttctcctgcctcggcctcctgagtagctggaattacaggtgactgccactatgccagctaatttttgtagtttttagtagagatggggtttcaccatgttggtcaggctagtctcaaactcctgacctcaggtaatccacttgtttcagcctcccaaagtgctgggattacagacgtgagccaccatgcctggcccagttttccttttaatttgctataattgtatctatcccactggctcaagagtctcttaggtgcaatctcagcagggtgataataattaagttcaagaaattctgtaggtggcagagcatgtcaatctatgagaaaggatgaattctgcatgaaatacaattgcttagatcagtagggtaaatatagtttaaaacaatctattgtatatttcaaaatagctagaagagaataatttgaatgtttctagcaaaagataaatatttaaggtggtagaaatcccaataccagtaatttcctattttcaaattatacgaatgtattaaaatatcacttgcactccaaaattatgtacatctattatctatcaataaatttaaaaaacctccactttctattacagattataaactacaaaacaaataaatgatggaacagaaagagtgtgtgaccagaagtcagaagccctgggttctgggttggggtccacatagccatgtgatcataagcaagttacctcattttttaagcttcaatataatatttattattattaatatatatgattcgatatcatataataggctctccctatcatatgtaaggttataatgagaaatgaatgaaataacatagggaatgattttggaaatgataaaacataaaagtaaaaagtactgtcatttctgtaaccatggggatatcaatattaattaaaatgcttattataaaacacaactgctaaagcggttacagaaaataaacaaggaaaaagaaacgtatatttctgtcttgagaaaatgcatgctgtcagttgttactcctgcaaatgacaggtgaaaacctttggtcaggagaaatgtgcaaagaattctgaaacacagtttaatgaaaactacaacacatttcttttgtcagaaccccatagcttcagcatagctaattctctgcttcattcttaagaaacattcttaaaagcttgaggctgtttgttagcaacagatgtagacatttataaacaaggaccatcttaacagaattatttctcacgaattaaataaaggatcccaaagaatggttccaactgtttacagttagcacttagacttatactatgtgggaacagtgttcattaaatgcactgcctatggaccataaaggtaatcagaacaacaatctatactactgggactgctgcctctgcctctgccccatatgcaaaccttagagagattggtataaatgttatctgagagccataaaacactctcagaaagtaaactttagcttatgggaagtaaaccttcagttcaccaaattccatttagtgccctgcagaaagaattctgcaaagagtattctgaaagaggcaactcatcttttataggtgagcactccatcacagaagcccagagatgagaaatcaggtcttcatcctcccaggccatcacagtttataactctaagaatgatgactattatcaaaactttaaagatccccagaaatggccattctacaacctcccttggaagcaaatttctgtcataaacacactatctgtaaaattcttctatatgcttaacctaagtctagcagaattctggctgcatctttctactttagtgaagatattcattcattcattcttcaatcaacaaatttttttttaatgcttatgatggcaaaggttattggtgattgtataagagaggaacaggggaacaaacaatgtcccctggataggcagcgacctttaactctttatttagatcactattaggagcaatgtatgaaaataactgccaatttgtagaaaataccgatgccagaaaaacatggtgcccagtcccaagtacggtaatcaacaaaacttagactgtaggaaactctacaggtccaatattataggtctttaacgcataaaatatgaaggaaaaggaagggatggacagtaacctgtaggttcaaagaaacttaaaagacatatccagttgtttttttaacagatgcacaagactaaactgaagggtctgggaatgcacattaaatgatgacactattaaaaacacaggagggttattgccataaggtcacactaatagcttattggaaaaagataaaggttgaggctgagaagaggtacccagatgggattctgggtggccggcagagtctcctttcttgacctagcgttggttacaaagccattcaccttagaattattccttaagccagacatttatttattttgtgtggcttcctttgtctatgttttgtttttgaagaagcatgtatggatatgaagcaactagagctcctatacattgctacattgctagtagaaatgcaaaaaggcacagataatttggaaaacagtttggcagttccttatggaattaaacaaatgcttactatatggctctgtggtcccaccctagttatcttcccaaaaggtaaacactctaagacctggacatgaatgttgatagcagctttaatcacattcactcaaaacgggagggaatccaaatgtctatcaacaggtgaatgaataaacaaatagtagtatatctacataacagaatactattcacgaataagaaaatgaactactgatttttgcaaaaacatggacacatcaaaaaagaatcacacaaagtcaaagaagccagaccaaaaagttccatactttatgacttcgtcatttataagcctttctggaaaaggcaaaactataaggagagaaataagactagtagttaccaggggcttgggagggaaatgagaacaaagagggagggagagaactggtccaggacatgaaaatattctgtattttaattgtggtggtagttacatgagggtcaatgattgtccaaacttatctaaactataaacgtaagaaaagtggattttctataaaccacaccaaaaaataaaacatttattattgaaagtagaaatcaattcagttttcagttttaaaacattattctgtatctcacacattttcttaaaggaaaaaatgtgttggagtaggaacagtaatgtatcagaagttataatatgttattaaaacatatttagaggagagactaaatcattggtatttttattgatggctctttcttcagagaaattgttaaaaagtgaaaacaattctggttgtcataaagttatctctgtttagactttttaccaaaccagttcaaataaatcctaaagtggacaacatcagagccaagagcaatcttggttatatgttcacagcagagtatcttaacttccttttgccagccaagttccccagtatttaattttggctgttcccaacagaaatttttcatctaggctcggcagttttctaatctcaacttctccagagtcaagtaaccaaaatagacatggccaaaacccagtcccacagagcctccctgtgattacagcatggacaataagacagtctcctccaagacctcaacataaaactcattgttagaatcttcaagaaggcctggttacaaatgtgaaattattacttcacccaataagtaagtacatttcatttctaatgcagggccttttaaaaagcataaaaagcattataaaactataatgcaattgaatttactcatgttacagatgagcaaattgagacccaaaagggtcaaattacttaaccagagttattaagctacttagaggtacactgacaccaggtcctggacaacccattaaataagatagtgctctttgcaatgaaattggaactatactctgtgttaatactgttttctctacagggatgaataataggcaacatgactttcacgttgtctactcaaaaacatatacctctttaaaaaaatttaagaagaaacatgtgaccatttcatcatttattaggcagaaagagaaatacaaaacaataaagtaatgttcagctttcagtaagttagtatttgcccaaggagccgaaaacagcctttctttccagtttgctacataattggttttggctttcctttgcattgcttaagggagagcttacatgctagatcactaagatacaaacttctgacaccaaaatatgatccatattatgttatccaggcattttaaaagaggtcatttaaaatcttttcttccatctgttgtaatttgaagaaaatttatccttgaaccaatgttgctttaccatcttcaacttctggtagattcacacagagcagcagatgagaggccccaatttttatgaaaagtctcaggcagaaatattgctgatgatgtggaaatagcaattccaaatcaacagaaaattgccctctgtattcatcaggaggagcaaggcactcaggagagccagcctctgagacaggtcaaagttgacgaacagtcagacatgggaacaagtgcagaagaggagaagagctctgtgctgatgcttgtccaaaggtcaattgacagcttttctcatcttgttacattttcctccttctaaagatgcagagaaaatgttcttttaatgtaccagatacagaagcagaagggagtacatgggtagaacatttaagggcatattatcctcttcaacacacacttctatgccaggtgcctacagtttccaaatgggcagcagaaaatgaaccctaggattccataaagtctctgagaaccgataatgtgaacagcaatgaatgaacgagttaagcggtaaaaccatctccatttacgactccttgaagttcagcatgcagcagactgcacttaagcacagcaatcaactgtgataggagaatccccattacagtaagtaaagaaatagcttcaaggctgtggatgacggtgccaggggagaaggtcagaacaggtgcaaagaaatcctgaaggtagggagtgaaagcttgagttccatgtgggtgatttttaactatcctggtcaaatatgggtggcaaaccttaattattcccccttatttagaggtacaatgactggtgtaaacacacaaggaacatttcaaggctgaagaggcctgaaatcaagtatctttattcctgatatttgggttgtaaaatggtttgctaagaatgtttacaaattatgtccgccaggtgctaaatctcccagatcaattttaatttaaatcttcaaacacgctgcagcacagagctgtgacacaataaaatgtgtagtattactgttgtcactatgcaatcattaatttcatctgactattcatgcctcagcataataaaccattaacaagtatgaagtctggctgttctgaatctggacagaagtcctctttatttacagctaagctataaatacggtgttttgttcatatatgtacgtaagacttctctatctaaattctactttttcttgagggcataaacggtgttactaggcacacaataaaagtgtttgtttcctgttgaaaatagcagctttcattactaatctacaaactgggcctggcatggtggttcaccagcacgttgggagactgaggtgtgaagatcacctgagcccaggagtttgagaccagcctgggcaacatggtaaaactccgtctaccacaattacaaaaattagccaggcgtggtgacacgcacctatagtcccagctacttgggaggctgaggtgtgaggatggtttgagcccaggaggtgtaggctgcagcgaggtgaggctgcaccactacactccagcctggggaacctgagccagaccctgtctcaataataataatcatcatcatcatctacaagttgattagattatttccaaagggaccaacagagatacctttgcaaatcctgcatgatatgcacaattatatatatgaaattggtactctgtagagttgcttatctcctcactttatcacctaagtgatcccattactctacctttttttttttttttgtaaatcactgttatttcaactcaacgtaccccaccctaacttggagacaatattcctcaaagtgctcctctaggtgaatctaactgatacacaaacacttcattacctcaacatggataataaatccaggggtccaaacagtgattgtctttacatacaagggaagacagttccatagtctcatctacagcattcaccttggctgtctggacaatcacaattcaaacaagcggttagaggagtggggagagtgggaagaatttggaattttagatagttacaaagctaacccctcataaaatatgcccagccacacagacaatgggttaaacaatcactttcacatctggaaagcacctttgatgtatattgccaaataataagataaagtggcagccctaagatatcaccacctgcctctaactactaccttattgaagtgctctctcaactgtgaaggcttaatttgcaagtacctttctttatccatatttacattaaagaatgtaaatggtctgaaccaagtttgttatgcctgtctgaatcaccctcattgcaggcaatttctgatgtatgagcttatggctgattaggtaacctctggtggcatatccaatttttttttattgcctaaatttggaccatttctgatcattatagcctaatcagaggtcaagagggaagaacagattgtggctgaaggtttggtggtgatataaaaaaaaaactactcattcaagcatttgtatagatttttatcacctcagcgatcccattactcattaatagagacaatcacaaatgttcaggcttgcctggtgccttcaagccatcaggctcatcacacagctgaaactgcataaaattaagccatggaccacctctcctgaatcactcatcctgacacctgaactctacttcccacgtgtacctaactgtcccagcatctaacttcattctccgcttctccctccattgactcaccttgttactgaagctgagactgggaatcccataactactgtttagagactcccatgcctacaaggccatcaaacataccaataaaacacatcacccagcctgggccaggcgtcagcatcttatgcctctgtttcccacattcatagtattagaaaagcacatgtatatatctggagattcccatgaatctgaagtagaatggttgccctgagaactttaagcaccagagtaccggagtagttcctatttcacttgtgatctcttagacatgacccagcattcttattccatatattaggaaattgaaaaactgctcaactttccagatataagtgacatagtgaaagcagcagcccttgcaagaattaatcctaatttgcaccattttgggccacgtctactgtatccttcagtgtcttctataaagtgttctatgtgatacattctattatgaatttattaacagagataatattcctctctttaaggagtagtagcctttggccatgagataataattacatattacttgtttctttttttcttttgatcttgtctgccaggaatcttagagctaaattacatgctcatactcagaaaacttgttgggctatgtgaaggtgataacttgccacattctcctttcatgacctttattttgtttttattttatcagccctattgtaaatctaccttttattgtaagccataccacattctttgagaaagtggttattagcttagtttttaaaagtaacctcagcccatgaacaatgttcaaaagtaatttcacatcccagatatcatcatgcacaaaatgaactcattggcccaagagaaaaaaagaaaaaaattatgaatataaaggtttctaattcaacagaataatttatattatggaaattatttagatgaccatattggatgctaaccccgtccaagggtgatgcaataaaggcttattctataatattgagaatttttcaaagacttaataagattatttaaacataactagaaatatcttaaaaaccaaagtttaaactgtgaaaggccatcagaaatggttcagtaggtctactcaaattattgtgtaattatctgttacatatgcttttcccctccatgtcttttactgatttgcattagttctctggctgtaactggacttgaacttttcagtttcaatgacactttacatgagaaaactaattataataggataaaagtccttcacaaaagaagtatgtaaaaaccaaccactacttattgtacacataattatcttctctttcagcctaggatgtagtcttggctcttgtgtaacttaaatctgtaggggattggcatctgatttacagcagaagacccagcatcatatgaatataatttactatgccatgtgtctcctgccacctaaatctatagcttgaatatagagacatctcaattagacagtgcaaagagagcaagatctgcctcctcctatcctgtgccattaaaacaaccaatattaccaagcagtgcttgttttaaattcactttggaggggtggatctattattttaagttggttaggagacacaaagggagagttgccatcaaactgaatgaaaaatcgagcataaggtgatataagtaatagcctatgaggggtgggacatgcatttattaaagtattgattggtgtatttctatagcacctgtgtattatcatggacttgaggagttgaactggtgttaaattataatgctgacacacaggagtcatccatccttcttgtcctgttcctccatgaactcctacaccaaagttgaagcacatacacagtattggccataatgaggtaaattatctggaggctcaactgtgtttgttctctccctgcaacacatctaaaaattaagctgtcattataaaaacttcataatgacaaagctatattatttatcaccggtcacagtgttctccaaatcctggtgaaaagttaaagacaagacccacacagttttctcatgacgattttagggcaacttctcaaacatggatactgcctgggataatctcaggagagaaaagtgaaacaaattattttcctgattttataaatggtgaagtatagaaatgaatgcagattgtccttcacaaggttcctatatctggtcccaaggctgtaaatgcacagttttctgggggattcctcccatggaattgaagggattttaacataatagtttgaaccatcacctaccctcatattaactataattggaaactgaaagattccaactgctagaattaaatctaggagctactttttcagaatcttcctttcaaattctttgaaagagagattctagtgatctctctctctctctttttttttttgtttttgtaatggaatcttgctttgttgccgaggctggagtgcagtggcgcaatctcggctcactgcaaactccacctcctgggttcaagtgattctcctgcctcagcctcccgagtagctgggaatacaggcacctgccatcatgcccggctaatttttgtgtttttagtagagatgaggctttgccatgttggccaggctggtcttgaactcctgacctcaaatgatccgcccaccttggccttccaaagtcctggaattacaggcgtgaaccactgcgtctggccacattcaagtgttctagtgatatctttttaaggacagaaactcactgattttttttttttttttttttttactactccttagtgtttcctctaagcaatgaggaagagtttattgaatcattagagtcacatactctctctttgtcttaaaataggattgcgatgaccactgaaatctcatccttttggctggccttttttttttttattattatactttaagttttagggtacatgtgcacaatgtgcaggtttgttacatatgtatacatgtgccatgctggtgtgctgcacccattaactcgtcatttagcattaggtatatctcccaatgttatccctccccgctccccccaccccacaacagtccccggagtgtgatgttccccttcctgtgtccatgtgtgctcattgttcaattcccacctatgagtgagaacatgtggtatttggttttttgtccttgtgatagtttgctgagaatgatggtttccagtttcatccatgtccctacaaaggacatgaactcttcattttttatggctgcatagtattcaatggtgtatatgtgccacattttcttaatccagtttatcgttgttggacatttgggttggttccaagtctttgctattgtgaatagtgcctcaataaacatacgtgtgcatgtgtctttatagcagcatgatttataatcctttgggtatacacctagtaatgggatggctgggtcaaatggtatttctagttctagatccctgaggaattttggctggccttttaaaggacaagcctactggctgcaaagccaccacaactcacttgaagacccttaggaaagccatcaggaaagaaaagacaaccagtttcaataaagctcatgtcaggtacaaatggaaagtttcagaaaattggtctgaatgccataggatgcttcagtcagaacagaaggtctaaatggttggtaaattagctcatcaaacacaacagaagcttactcaatggacattcaatccaaggtgttactggtgcagagagagatgcacctcaggaagcaatctgctcagctaagaacaatacctggagaactgctgctgcaagctacgcatctgaattctgttgcgttcagactctagggtcacctcctgcaaccgcttctcgctttgaagacgtaagtgtctctcctcttccagttcatgtatcagcttctcatgctataaaagacacaaaggggatgacttttaggaaggtgtttatgacaaaaataagaaatagctggttatcaagtgataacttgagctttatatatatgaatttcatcctttgaacaaccccacgaagtaggtcctattcttaatctcttgttatagacaacgaaaccaaggatcagagacacctaagtaatttgtgcaaggtcatataaaccagaaggtaatagatcttgactcccaggtgacttaattctaacacttgaataatttccactaacccagagagcatcctgtgaagaactatgacccaaaaatactattgaatgcacaataagtcagataataattagtaagattattacctgttcagaattatttcatctcttccatctctggtatatccttgaaagagaaaattactacttttatagaaggaccaaaaatttcaagttaattagaatgtgaagctgatgagggtgaggctcaagaattgtttttcattttgtccagttaggtcttcagatataaaactaggccaagccacccactgtttttataatcctagataactagctcatctcacgaacgggtatcagggactgaaagaggaactggatgacacagaatagacggttcagcagaaactcattcctggaactggtaaaaagcacacagctcagatcctcctgatagcactgagtcagctacactaatgtctttgttgttttgtttttgttttgttgttgttgttgttgttgccttttttaaaaagcatgccatgctgttattgttactgctgttactacactaagcattttgtacacaggatatacactctatgatgaaaactatacatgcaatgtctgatcatgagggacatatatacttaaaaggaaagaaggcaaacagtgacctctgttttgaaataaaccaaacactatgactgtgtaccatgcactatggattaaatatgattcatctcatgtggcatattcacaggaagtgatagcaatgacagattttctccagctctaactcatgagaaaaaaggcattctgaggatcatgaaagaaacattagactagaatctagatgtgaatcctgatcctctaaaaatacttacacatcctcctgcctctgtacctttgttccagcgtgaaaagctgcctaggtctctcggttgaaagcctagggttccttccaggctcagttgcaagccatgtcctctacaacttatccctcatcactgcatttcctcccttccctgaattccaacatcacctaccatctttaccaccctttaggtctttactttttctactgttatttttcatgtgaatttatcataattctccacctggataaatatttgttcaagatgccttatgtgcagatatattttacatttttagcacattacctaatatgcagtagtgctggaaatatatttgtttattgattctgaagctggccttttgcttactcaggcctgactttttgatggtctacttttaactcccataatcagttacttttactgaaatcagaaaaactaaaatcaaaattaaaatcaaatctttattctgtcactttggaaaatgacattctggaagcgctggaaagaaagaaaaatgtggttgtggaagataaatgggttaattaaagttaactctttacaaaaatggtcaaaattgcaaatttcatgttatatacattttactataataaaataaactctttatggttatatacacaattgacattcctctttttattgactgattagactaaaagaaacatggacaagtcaccaatactacagaatttggaagatagtgcttcgattccagaaacaggccaaaaaaaaaatgtacgctaaatagttcaaaagtacatgctacgaagaatgtgaagttcacacctgtaatcccagcactttgggaggctgacacgggtggatcacgaggtcaggagttcaagaccagcctggccaagatggtgaaaccccgtctctactaaaaataaaaaaattagccaggtgtgttggcgggtgcctataatgccagctactcgggaggctgaggcagtgaattgcttgaacccaggaggcggaggttgcagtgagccgagattacaccactgcaatccagcatgggtgacagagcgagactccatctcaaaaaaaaaaaaaagaatgtaaagttttgcagagaaaacagcatccctccttccttcaaaagcaaagaatgctccatagattcactcactgccatatcaaagagtcccaaaaacatgatcatgagagaaccttttccacatgaataatcttttctcttcaatttatttatgccttttaaaacatgaaaaaaaaagcacacacacacacacacacacacacacacacacacaaaccctgataacacagagaaaattctaaggaattaagactatgagggcaaaagctttttactaaaatatattcccttcaaatgacgtgtatttctattaatccatcaaaacttgacaataatccacacctactaaatatgaaaaatatttgtacccaattttttttttttttttttggaggcagagtctctctctgtcacccagactggagtgcagtggcgcgatctcagctcactgcaagctccgcctcccaggttcacactattctcctgcctcagcctccagagtagctgggactacaggcacccgcaaccacgcccggctaattttttgtatttttagtagagacagggtttctcgatgttagccaggatggtcttgatctcctgaccttgtgatctgcccgcctcagcctcccaaagtgctgggattataggcgttagccaccacgcccagcctgtacccaaatttaaaaacaggctacacatagaaaaaatatagtatcaatagattggctattttttttctgtattcgctatattctggatataaattgatctatccccaaagtaattttaatttgtctcccaaatgttggctctggatctttcccagcagaaagtgtgaaaggcaatgagagatggagaacagttgctgttatttacacaacgccactaggtactgaagagcaataagtagaggacaatatcctgggaatctgggttacaaatctgacaggaccacatttccacagcaacagctctctttctgcagagccactgagctgggatggcttgaagacacctgcctaggagagcctcatgatgattttcaaagctcctcaatcaccacctttcaattcttcccatgttcttcgagcaagatgctccatgttcgtcacctcttccctttctctttggcttctcttagcaaagatctcaaatcgctgcaccagaacacaagcaacagctcaaaggctgagtctaagcagtgacattacatacatgttcaacaaaacttgccagtcacaggctcttctttccctttacagaggtgagctttgttattagtaaaaaggtaggtttccctgtttttctgaagaaaagctgtgagtgggttaactttcaactctgttattcgttagctgctgtctctaactccgaaatgagcaaactctgcaaaaaatatcttcaatctggagaatattttacattttacaaaatgtgtccaccttcattactgtattcagtcttcagaacaattcagcaatagtggttattatcacctccatctaaagataagtgcagaggactgaaaagagaggcaggaagcttgctctgtttccatggttagaaatagcagctctggagctagaattgagtttttctgaccctaagtctcccacttttttcccctactactgtcagctctgctgtaacatttcttttaaaagtgctaatttgttccaatgcaactgatatgttgtgaaaaaatttaagcatgacacaaatcttaggtttgccgattgcctgatttcattcatgagaaaaattaggtgaacacagaaaactccacccagttgaactgcatcgaaacacacaaaacacatatttcaaacagacctcagtccactgtgtgcattacgagccacaaccatccacatgtggtgtttacaacttcccctccaatttcagacagcgttccttccaccacttcacagtaacttctgaactgcatccctgttgatatccacttccacaaaaaactctttcaaggtaaagcaccatatttattgtagtatttatgtattttttaaccactgaacacatggctgccaattgtattaggttcctacctttttgtttttagtgtgtcactgacaaagttttgagtatttttcccatagtcctgtttcccccaaaagctttgtggttttcactgtgtggttttacagagtgcagtaattttcagtaacacacatgttataccagagctgactggacaccatggtggagaaaaagaagtccaaaacaagagtggaattccaaaatacttttcctatttggacatgagcaaagagttaagttctagacaaagaatcaaacatacaaagagaaagacaggtatttcctccatggttctacagaatgatcttgtctatacctcatagcctacacatagcaacagagctcaaactgagccatcctctgattaaacctcaaatgcaggagattcctccatttccctgggtaatctatgtttctgaccttttctcctgataattttgtaaaacttgcttaaatcattaaagtatcaaaaggtcctttctacatgcatgttccaaggaaatgaagcaaaatctatatagattctgataattctctaatttaatagagaactgtgcgtgtaaaagcagctatgtacccccaacatggagtcgtttacttacttggcccacaaatgtttactgagtagctgctatgtgccaaacactgaactagagatggaaaccaacaatgagtcaaatggacatggttcccggcttcgttagacttacagactaatggagagggctggcgctaaataaacatcacacagataaatacggcagtataaactgattgttaattaagagtatgctgaaaggtgaaagtgacggaaactgattttgtttggtaggtcagggaaaggcctctgaggaagtaatattgaaactgagacctctgtgatgaccaggtgctaccaggcgaagagaggggaccagcactgcaggcagagggagaggcaagtgcaaagccctttgtcgtgtagggagggaggaagagaagcccagtgtggctggaagctggtgagccaggggacaggagtggcataggacgcaggtggaaaagaataagggatagaccacgtaggaccatgaacatgacatgacagatttgggactgtagcctgggtaaaatgatgactcattaccaagggcttaatcaagtgaggaagatgatttcagatttggcaaagttcattctgactacggtatggagaaagaactaacaggctaaattatagaatgggaaaacatttatataaatatttaaatatttaaaataaatataataaattaaataatgctaccagcttttagtttgtaccacaccatttactagagaagtggttttgaacaagccacttaacttaaaacttaactgctttaagccagtttcctctgcatactggggacggtgaactcatccaagccaatttcatagtatcattgtgaataatagatgaaataatgtatggtaaggcacttcaaaaactcaaaagtcctatataaaaataaaatatggctaactaaaattgtacagcttatattgtctaatatacttcagctacttttgataaactctgtataacatttgtctttaataaccattacatattaaagataatcatagatatttcaaaaagttcaaaaatgtgtgtctaagcagatcatacattaatcttgaaagaaaacacattttaaatatgattttgatgtaagaatggagaggataacttaatcacaaatgccatctagaatatatataaccctgtgtttggccttccctaaaatacattattttttattctcatttcctagtatgatttcaaacagatggcttgatgtatggtatgagaaaacttcagaatgaaattaaaatattaacacttgattcaaatatggaaagccaataaatacctctattctaggtctaattatagttggtgattctcattatatcagtgggtggtaatactgccagagttaaagacaattcaaaaatatgaaaaagaaagaggaatttatttggcttggaaattctagcaccacattatgtggcatatatttgacgaaacatatcaggcataacaagaggcacgtcccacataggctccaagccctccgtgagtcctgcctcgttgagtgtcatgaggtaccagctcatctcaggtgtcctatgctggcttgatgtctgaagatacatgataattgagaagtaatcgctatatgtctgtttcaaaagatttcctgaaatgtgtccaagtgataatattcgaattgagtcatactttatgaccaaagaatcatggggaaaacattagtactcttggataataagaggatcttaaggtaagaaatgaatagaggccattagagaaggacaaagggattcaatgatattcctgtatattgatagaaaaacacatgagctcatttgagaaatgtggaaactgagaagcaagctaccaactagaaaacgtgcccagtcacaggtatctccacgtattcatcaaccaacatccaatgtgcactcaaacatcttaagaattacacggagacccagaacaatccttttaattctctccctacctattgagaatctaaattgacacctgtgttttttcttcagaagtccataagccaaacacatcagcagaaaaattaatgtcttcatgaaaactagtttttaatgggaaaactctattaaccaactctgtcaagccagtatgaaatggatctaaattaagctatagttattacatctaattgtagccttgtttttgttttgcacacatattgcaatacagtttcaccataaagctctctgaattcaatatccccattagttatgaaagatttggtcatcctagaagcagagaaacagataaggaacttgaggattgattttttaaaaacccgtactcttggctgtaacagaagaatcagaatcagattttgagatgcaaggatagaaacagccaagtatatatctgcagtgctgataacatcacccaagagagacaaagcttttattctaactaaaaaaagatgcagagcttggttttgtgtgtgtgtgtgtgtgtgtgtgtgtgtgtgtgtgtgtgtgtgttttggaaaagaaaggagaaagggtgagataaataaatacagaagaggagaagggtggggtagagggtagaaatttcaagggcaagtaagacagatgggcacttggatggatcttaaaaatgtcctcaatgctagacaggagctctataacagaaatggcacaggtgaagcaccccatatgactaaattttcttagacaaagattatatatgtccttattatttagcaaagggatagagatgtgaacttgatgaaaggagtttttccagggtgggttgtgaagaaaagcaagataaaatgaaggtgttaggaataccgctcaaaatcctaaggaaattgaacactcgaacaaaggattcttagcaaagcaattttacttccgcgcagaggggtgcctccttggccagttgccatgagaacacacctgaacaaaggggcaggagagcctttattcctgacgcaagtcctgcccctgtaccctttccccattggctgaggtggggtcgtacaatctaatcttggttagctaaacatttgattttttttagatggggtaggcacgtaaaagaaagtggagggaaaggggaaggggtgtctgtaatgagctagaaagttagtcctctttccaaataaggaaaggagtgtgagctggtactgatagtgcttggtactgtggtgtgcataggcatctatcaaaggcaaaaaggaaaaaaaggagaaaaagaagggggggtactatgaattaaagaataaaagattgattcgattattcgaagagaaacctcatcatatcccacaaaggtctggcacgtggagattgatatgcactataaagtcatggtggaaaaaattacaacaaattttgggatcctaccaagagaaagtaagttgtttactgcatagtcaatggtttttattatttatcaactagggctacaaatgaataataaaatggtaacactgtatttacaacaaaaagtaatacagttttgcttttaatatcatcctacagcagaaaaaaaataggatgaaaatttatatattgatcaacttctcacatttttcatcagtctaagtgtcattttcacatcatgattcctacagtggagaaggcatgaggctaacagactgggctagagtttctgtcttcccattaacttgataagtgaccttgggaaatatacttactgtctccggacctacttctaaactgctgtagtaagttcttataattttatgttgccttggcctccattttaaatataagttggattctctcataccagaagaagggctcagtcatccttggcagaatttccagttctacgcctaactcacactcctagttcctcaatgtgttcaattcagatatctgcattacacagttgctcactacgggtcagctagacacagcctgcttgactggccctgctgctcctaccccctgcatgagctgtgcagatacgccacagtgactaaccctcagtcacagtgtggccacctggaactcacacctgttgctttaaactcacgaattaacattccccataggaaacctgtttggacaacaccctggatgccagtaaaggcattggctcatggatctctctctacatgtgctcctagacctccatatgtgtgaccctcaggtgtatcacataccccgagggcctgtaaacaagaaaatctgtatttccctcttgtgtctcttctaatcattggaaggttccctccatctggaagattctaaattaacactaatgctaaggtcccttccaactctcacattctatacagcaatgaaattagccacaaccatatcaggaaaagcataagcaattacaaataacattagtggcataaagagattaaatgcaatgtctacaagtggggtgtgtgtgtatacacatattttgggggttagtgaaagtataagtttcacttaatactgatgaaagtgactggcatccttgttttggataattagtgggtgaagatttaagaggcaaagggcacagtttttgggttaaagagagccaggcaatgttaaaacaatgatattgcacattacacaattaggaagaggagtgataaaatagacacaccaaaggcattggttttaatttgattctgaaatgattgggagtatcagtagattttgaggagaatgacagaatctaaatgatgtttaatctaaatctaaaggatgataattcttcctcagagtggactctagaggtgagatactaccataaaaggaacaatttcctcactgtcattcattagcaatggttccttgggttggaaaaggcctttccacagggttttctacctcactgactttatgacttctataagcttctcagaaaactaattcttctcaagtctttgaatatctgatgtttacagaggctgaccaaggaaagcaagacattgagtaataacccaggtaggtagtaagcttgttatcaatagtcaactgcctaattcagactctctttcccttacccgaatcttttccttgagtttattcagtcaaaaggctcaattctcagcttgacttagaaaagagctttatttactcaaccagtgggtcctttcataaaaagtcaatgactcattcttctcccctggtcacagatctttctttgttgtcatgttaattgatcacaattaacagtagctacttattattctatccccttgaagttttcagaagttgattttattaaatgccttcatacttgactgaagtcttaaacattgtttccttttctgtggagacagtatattctatgcaaagaagacacagcatttcaggttttttgtttttgttgtagcaacttttgcttccagttctgtaccctgaaccacatgtgcactttcagaatggctacagatctatgccccattttacccccaactctgttccttttctgtctgtactccacaacaatcggtgaacaacaagtgaattctctggctagtttcattttcatttcaaacttttggtccctatgtttctctcgttgttctctgttatggaggattccaagatttttcatcctcccatctacgctctagtcttgaacttcagctatatttactatgaaggttaacacctgttctgcctcaactctgatgtctctcttacttcactgcccgcctaatttatggtttataaaacatacttgtgctcttgctttataacttagctttatacagaatatataatgccacagtctttgctgtttcacatacatatgacgtattaatcattatataatgatatgtataatatatattatatataagtaagcttgttaatataataaattatattaacattaataaaatgaataacaaattatatacaaaataatatattactatatattcagtttaatgtatattataaccaataatatattattccctgtctcttcaaagagcacactttccttcaggcagggattaggcctcaaacacagtcacaaaaccccatagaatattagcatattgctgagctttccagaatgttcaatacatacttgttaagctccacatgaatcctcttgaccccccacgaccttagtgggcagctagctctaggtttataaagtttctctcggtaacaacttttagtcttaatcctgactgaggataatgtgatgagattttctctggtttagaaactccacagatacatttctctctgtcatcttctttcccttaccattgccttctcccaacagcccagggattgcaatcccaacttcatattcacatctcttaactgatgattcactttcgctcaataactattaagtcaaaaatttaatttctgagaagatgtgcaggagtttccaaacaaagccatttataattctatttttaaggatagtacattgtaccgttctttttgttcgccctactagactgtacagagtagtggaaaggaaaaaaaaaaaacacaactctattcagactaagaatcctttttatcctgtagctggaatccttatattccttccttcagtgaatgggtataattatgtgtattggaaattagagtattcgctataattatgcactcttttaaagtgggagaataattataatgtctacaaccaactgtacaaggtactactgaagcttttgttttaaatctgccagggaggacctcagtaatgattaatttcttacaactactttttattcatttggagaacatactaggaatgccttcacacttcccgtttcattgtggaaagtttctttaaacaagaatatttctttaaacgaagacttgagaacaagtgggttggtttttacatagccagcttccattatttcatcgtagattatatgagaaacctaaaaattttaaaacaggacttttagcagcttcccttatccttgttagcaaatgcaaacttttacattttatcatgctgctaaaaggtcagctacaacatttaaaaactcaatgtggaactaatcacaagctttggttcaatgctttagtattttatttcatacaattaccaaagttagaagaaattgaaagcaccaaatattaaagaattagagattgtgttatttctgggaggtaaggttaaacagaaatatcatttttatgaggaaatcattaaagacctataaatgagctgagtgagtgcagttaatctacagaaggggaaaacatatactcttaaaagacaaccagagggcctcttttgaaagtatatttaacccttggttaaccacatcagtcaaggagaacatcacaacagacaatctcactttctcaatgatcgacacagtcaccagaggaagcaaatggaaaacacagtttcacatggtctaaatactactcacaaaagataggccagtgtggctacaattactactattaataatagaatacctgcctggcccgttgttgggtatagaaaagctcacagaagaaacgcttacatcatgactgcaggtcttttgcatgcactttatgtgagtgtcagaaattgtgttctcaggtgccctttttgtaatctcctggtctctccccagtttccactcctggcaatgtttagccctttctcgttcagaagtggtctctcctggaaggctttgtcagacttgactgaacacagcaagagctatttttccacatggacacattaatatctgcccctttctagaggtcttatgatcaaagggaaatgaaagtttgcagacctggaagggtgcttgaggtcactaagtccaattgaggtcctaaaagataccaatttgtccagggtgatccagcttaccataagcctttgtcgctgtggacagagaagattcaaagatcctccaaaatctccctttccaggcagtcaacaatagagcaaattttcaagactttggcagagttttgcatttggaccagttagatttatatgtaaaactttcatataaactactttcctctgcaatatagacctttttataagctcaaaattaaactgctgcatgaagatggaaaagtgatttggcaagaccataaaacattttcatcctttttatattagtgtcttgaaagcccttctagaaaattttgcctccttcttcagaagacaacaatattaaaaacgtgttttttttttaaccaggccttgaatgttatgtacattgctccacaaatgtacatttttatataggctaagactctatttatgatcaaagaatcagattcaacatgcacaaagaaaatggttccaattagtgagagttacctgccatcttagtaccactgtcaatcagaacaggtgtgttattacaaaagtgtgccattacacaggttataactcatccacgtgcaaatacctacaacagaggctctccacctcttaggccaggaagaactgcaaagcatccacaaattacaaacggttcagtgtactgaacatgatgtattgacaggtattgaataaataaaaacacaactgctataacacagaaatctgtggccttattttttatggaaaaaggatccatgtcttcataagattgtggccactggcattaaatctgaactacagctagtgccagcagccctactgatgatacgtaagacagggaaacatgtatgtacaattaaagtgcacctccttattcacagagaagtcacaaagtaattccaggacaaataaagtgaaggaaaataagagagagagagaaaaagagagactcttcccagcatcacaaataagaatgataatgatgaaccctggctgagagttctaagcccttttcacatagctgccactgaacccttgcaacaatactagacagttggcactattcccaaccagattttttttttttaagattatgaggctaaggccacagtaagtaaatagcagagccaaggtttgagcccatgcaatctgattccaggaacctagggcttgactgcctctctttacaggtatgaaggagtttctttcctggtctagtaaactttcatcgcaaccagcaaaccaactgatgcatttaagcctctccctttccaggaccttgttagagattgtagggtatagaagagttccaagagatggtctgaaaaatagagagacagagatggtctttgccattaaaaatattgtaatcttgttaggccaagattatcacacattcaacaattagctagtaaagtatgaattatctagagcaggggttggcaagtttttctataaggaaccagagggcaaacattttaggcttgatgtgccacacagtctctgttgtaatgactcaattctgctctggtagcacgaaagcaggtatagataatacatagactaatgtgtgtggatgtattccaaaaaaactattacaaaaataggtagggagggaaatagctcagccatagtttgtggactcctagtcaagattaccagctataacaaaaaaataatcaattctaatcattcattttccaggaggtgacattccctttctccaaaatgcataaactccctagaagccatggggttgcagaactgtcttcttactgttaagaaacaaaaacaatttgaaacctcttccccgaaacttaatgaaactgtagctactgtcgaaaatgaaaaaattaagtgtgtgttttctagaaaggatgaactttcagcagtgctgaaaatcacgtaatatttgtgcttgtcagtgtgctagaaacaaatcttttatctatccctgtgtgattacgtctctgtacagaggcacctgcgttgtgttatacatagaattatattttaccctttggtgttgaaccattagccagtgtgtcttcttattctcaattaggaacagagttcctcccactggagggagagcagaggctctgcagtcactcgctgccgtgttagtgttgttagagattatacaagtcactttaactcaacaacttacaaagggtctacattttacgtcaaactaatctcaacattagataattttgaatactggtcataatatacatacaggtagatgataatttagccatacagattaacattttgttcttttctaacactttgagagcctatgagatttaatgttgacagatgctaacacctttaaatgcttttctattttctcagatgctgaaataaaattttaattttattatttaaatacatttaatttattaaaaacaagttggaatatacagtaaggctctgtagtgcatggattatacaggttgtagcagaaaaaaaaatctatctccctctctctaccaaaagttttatatttactatgtgctatttaataaataagttaattttccaatgagaacacatggacacaggaaggggaacatcacataccggggcctgtcgggaagtaggggttaagaggagggagagcattaggacaaacacctaatgcatgcggggcttaaaacctagatgatggattgatgggtgcagcaaaccatcatggcgcatgcatacctaggtaacaaacttgcatgttctgcacatgtatctcagaacttaaagtaaaataaaataaataaataagttaatttccctgcacaatcaatcattaagtcttctacctcccaatatatgagctggcctaggaggggaagagtagtaagtttataatctaaaatttgtgtacccttgggtcgtaacttttaccaacaacttaactctccatattgtgcatgtagttcatattttaaagacttcaaaacttcagacgtccttttgtctgttacacattgattgctgttaaactaaatgtttttcactctgtaatcaatactttcttacaaaaataagcccaggcattgacaaacaactctgcagcacattgcagctttcctgaatgaaaaactaccacccccaagaattaaaaaagattgcatcgactccagtgcttattacaatttttacaagcttcttacagctgaatcattccactgtaacaagactttattaaattagacagccattgaatcttaagctttctgagaataacaagtaatatgcctttgtcctttattattgtttctgcaaccatactgctcatgttcatatttacatcttctcttgtgatgaagttattaaaaagcaacatctagataaaaagcaacatctagataaaatgggagggaagcaacatctagataaaaaagcaacaactagataaaatgggagggaagcaacatctagataaaatgggagggaacatctagattagaaaagcaacatctagataaaatgcaacatctagataaaattaaaagcaacatctagataaaatgggagggaagcaacatctagataaaaaagcaaatctagataaaattaaaaagcaacatctagataaaatgggaggagggaaggggtggtataacatgtaaacgatgactttgtgtttcatgcgactaccattctagatcaattttaaaaagcactactaccttaagaaaatgctgttgtacttttagaccccaaatgcaaggaatcttttaatctgggacttttattttacacactgtaaagtgtgagttgcttttataagcatttgccttcaaattatttgttcatcacatggttcactctcttaatacaaccttccagtgagaatccatggtgaatgcgaggggcaagcagccaaccatacatcaggttgccaccaacatgcaccaagtatataactctccctccaatactaatccacacaaacaccaaattcttaaggcatataaccctatattccatcagtaggcatttagtggtctgggtaaaagctaaagcaagttgagaataataaaaacaaacacttccaaatacaacaaagagaaaagccctcacgtgcatacaccttaaacaagctaaggcatgttctcaccttcatgtttattagcaaaaaagaactcaagaaacaattgtttaaatcatttaaaccttgcatgtatatatccatggcaaacagcaacaaaggcatttacaatttttattagtgggtgatatttcctgtcaacagaagtggttttgtattacagtgacataagtcaatgtacagactccaaagtttttcacaaaaacactttctattttttgatccaagatagcacttctatgcaatagctcaaaattgccaccaagtggacggacaaacactattctggttgtagttgtagagtaaacagctgcttctgatttgaagagtgttgaactaatcacatcaaccagtgtttactaaatattaatacctactaagcacagggtgctcctctatgcaccacagatgaaaggcattctgatcagagtgagaaggctaaagccctgtcacgggcaccgcatcttgcgtgctaatgttctctggacttcaataggtaaattattccatttatctctttagaggaggaaaaataacctattaaggctactgtgagtgagcaaaacagcaacatccagtctgggaagggcattcatatcgctaataattgttgaatgatatgaataagctccagaaggtataaaattggagtcactcctaaaatcactgatagtgttcaagagactaataaattagaggttatgtggaccccaccttacaatctttcatggagacactgctctagacatagcagtggtgatgtataactcacggtaggtctataaccaaggctagataagcatatggatgagcaacatctacattcccagctagtaagcggcctcttccccatgggtacaccctgacctttcacatggaagagtttagtgtatgtgaaaccccaaaggataggaatctacatacatatttgatgagccaatttatttaataaaatatctaatttttccaaatgagtgactctaagtcctatttaggcaaatcctcagcttctggcattatttattttatgttataaaacataccttctctcttggaagcatgggtaccaaagggaagaacagtaacttttaatggatgcagttagatcttgaaatttttatctgaaaaccataaagcttttaaaaataaatttgcaaatgtaattgagcctctaatagctgctactgatagtaattaaagaaatctcatttccctaaattaaacataatgaaatgtttttcaagatcaaataaaactagaaaatgctatcagcctgatagaatttgcctctgaaagtggtgttctggagtttacagagaagcctcagttgccagcaaaagtcaatggtttatagggttacgggcaatatggaagccatttccactgtatcatatcaacttttattggctgataactgatctgaaagccagtatatggtacagcttcacattgcagtgcttatgcaaatgaagcagacactctaaaattcttcctttagtgcctttaaagagtttgttatttaattaaacgttgtcagcatatcttcagttcaacttacacatttcacactcttaatgttcaatttttacattacttttgcttttcttaaagtgaaatggcatttgggcatcagagtgaccatcttacccaggtctctcttaagcagggaagtgcttcaatttgctgtcttagtatgggctactataacaaaaatcctacagactgggtgacttaaagaacagaactttatttctcacagttttggagtctgggaattccaagatcaacttgccagtccattcagttcctggtgagggctctcttcctggtttacagatggacacctgcccactgtatttccatgtggtagagaaagggcaagcaagctctctgaagtctcttctgataaagtcatgttaatcctatcataagagctccaccctcatgacctaactgcctcttaaagacccaatatccaaataccatcacattggaaatgagagtttcaacattcgaattttgggaggacacaaacattcagtccataacaattgctcagaattgatcattgtcttctcatttcttgatggtctccagacaaaaatacctagtttccctgttatttcagcaatgtatcatcgtggtaatcaaaaaggttttccttatgtttgataaaaatattttgtgtcttaattccttgccttattatttgggcttctatgaatctaagaaactgttcatctctaaactcttcataacaaggctttattccaggaaaatataattaagccaaccattagccttctgttaacagacaccttacctgtcacatacatagaagcttctaacatctcacttgagtatgataagaagtatgatgtatttatgtcatttgtcatccattttttatcacttttgccacatttctctatatttttacattctctttaaaactggtatatccaaaaccagatgtaaagctacataatgggtttagttaatgttatgctcaggcaaagcatggactgatcttactggtgctctatgttggctccatacttccctaaacgaagtaccactcccatccccaccccacccccaccacacaaacagctcttctctactgagagcctctcatttgctcgtcaaattgcgcataacatgcaggcaacaaatacctatcttggaccaattaatgactcttatctaactcttaactacaacgatgccccaaatttttcttctacatatgttccttgattatctccctgctgaaatggtgatttgttttcttaatcctaatacatcacactgctctcactaattattcattcattaactatttagtaattacttcttgccagacactcaataggtattgccattcaattcagaataagacaagtttcctgtcctgaagatacttaaaatctagtccatgccccctacttaagggggactattgttgtaaatcattctattttgtgtctctgttgttcaaagtataaattaactgttctatgttaacattctttcaaaccaatgactgagcatttgctgtctccactccattcttgccccaccctcacctccagatggatgtcagtctttagcacaatcctccaatcaattgtttattcactgatagccttgacaggaaaggtgattacaaactgctagcttaataacagaaacaacaggatttcttcaagtacttaagggggcaagtgtattcaatactgcagtatccccttacctatgatttcagttactcaagtcaactgtgatccaaatataaaatggacaattccagaaataaacaattcataatttttaaattgtacatctttctgaacagcatgatgaaatcatgcacattctagctctgtcctacccaggatgtgaacctagtgtatccatactatagcggatacctgcctgtcagtcactaagttgttgtctgggttatcagataaaacaagcaaagtgtatctagggtccagtccagtccacaatttctggcatccactgggggtctgaatggagcatatatactgaagataagggggaactaatataaagtgttctttacctccaggatttctaactgagttggggctgagtctcacatcttacagtttgtccacctttctttgcctcttttcaaaggagcactttctgtcggtgagggcttcatctacatttttacctcctagttcatgttttcctagagcatcattatttagggggaaaagtaagctgtaacatttttaaataaattggtttgctgatgggagtttaaattggtgcaactgctttggaaaaccatctgggagtatctgattaaagctgaatatatacatcacctgtaacacagcagttccagtttaggtgcatatgtttaccatatatgtacatctgctcacctaaagtcatatactagcagcattattcataagagccccaaaatggaaacaacccaaaggtccattaacacagataaattatgggatactcaaacactgtaatagcatacagcaatgaacaaactacaactacatgcaacaatatagatgaatctcacaatgttgagtgagaagagtaaatactgcatgatctcactttatattaaagagaaacaggcaaaggtaatccatgtcattaggcgtctactgaaggggatttggtttggtgcctagagaggaacttctaggatactggtaatattctatttgttggtttaggtgctgactcacaggtgaacttgtgaaaattcagtgagttaaccaatatgtacgcttttctgtatgtacattatacctcaataaaaagtttttttaaaaaaacagaagaaaatctaggtgaccttgagtgttgtgatgactttttagatacaacaccaaaagcatgacctgtgaaagaaataattgataagttggacttcattaaaatgaaaaaccttaaacttctgctctgtgaaaaatactgttaagagaatgaaaagacaagccacagactggaaaaaatctttgcataagatacatttgataagagatgggtatacaaaatatacaacgaatgcttacagctcaacaataaaaaaaaccgcgttaagaagtgagcaaaagatttgaaagaacacctcaccaaaggtacgcagagggcaagtaaaaatatgaaaagagtctagggaactggaaattaaaacaatgagataccatgacacactattacaatggccaaaatccaaaacactgacaacaccaaatgctgatgaggacctggagcaacaggaactctcattcactgctagtgaaagtataaaatggtacagctagattagaaaacaatctggaagtttcttacaaagctaaacataggcttacctatgatccagcaataataattctagttatttaccaaaatatattctaaacttacatccacacaaaaaaaatgcacatggctgggagcagtggtgtgcccctgtaattgtagctactcaggaggttgaggtggggggacctcacttgaggacaggagtttgagaccagcctgggtaacagtaagataagatcccacctcaataaaaaacaaaaaccaacaacctgcacatgaatgttcatagcagccatgttcataattgcagaaacttgaaaggaatcaagatgttcttcattagatatgaaggaaaccagaatatttctccccaaaatatgaaggattattgagatgaagacaagtaaaatgcagggtagctctctgccttccctctgtttacttaaagcagaataaagaattacaaagacttttaaaaggtcttttgatctctccctatatcccacctaaagaaaaaatgtaaatttccccttactgcagacaatctcgacaaagttagggatggcgccagaggaatgtgagctttactttactttgccacagttttcccccctttggaagcctggaactaatttcctttgccctgtaatttttctaaaatctattgctctttgttgaagattttatgtaagattaaactctaaaccactgccttaagttactttactcctgtgagatgtacgccgaatgcattaataaacttgagtgtttttctcttgttaatctgtctttggttgcagaagtctcccaactgcaaatttatgaatactgaagaaaaattataatttctcccattcagatgaatgaataaacaggcgtgatacatcctgcaatgaaatattattcagtgatataaaggaatgagctatcaagccatgacaagacatgaaggaaccttgagtatactgctaagtgaaaagagccagtctgaaaaggctatatactgtatgattccaagtatagtcatgtgccatataacaaagttttggtcaatgactgaccccatatacaacagtgatcccatgagattatagtactgtaatttttactgtacctttttgtgtttagatatcaaatacttaccactgtgttaccattgcctatgatattcagtacagtaatatgctatacaggtttgtagcccaggagcatgaggccataccatatagcctaggtgtatagtggagtaggctgtagcactaggtctgtgtaagtacactctgtgatgttcaaacaatgacaaaattgcctaatgacagatttcttagaatgtatccctgtcattaagcaatgcatcgttgtacacaaagttttggcaaagttaaaaccatagagacactaaaaagatcagtgatttccaatggttcagagctaggggtcatggatgaatagatggcatgtgaaatatttttagggcagaaactattctgtatgctactataatgctgtatatatgacatttttatacatttgtcaaaacccagagaactatataacaccaagagggaccctaatataaatgatagagtttagtcaataatagtgtagcaatattgcttcatccattgtaacaaatgtaccatattaatgcaagatgttaatcatggtcatgggaaactgtgttgggggtgagagtggagcaggtaatataatatgagaactccctatactttctgcttaatttttctgtaaacttaaaacttctctaaaaaataaagactactgattttttttaaaaaataaactcatttaatagttacaaaataccaaacttgattcactcaaatctattcaggttaatccagggatcacaaagcccttaattttccccttctaccttcagaataaagttcccaaacccccaggcatacaacataaagccctcacccatcaatccagccccatctttaaacactctctcctgtgtccactgtgcttctggcatatctccatgctttcctactgttcttttccttggtcctagaatgccttcccctcccaacacacccctaatcgccttagtttagctggtgagttcctatgcatcttccgaggcccacttcaaatagttcctccttcttttttttttttttttttttgagatggagttttgctctttggtccaggctggagcgtaacggcgcaatctcagctcactgcaacctcctccccccaagaagggttcaagtgattctcctgcctcagcctcctgagtagctgggattataggcgcccgaccaccacacctggctaacttttgtatttttagtagagacggggttttgccattttggccaagctggtctcgaactcctggcctcaggttatccaccctccccggcctcccaaagtgctaggattacaggcgtgagccaccactcccggccagttcctccttcttgaaactctttactgttcttgattaaatgagcatctctttcttctgtttcctaatcacatgctgtgattatgcaactggctcttgatgaaatgggcatcgctttcttctgttttctaatcacatgctgtgattatgtaactgtttgtgtttctgcctcatttgtgagaatgtgaacaactctcacaaatgagggaccatgtcttaaagccacctctggtgaacactggtgccgagtgcataatcaacaagactttattaatcaataaatgacatagttattattcaagttgttattagcactggtacagcaacccatgtgagctgaaggtataacataaatgttaactcagtaaagtcacttctgcaaggggctgagataatatggcttaggtatttgacatgctgcttctataacttaccatggcaataacacttaaagtcacagaggaatcacttgctcattagacacactctctggaagaccagatgtctcaaggaagactttgataagtgctggactgcaattgattcatggctgaattctctgaggagcgtcacaatggtagataagctatatgttggggatgaaatagggatgcatatgctttatatgccagacatgcatacatcagagggagtggtctatttgagaaattaaggactctaacttacagtttttatctggcaaaaagccagttcagttcagcagtgagagttcaaaatataatgcgatcttagaagaaaaatcacagatgcaacccaccacttaaacctgtaatattacacacttaggctctatacctgggccacttttctttcctcttaaattctgctttggcaatttcatctactctaaggtttgaaccattatgcctatgtgaggtacctcctggtatatatctcccctaatgcaggagcagaacaccttccacttgcttttcctgacccttctctactctctcccactctgattcctgccctgggaggctaatgtttgtgccctcatcaataatctgttttctgcctctggcttcctgtgaagtccaaccttggaggagctcaaacaggagatcagaggaaggaccagggagggaggagttttattcacctgactcaatgattcctaaactttagagtacatcaaaatcacacagatgaaggcctgttaacagagattgctgggccccactcctggcatttctgattcagtactgctgggatggggctgagaatctgcacctctaactagttcctgggtgatgcggatgctggtggccaggactccactttgagaacccctgccacagctctttccctggaaggttactgagctacttctaccaaaagtctgtgctcttctcaaggtgacccactctacaagactgtggtgattaatgttatgtgtcaaattggctaggccaccagtacccagatatttggccaaacattattctagatgtttctatgcaggtattttttagacgacattaacatttaaaccagtagacttgtagactttgagtaaagcagatcaccctctgttatgtgggtgggcctcaaccaatcaactgaatgtcttcatagaaaaagactgaccttctaggaagagggaattctgccacagactatctttaaaatcaaactgaaactcttccctggttctctggcctacagaactaccctgcagattttggacttaccaagcctctgcaatcatgtgagccaaaataagtctttctctttttctacgtgtgtgcacacacatccagttgtctctgtttctgtggtgaactctgactaatataaagaattcatccctccaggttcaagtaactgctccctactccctatacagctcttaagacagggcaatgacagtttgactgctacaaagtccccagtttctgtactgtctctcacctgtttctacacctttgcaaacagtccttgtagagtaaacccttgttgaattatcctatttcagatgtgccatctatttcccattggactactctttggtacaatgcaccttaaattagagggaaaactcaccttctctgctttctttctaagcctactgcacctgctgtgttccctcttgtgattaatagcatcacttcctcccaggaacccagacgcataagctcagcgtcagtttttcacctcttgtaattgctggtccagctttccgggttttctatgattctggaagctctttagcagaaagtttatctacttcatttctgtatctccagaccctaacacagcatgttccaggcatctccaggtagcccaaaaatatgtgctgagaaaacaaataaattaaaatgtgtatgaaatcttaaaaattgtatatgcctttcatatacaatgtttccagactccaaattccagtttctttccctaacgctttgctccacacaagcaaagattcactgctaacatactgagtattggttcatcttccacgacaatgcttgtatctattccttcccgtttccacaactctgcttcctgtttctattatttgtgaccgggataattgggtattagcattctaacctgcttccttgcctcctaacctgcttccttgcctccaatctccctgttctctaatccatcttatatcttaaatctctgatcatgactttgtctctatttaacagcttcttattacccaatgaacatgagccagattttttagggtttgcatgcaagatccttcataagctggtcccaagctagcacgccaacctaatcttaccattccctcatatgaactctccactccaggtgctgttcacctgtaccttgcaatctgaatatttccaactctgtatcatactgtgtatgtcccttgcttaaaacagcatgctactcatttttgttcacatctctcagaacctagctcctgccctgttcccaacacaatgccaacccacaataattccattttgcctcaaatactgtcaatagctattttctatatctcacatctggaatctaccaattttattgcttttgaatgtaagtatatcttatctttcaaatcaggctgtaggtaacaagcgggcccatcaaatggtggtctactttcttctatcctccaaacctcaagcacagtcattggaacagtgcaataataagcatttgctacattcttcttcagtgagtatctccaccacctatgaaaaggcatgtctgtgaagaactagtacttactgtgttcctaccagagggcattaatacgtagaggaaaggtttcccatctgcctggggttgacagatttcaaaggggcaggaggctctatatttagctaatcttattgagtgtttgttaggaaaagagcaatgcattctgtgttttgattaatggttttcacgcttttgtttgtggagattttctttgtttctaaggagtattttttctttcacaataaactcccgagaataaaactcagaagatttagacatgcccaggaatttctctatttaatcagcactttaggtgcctcaaatgttagtggctttgcatttggcactcactttgagaaacgctgggatagtgtataaaaagaaactgcatagaagagaaagacttcatgttaattatggagtggtggtaaacaacattattaaatgtgatctactaatgggaatgcttgctcaaattaatgttttcattaaaaaatccatgtaatctaataaattaaggtatttttccaactgagaaagtgattctccacttgccttacaatcaccccatataactggcaggtccactagttaattctctacctcatgaaacactgagagtagtagtaatatggttgccacatgatacaatgcatgttgtatcataaaaatatatttcaactaaagggtagatgtgcttctaaatgaaagaggatatgggtagccagagagagcagtattgctccaaacaaaaatcggacacttgtcctttaggaaatttaaaatatgctgtccttcctttctgtttgctcttggttagggaggttttcactggaatctatttgaggcaagtgctgagtatatttgctgtcattgtgttctttgatctcagtatattgattggatgcagctgcagaaacaggtaatgtgggcaaatatgaagaaaacaaactgctgcctgcagataattttttctggagtgttaggggaaatccaagataattacacattttcttccatttatttttaagaatatgaatagcaatacacacttcagtcttcagaatggaggctgcaccttttaaactcactttgaattatgatttaaaatccattgtgctgcattcattcacttgcttgttcaaaaatatcactgagattttgtgttggacacataaataaggggctacctactctaagactagcatccaggtgtcctattcacacctcagaatgatgcttctctattctctatttccacaacaatcccagagttacataacccattacctcatttatatgttatctccactacttgccagtctagacacctctagtattttgtggtttcaatctatcttatattcaattaacaaaacaatctttccaaatataatttagattagccactggttcaataacacaatatcatgcctcattgattacccatcattcaattaatcactcaacaactaaagttacagagaacctactgctcttctgggcactggtgctagggtcaaaagggagagggaataaagaagaaatacaatgcatggcttgtgctcttaagggctacagtagatagaacaacagcctaccaaagttgtccacaccctaatccctagaaaatgtgaatttggcaagagtggttttgcagatgtcattaaggttacagactttaaaataggaagattgttttggattataagggtgaggccagtctaatctgggagcccttaaaagcagacaatttctccggctggaaacagagagatgcagcaaaagaagaagtcagattccaagcatgagagggactcagtgcgcccagtgctggctctgagatataggcccacatcaaggactgaagagaggcctttaggagctgaggttggtccccggttaaaacaaaatgaggtcctcggttctgcaacttcagggaaccagattctgccaacaacctgagtgaatctgaaagcaaattcttcccagagccttgcaataagagtccagcagaccaaaacttgatttcagccttgggagacctggaacagagaaacccgtcaaggtatcccagactgttgacctacagaatggtgagatgccatgtatctgttgttttcagctgctaaatgtagactgtttgctatggcagcaataggaaactaatacaaagaccctatgaacgatctatagggagggcagtcccactccataaagcaacacattccatcattaagtacaatatgcagggttggtgagaaccactggcatgttcctgtaagttttgaaaggattcagaggagagaaaagtcaatgaggctcatggtagttagagaaggctttatacagtaaatagtatttaaattgattgaataaagatgttagatttttttaagcaagcatttcaaaaaagtagaacatgacagtgacaggcacaagcaagttggaatgactgtgaaagaaaagcttgactggaatggcaaatatagtccaatagtacacataatgagcctcctaaattaaacagtggcttgaaaaatgttctcaggggtcactctaggcaaaagtatgatggggagcaaaaggaagggaactgtttgtacacatgatggggatatgtagtccctctctccatcttctccccatctggtcttcaatcagagtacctccactctgatagcttttacatagcaatttgaacaaagattcagcagctgtattagttttctaaggctgctgtaacaaagtaacacaaactgggtgacatagaacaatagaaatgtattatctcacagtcctggaggccagaagtctgagtctgaaactaaggtatcagcagaccaccttcagggctccctgaaggcagtagggaaggatctgctccaggcctccctcctagcttccagtgggttcctgagcttagcagcatgactccaatcttcacaggacattctccttgtacatttatagggttcactctattccagtctccaagatgacttcatcttaataaattacatctccaaagactctatttcccaataaggtcacattcttttttttttttttcttttcctttctttttcttttttttttttttagcagcgtttatttgatcaaagaacaattcatgaatcaggcagcccttaggatcagaaaagattcagagaactcccaggtcatattctgaggtactggggaccaaataaattttgggatttacaatccaacccataacaatggctgaaataaggtttgaaagctaaatatataaaatagcaactctgaccagcatcgaaagctcttcagccagtaatttaccctccaatgtggacagactggcccttttaggtgcacaatttactcacccttcctgctacttactacccttttcttctcctagaactttccatacccagttctgaggattagtcccagagttttctcctttagaagaaatctagatgataatctatttctagggagagtcttctactttacaggttatattagtagtaaactgtcttatgcttactaaactacttagtaatcactgaactgatatcctctgtgacaggtgtccccagcccccaagctgtggaccggtagcagtctgtggcctgttaggaatggggccacacagcaggagatgtgcagccagccaagagcaagcattgccacctgagctctgcctcctgtcaggtcagcggccgcattagattatcataggagtgcaaatcctattgtgaactgcacatctgagaaatctaggttgcaccctccttatgagaatctaattcctgatgatctgaggtgaaacagtttcatcctgaaaccatctctccaacttccacccccagcccatggaaaaattgtcttccacgaaactggtccccggtgccaaaaagtttggagaccgttcctctatgagactggagccaagatgtatgactcatcttaatcatgctgcacccaaaatcagtgttctacagccagcacaaaccctatatatgtttattgaaaattagtccatctaaaaatatattcagatgttacacacctaaaaacaacgcattcaaggctaaatttagactttgtcccatagaaatacacctctagcccagattttaatttaagcacttcagtgtgtcaatcactttggcaaatacagccgggtacccacatagctctgtactgttgatgctaagtcagccttccagccaaaaccagagaggcaccacctagcattgtgatgtcagtattatgtgtcagcaagatacttagccctgcaacccttaggtggtcatgctttctcccagcccatgaatttctcatgtgaaattttcaagatgtaacaatttttaaaattaagctttagaaactctcaactgagattcacgtttcaaagtaatggcatcctgaaagctcaggcctgtccaaggaaggtttattttattcttttatgccagaaagacatgaggtatatagggcccagaactgtccacaaagacatcttctcctatataggatcttcttccatataggatctcctgtatcagggatctacaaccagggagaaaagtacagagtttttaaactttttctagaaatcccttgaaaccttaagtttagagtcaaggggcttcacctaattcttcctatctccaaggaactatttaaagcagatttgcacttactcattcttggccttttctgtgccctcttgtatagttcatatatagaacctataattaggcactcactactttcaaaagcatgtgtttttcacaccataccaccagcctttggaaaaaggatgttctacataaataggcaaaaggccaagaacaaatattttttaagttttagataattttttatcacatccaagggtggcatttgcaaagactttttttaaaagaagtcatttaattactgcatttaaaattcacataaagcactgtgctagagattaacgatctatgtggaaaaacattttgaatttaaaaagtactgtaccaacatttacaagagttgtagcatcttaagttgaaaagggattgatctatggaaagtagaagtataaatacatacttaaagctgcagaaacatatttgtttttgaaaaaagaagttgaacatttattcatccctgtaaatatagagtgttactatgagagaaaaaaaatcagcataatctacagaagccctaaattctttcatgaacacccttgagaccgtcacctattacttggatcaatcttcacattctataatccatttttactcttaaggaaaaatttaattgacttcttgatgcaacattgtttttttttgtttctttttttttaatttaggaaatgttcaagtctttacatctccacaatacatagtcttataagaagacaattcaggaaactgagagctttcaaagccacttgtggctactcttaaattactttctgcagttaaaataactgtgtgtttgtaaacaaagtgcttttcaagagtaagatccccaaacagtcatacgttatttttttccatgtgagaaaatgcattattgtgaaggttcagagacataaagatggcactagagaactaggatgatgctttcacctccataaaaggagaagtataaaagagaactgcccaaggaaactccaatattcagttgcatgtcagcaaatgggggaaacgttctaaaatgccctacctttatacatttaaaaagatgaaagattaagtttcaaggaactcacagcaaaaaaagagaaaacaccccaaacagtactttgactacctccagaggaattaaagggctatcattccacatgaaaatatcccagcatttctgttgttgtgtctctgcctatgtgattggtcccgaaggccccatacacactggtgttctcagatcacagctgcttcttgtgctttaacttgattgcctctacacgtacagacacagggcatgaagcccatttatcgcaggctcaaatctctgttgatgtcattggaatctaagccttcttgctcctgagctgcaacaggcaagtatagaggcccatagaagacgggagatgaatatttaacttgtccagagttcccagacacctcagaaaatattattacatctacttagtactgactgttgttatcagcaccaagtcaggacagctttatatttttgctggagtaaaatttcagaataaaaaccttttggtattggaactcaaaaatgcgtaacttctgcctgaggaatttcataattcagagatgctgagatggtatctacctatgcgttcttgtaaaggtgcagtgaggaacagagcttagttttgttgttgtttaaactttttccatgttcccgttgacttctattctcatttaaaaggaatttttattttcacttctcaaatatcctcacacttgaacttcaacttttagtttctaggtcaagtagtaattgtatgagatgaattccaattcaaagattcctgttatttggagccagtcccgtaactaggtaagaaccttttcttgtacatctacactaaataatttgtctgttttgcaaatgtggattctcaaaacatagatatcttaaatatgggcatatctcaactgaacaaagcaagcatcaattgaacgcctactttaagcacagcaaggcctcagaaaacagacaatataaaggaagtgagacgcagcaaacagtgagagaataattccaagcccacaggcgagaagtcaattttcaaacagttcactgtgtacaggtccatgctatgcaagcacaggatattttttcataatatataaattgatgccttcaacaatctgtggtggtccatccacacacacaaaaagaaaaaaaccaactatggtgccaagtagtataaaaagttatttatccaaactgctgcttttgttttgatattcaaatatagattgtagtcacaggaagaggaaagatgatagaaggtaaaaacgagctctggagtgagagctgtgtttgaatcctggttttgactctttctagctgtgggtcttggcaacgttgttcactcctgggtacctcatttgcttccctttgtttttgctgaagagtccataaaatgaattgcagagcactaaacaaatcttatttattattatgtagtcttgttgttacaccttacaacacaattgtataaaccatagctttttatgaggttttaaagattgtttgatgagaacctgctctgcatcttgtctttcaccatttctactccaaatcaagtccaagttcttgccactttccttgtggctttgggattccagtctgtttaaatggccacacaccaacctggctatccaggttcttaaacccctatccttcagtgtctcgggaatctctgctttccatggatctttccagatgaaaacttaggagacccctgaagattggaaatgaaataatgtgttttagaagagaatcttgggaaaatatttaacatgaagcaataagctgtatttggatgcctgaagagatccctcatccaaggcacaggacgtctgtatcaacatgcctggctttgtgctgttaacaggtatgaagacagactaggtaacacaaagtgttggcaaagaaagagcagtggttctcaaatgaggatgattttgcctcccctcttctaggtgacatttggccatgtcttgaaactttcgggtgtcacagctggggatgggaggaggtgactgccatctgcaaggtgaaggccagagtgccaatgaacatccatcaatgcacagacagagcctactaccccaacacagaattatctggcccaaaatgtcaatagtgtcaagggagataaaccctgacaaaagcaaaagtaactctcaaacactgctggtgggactgcacactgtacaatccctttggaaagcaatttggcattatgtgatacagctcaggttcaagatgctcacagcctgcaacccagcttttctcctcctgggtaccttcaagaaactcctatgtaagagttttaagaaaatcttttaaaagtcatattcagtattgtttatagaagcaatccaaatttctattaggggaatggctaaattgtggtacatccatgcaatgtgaaaccatctagtagtgaaaatgaatgagctacagttgcgtgtgtcaagagaggaaagcacagaagcagactgactttctcagatgaaaggaactgcagaaaatcaaaagctggggtgatagaacaagcagggtgtccagtgctgacaacagagacagtgatgggtgtaagctttgggctgtgacacacagatgcttctcctgtgttatgagcatgcaagggtcttgcctttaagatcacctgccatctttggtatcagatacccaggtcatttgctggctactatttggccccttagatcccctggtagaaatcctaagccttttgttctcataaaaggaagatatttcactataatcaactaagttgatttcatcatcaacttctcagatcagtttatacaaagattatattattttttggtgaattccattagcattccactagtcaaccaatgtttgagtgcctgctctacgctgtgttccatgtttggtgctttaccaacagtggggatgaaaagtatgtggtctttgttttcagggaccgccagaaaaactaaagaacatcctctggcagtatcaaatagggccctgcagtggaaggaatggggtgaggtccatcagagaaagtctatcagaataggaaacagctatagagaacagaaggatgaaaaggagtcactcatgcaaagaactgggagagaaacattccacagagaaggaaccctgaaatttgagaagataaaacaataatcagtaaaaccattactttaatgtagcatacttcatgtgagtcattttgcctggttcatactttatagagatgcaatcataatttacatacaattttatatcttgctcattattatatcatgaataactttttcacgttgtaatatagtcttcacaaacatttaaatggatgcattatattccctagagtggttaaaacatcttttatttaattagtgttttggggcttagtcattcttattacttgttctttgtccctctagtgtaaagatgaaggtctctctttatgtaacttttccctatgtcttttgcattattgccttaggccagcttttcctaccttaaatttaaacacatatacacacaaatgatgaagtatgtttcattcctgtttcatcttaatcacttttatctttaaaatccttaagcttagagaatagttcacattacccaagccatacaatgtctttcatttcggcacagtcttggactgtctttaaaattcatcacatacataaactgaaaaactgaactacagctaccaaaaaaggttttaaaattgaaatctggttttagggggctgacatttcttgagcttgtgatttaaagtacattttttctttttgtagtctctggcagtcaaccttacagatctcccgtctgagctggtttatgatcagcaggctacattctagatgacaggattacctactaatgtcttagaattaagtaccactaacttgaatcataagcaaattaaacatttcagctcaaatgctttcctgtgactccagcaactttcaggtcttaagattaacaggttgtggtctgtaataaaaaaataaaataaaatcccctacaacttcagcttccctcaagaatccacttacctaagagcaaaagaggtatcctgtgatgggactgaagccctttggtgaaaataaaaagtttaagtgacaacacttagtgtcagcatgacaggttataacccagagaaatctaacccacttggcttactcatcttagtatcactcagggtggaaggcagcataatgatttagctattatttaataactaagataaatcattgaagtaaataatatccttgccatcattaagaataatcccagtgtaagtcatttctaaactacttcacggtgtatgatgcaacaataataaaagcttacgttcacaaagttctttagttcacaaatcatattaatattaacatatttgatccccctaccatacatggtagataggaaagaaagcttctttatcttgtggatattttagagcatcattttcaaggttaagagacctgcttgaagtagtatataatgaagtgaggcaacgaaccctggtctcctgattccaaatcaactgttctttcaactgcaccatgataccctggatcaaagcgtagaacacggattagcttctagttccagctttgacatgaactagccatgtcaccttatacaagtcaagtaactaagcctcagtttattagtaaaatgtcatttgatcacatgatctctgaaggttgaaaattccattttctataaaagaattttctttttacttccatgggaagaaagtgtcttcccactacagattcctgctccccacctctccatccaattattcccctgcaagtatatagatatgatcgattcattaagtcagcttcaatgctataacattatcatcataacagtgataaggtaatattaatagctaattttaagtgtgtgtttactgtttgcaaggtactattttaagcgctttatatgataattcttttaatccttacaatggccctagaacaagctgaaattattattcccactctccagattagaaaatgcaggcctgaagaggtcaaggaatgtgttcaaagtcacaatgccagagctgggattccaactcagacagcctggctcttgagcccacgcacttaatcactaccttacgaatccacattccttgacttaacaatttcacatactttctaagagtgaatttcaactgataacattttttttttttttttttttgaccacagatgttgcctgaatctcactttctggaacagtagcatatgaccatatataaagcccccaaccaacactttccctaatggactattccctgctcattcctgacagaggtgtccgcactgtttctggggttcctttcattatacagactctcaaaaccaaacaggttatttggtaaatggaagagatctattacagtgtggagtcattaaaacagtccttcccagtatccagctcccttccgctttgcctgcttgactttctagagagcccacctcctctttcgagtcagtagagagtcactgagttcaatttgctgcaaactaattaattcctaagaactttgacactagaagctaagaccccaaaacagctcctcctcctttcatcctgagagaaaatatttcagatataatacatacattttcaatttccatatttaaaattcgcttcaatccatttttccccatatttataaggtcacatttgttctttatgttaatggcacagatttcagagccaggagactcaaagtacttctcaaataaagagtgtattcctcactgtgtggtaaaagagtttactcagcttcctctttgaaccatagacagcatttccaccttctaaacgctgtatcccaaatggacaggctgcccctcttgctggacagccctgggacccaggggacatgctagtcgttctccatcactgtccttgtaaagttgtacaaaccagtcttgaaccaagtatttcagcataagggggactatacaggaaaaatataccagcatctgtcagtagcagtgaatgtataaaataaacatcataaagtgggaaaaagacttccaaacaactctcagcaatcttgtctaactatcctgaccttaaaatgccaaagtacactgcagtaaatgggagagcaacatatcaagtgctgtcactatttgccgttccattctagaattccaccacctcgatcttgaaacctccaatcagatgtgctacagtaaatctcccttccactaatcaagatggaaatcttttctttcccaatcaggtccaattgcacagacaaagcagtgcatctgtttccctttcaagacagctcacccaggggatggtggagctttaccgacagaacagctagatggtttgtcatatatcttctcctctcgcagagtgtctctgccatcttttatcagtggttatccagagcttccctttttgtgacaatattaacccaggactgctgccataagcattcagactccacttgctgcctgcagggacttctgaggagagtttatcaagactgctgagcctgatgcttttacgttaaagtggctcccactcgcagttattagtgtgtgcggcgagcccacacccgcacacacatgaggccaactccccacaagagtgctacgcagagcagtagcaatccatctgttttcagttagaaaatacaattgcttttgcacagttgaagaactgatctgatatgaaatgaccctggcagttttgaggtgatagcaaatactctgatgtggctgccaaggtaaggcattaaaggggttacgtaagcataaggcatccctgtgccacttaggaatgtccgtaaagcaataaacaaacagaccaatagacacagaagttgcactatattcccaacttacaatacaaagagcctgcaatcatcagaccctgactttcagaacactgaaatgcttaccttggatgatgttttaaaaaataattttattatgggcatattatattttataattctcagtgattcatacaaaagcaatactctttaaaatggccagaaggatgggcattttaaaagagatgatattagaggaaatgtttaatttcattgcctttggggctccttgtaaggatggaaggcaagattgtgcaacggctgggaacgtgggtgagggcagagtgggggcagatagaactcaaaaaccagctctgcatcttcctagctgtgggacctgggcaagttatttaacccctctgaactagtgcaactgggtgttaataaccacagctacttctctgggttgtaaaaagcttgtgcagatgctgtgcagaaatggtgtgtcatgaatatgaggataatggtttgtcatcatcatccatagtatactatggtttctatcattgtgagttcccaaagaattctgcaatgactgtaacgaagtaatctgtcccatgccttgcagaatcatctctacctctgtgcctttctttattccacactgtgtttgtatttttgccatagaaagcaaagatggagaaaaaatagctagcattccctctaaagagaaatgtcattctgccctgtaacaacaggaacatacacagcctattttgttgaggcattgacaagactccattcacagcaatggcgatgggagtgactattccaaagccatggcttcttcttttctacatttcattccatattgtccttgtggatgtcccatttcacttaagctttctttttggccctgagacatttatcagcatagcctacatgcagatctaccctcccaagcatgccccagcaataactcgtctccagtcctctttaaaacacaaccttctcctggtttactcaggtgacaagcttgctaagtctaataaactgatctagtatacatacatagctcctgatagattaatatattaccatactggcgatactgacaatttttgaagagactatctgaagcaaaatgtaataatctaaatgaattactttctcacgctagaattctagacatttaagcaggtcagtagagagataaagggagcattttgaggcagggtgcttttgaaggcatctcaagttataataaaaggcaacaacctgtttttcatactgtgacatgaaacccacaaaaggagacagttgtttttgtggaatgataaagagaagtaggccattacatgcttaattaaagattcaatccttttaatccagcagaaatgtgacccccaactgagtagaaacgtggtcttcagggaataagcatgttttttttgtttgttgttttgttgttttaatagagaaaagcattaggacaaatctctttattacagggctgaatgcatcctcatgccattggcctccggtggtggtctctgaggtggtctctttctcacccaagagagaggtctggttccatcatgcccagagcactatgtcacatgcattcaacttgccaagaaaagaaagaactcaactaggattatggatgctgttttaaatgaatgtggctccctcttctggtggaaagcctgaatcaataataaaatcatctcaaaggagaaaaggtgcttagcttcttcctctcccagctccagaaatatatgtcaacacaataccactaacaagtgaaccagacaacaatagatccgccgtagttctcatattctgcaaccaaggctaagtggtgaagagatccacaactgagatgcagcaacaagagaagagaaaaagaaatggactttagagggctggatctcttaaaaataagcccttcctataaatatatacatggatatagggaatggagaactaatgctgctttggaaaactactgctaacagaattcttctggggaacaagttaataatgataaaatgtctatttgacatcttgatttttagtgaggtcaaatctacaatattaaaagtatcttccatcacatttcagtaagtcctatggagactctggacactttgaaaacacttttgtttactagaaataatgacttgagccccaactatatacctatttatcattaagccaaaaatgtagataaccttacaaatggcgtaaaatatctatacttaaataaattccaaagcaaagcaaacaaaagtatatgttgataatgcactatgctgcttcctaaataaattctaacaggctgagggttatagaggcctgagaaataaacacggagaacaaaacaaataaccctaacactccaaacagaggagcccagttagactcccacattttgtgtcttaacacttcattgattgttaaattatattcactcctgaatgaccccaatgtttctgcatcacaaatcttgccacttgctggaggctacaacccatatcttttctttttgagactgagtttatcatatctgtttttttgagactgagtttcactcttgttgcctaagctggagtgcaaaggcacgatcttagctcactgcaacctccgcctcccaagttcaagcgattctcctgtctcagcctccaagtagctgggattacaggtgcccaccaccacatctggctaatcgttttttttttgttgttgttgtttttgagatggagtcttgctctgttgcccaggctggagtgcagtggcacaatctgggctcactgcaagctccgcctcccgggttcatgccattctcctgcctcagcctcccgaggagctgggactacaggcgcccaccaacacgcccagctaattttttgtatttttagtagagacgggttttcactgtgttagccagggtagtctcgagagatggggtttcatcacattggtcaggctgctcaaacacctgacctcaggtgatctgcctgcctcgacctcccaaagagctgggattacaggcgggagccaccgtgacgggctatcatatctttatggaagggtttcagtgctggaagcaatgcactgtgctgtcaggcagaaggttcaggttcaggagcactgagggctgcatcctcaagccaggggcaaccagtaaagactcaggtgagattatgtttgatctctgaggagtgcctgtctcctcattcccacgaagattaagtaaagtctttagatttggggatggcaggaggttggggtgggatattgccagagacaacttgatagtggtcatattttctgttctttcatataaagaggtagatttcaactctggggggagctggaagaaagaaaatggctatggaaatactgagcatcattcatatagacaaaaagtctctccttgactgaactccactcaggttattttgaacttttatcaatgaagccctgacttgtgaactttcatgttcatctctccattgttgattttggcaagaatcctgctaagtcagtttagacagaattccccagcctccaaatctgatcatcctccaccatcccccaggtgatgatgtctgatcaccctggcctgtcttcagcaagaatcctgtttggctggtttaccagaatccccccttaccacccactggtccccctaaccctggctcctttgctataaattcccacttttccttgtcgtattcagaattgagcctgaattgagttctatacagaggcctcttgctcccattgcaatactcgagtaaaatctgtttttactattttaaccatggtctagctctggcttttctttgacaatatccacatatgacagatttaccaaaaataaaatctgtttttgccatttagtcatggtctagctctggctttctttgacaatatccacatatgacagatttaccaaaaatctggacactgggatagctataaacgacagatatatgagacatttggaaatcaggagaggggataaacagaatggagagaaggtagaaaaatacatacgctttttttcccccagtgattaaaaacacaaacctggtacaataccattaactgaattaaagtgtttatttgaatttcatcaatttttctcctaatattctatctctgttccagcatcctatccagaatcccatgtggcatttatggccatgtctccttagtctcttctaagctgtagcagttgccaagtctttccttgacttttatgaccttgataaaataccctccagtttgggtttttctgatgtttctcattattggaatgaggttatacattttagacaagtatactacaagaaaaatattagtgtaccttatcaagaagttcatggtgccactagatcttaatactagggatgtttatcttgatggcttacttgtagtaggctctaccaggtctctctactgcgaagttactattttctccttgtatttaacatatatcatggaagagataccttgagactaggcaaattctattattcctcatactttcacccactaattttagcatccatcattatggactcaaggaaatttattttattctacaggctaaaatccatcaccgaggttaattgcattattcattttcttgctcaaattgtaccagctttggttattaaaagctccttttaggttgcattctgtgtccttttgagaaatccccatctatttgggaggcatttccctattctcaggcacaacaaaatattccaagtaacatctttttttttttttctcccccctgctccagctttggaatcaaccatttctccaaagagtcccagttcattttactctacaagaatggtgtttagaaaccaagattggtctctagctgtactctctgtaatgaataacctcatgcgtgtttacttctacaccaccgcagatgcatcatgagggtagatccctaaaccgagactgccaagtccaaagatgtaggtaatcttgttagatgtgactaaatttccctacagaagaattgcaccaatttgcattaaggccagcaatgtatgagtgtctgttttcccacagcatcaccaacagaatgtggtgtgatattatttagttttcaccagtctgataagtgagaaatggtatctccatggtttttaaatttacagttctctaactactgaacttttttttcatatgcccaggggtcatctgtatataacttttgtgaatcatatgtgcatgtctccttcccataattgggtttttctattggatccttgaacctaagattttaagggtttaataccatagacatgttaaccctttcttgtgatatatgttgcaaatacacatttttttgccctagtttgtctgttgtcttttgactttatagtattttttcatgcaattttttagagtttttatataaaatccatcagtcttttgttgcatccagatttgagtcataattagaacgtttttctgtactaggattagagaggaatccagctatgttttctttggaattcttctgtcttttcctctagtacttagtttcatgtactgttcttcacagtgatttgaagtaacagatttttttttggtggtgatttcaaagctgtcagggttatccaaaactttctgagaattgctttaatatctgtactcctacttagaccaaggctaactccaatagtatatatttcacttggagtcactagtaagaaggaattatttgattgaagaattataatcctatctcttctgttccatgtctgcctctgtctcttactctctcgccccacagatgggaaactagaattcaaatgataagcctaattgggttaggagccaccatggaataattcccaacagcccattctttatttgagggtacactctcagctccatataccaaccttcattgtgaaggatgaaggccagaaaccacggtaaatccattcataggacttgcttccccattattagcaccatctgagtctgttaaaaatcttaactaggagtttaatttctctacagagggctttaaattaattagggatgtacatgctaacaaagagcctgatgcatccataaatcaatctggggtaggaggactagtcagggaggatcgtctattcagtggagaccgcatatccagcatccctgttgggttcccaacaaaagggtgcaggtgtggaataggccactgtgacaaggaagccccaataattattttgcatcacttaagccacagcaggtaatatggcaaatcaaagtcccaggcgctcaccaagtgaaacccatgttgccatgaaaagccacatcatatcactttaacctctataaatgaattgccataacactgtgatttattttataccaagcctaagaattaaaagggcattgatcaaaatgatctcctttttccccttttgttaagaatagaaagtaacagatggaaccacttttttttttaatgtgctgaacattatttagaacaacctcggaaattgctggtgtcttttattaaatatacttgctttaaggtttacgctcacatacaattatgttctttggatagaatgttacttatattccattagttaaacacagcactcatttgaaatccactttaaaactgcgtaacaacaactcccaatattcaaacacttccatgtgctagtaacctggtttctagtctttgattagcaaacatctgatgaacaaaagcaaccatggatccttttaaaacaattttgtattttatttgccataatatcatctatatctatatgacagtcatgagtgtatgtgaatgaaacaaaactttttaaaaaatctataaacaatgcccagtttcagtgtggttacagtctctcttgcaggaatttctttgtccatctaaactattcagactccaccccacttccccaactttagggttctgaagtccatatgctagaaaagcaaatacatttaattccatatagggaatattctataattaatccctctttaagctaaaaatgtgttattacataagccctcactaataaagttaagaaatcagtgattttaaaatatgaagcccaaaaagtctcatgatgacatctcaaaagttatcactgatttaagctacattatccaggcggcagatatttaagtttagaaatactggagtcaacactctaagaattttagcgacacaggaggttttgttttctatatatatatatatatatatatactcaagaaacttctgtaaaatgcatgttttccatctctccatccgtgatcacagcgttgtaaggcttacaatgactcaggccctacagagttcacagacatggcaagcaaagaaaagaaaacgaaaaaaggaacactctgtacaaaagatgagagatttaatcacattccctatactgaaggccctggaccaaaccatgaagatgaatgtgggggtgtggggaggggatccagtaatgtactgtccaagccattcatgtgcaaccccgcacagcttcactttacccccttaaaccacacagatgttctcagaatgcaaacatggattactgccagccatgttaaataacccttatcccatatcctgacctaagctctcaccccaactgtttggctactttcataccacaggtttgtaaaactgtggtctatatctgaggtctccactcctacaccagatattttctagtcgagacttccatactagggaggctatcatgaggcaccccaacaacacccatgggagtggtatcagggaaggccatgaagggagccaggacttccatcactgccaggtggtaatgagctccccatccccacaatgtaagtggagaccacctgggaagtctggacttccacctctacccagcagtaatgaagcatcagcccacccccaacaattccccgttggggtggtgtgagaggaggcctggtggagaggcaggatttcatcaatgctgagtggcaaggaggctgcctacctctcctgtcaacgtaggccaagtggatgacaatagcaaggcccttcttcccatcccaataggggtgcagggtagctgtggaagcctagtagggagccagaagtcccacacctgcccagcagaagttcccctttggtatcaatggaggctgataaagaacctggactagtttcccaaactggcagtaactaggcagatcctcccttttctcctactggagacgtagcaatagatgccaggcagagccgaaggtttaaataagaaccagggctgggagcagtggctcatgcctgtaatcccagcactttgggaggccgagcaggtggatcccattgaggtcaggagtttgagacgaccctggccaacatggggaaattctgtctctataaaaaacatgaaaattatccaggtgtggttgtggtgggacaatcctgtagtctcagctactcaggaggctgaggctggagaattgcctgaacccgggaagtggaagttgtagtgagccaagatcaggccactgcactccagcctgggtgacacaatgagaccctgtctcaaaaaaaaaaaaaaaaaaaaaaaaaaaaaaaaaaaaaaaggccaggcgcattggctcacgcctgtaatcccagaactttgggaggccgatgcgggcggatcacgaggtcagaagattgagaccatcctggctaacacggtgaaaacctgtctctactaaaaatataaaaaattagccaggcgcggtggcgggcacctgtagtcccagctactcgggaggctgaggcaggagaatggcataaacccaggaggcggagcttgcagtgagccgagatagcgccactgcactccagcctgggcaacagagcaaggcaagactccgtctcaaaaaaaaaaaaaaaaaaaaaaaacccaggtctctcctaatataaaccagcagggcctaagcatggtagctcattcctttaatcccaacactttgagaggctaaggcaggtggatcacttgaggccaggaattcaaaaccagcctgcgtaacatagggagaccttatctctacaaaaaatatttaaaaattatctgagcttggtggtgtcagcatgtagacctagctactcaggaggctgaggtgggaggatgccactgcactctaggctgggtggcaaagccacacagaccctgtctttaaaacaaaaccccaaaaaacaaaagaaagcaaaaagtaacaaaaataacaggttgagtataccttatttaaaaggcttggaaccagaattgtttcagatttggtttttttttttttttggattttgcagtttgtattacacttaccagttgaacatccctaacccagaaattcaaaatgctccaacaagcatttcctttaggtggtatgttggcactcaaaaagttttgaattttggagcattttcaattaaggattttaggaatagggatgtttaacctatactccaaaagtccaggtttcaattaaaaaaaaatcactcataaaacaaaaaaccaagatctctaagtgaatggaaaaagacaatcaatagatgacaacgagaagacagagatgtttgaattatctgatgcagattttaaagcagttgtgattaaaatgcttcaatgaatagtaatgaacatgtttaacaagtaaaaaccagaaatccttagcaaagaaatacaaagtcttagcaaagaaattaaagatataaacaagaactaaaagaaaatttagtactgaaaaattcagtagccaaaatatacaagtcaatgagtgggctcaatcgtagcatggaggtgcagtgaacttcacagacaaaagaaaatacacagtctgaatgaaagagagaaattcaactgaaaaaaaggaataatgaacagtgtctcaggaatgtgtaggaatgaaacagagggtttcagatttacgtcctcagagtttttgaggaagagaaaagagactgaaaaagaattcaaagaaagaatagataaaaaaaaaatcaaatttgacaaaatacatacagatttaagaaacagagtaaaccccaaacaggtaaacccagcgaactctgtgccaagacaaaccatcgtcaagcttctgagaatgaaagacaaaggaagtcttgaaagcagtgagggaggaatgacaccatacctacagggtaaaacacttgcattaggaatcttggagggcagaaggaagtggcacaccatttttcaaatgctgaaaaaaaaagaatgccaatcccagaatcctatacccagtcaaagtatccctcagtaatgaaggagaaatcaagacatctcaaataaaggaaaactcaagaaaatctgttgccagtagacttatcctaaaagaatgattaaagacgtttttttttccttttcttttctttctttctttgaaacagggtctcactgtgttgttcaggctatagtacagtggcatgatctaggctcacggcagcctcgaactccccaggctcaggtgatcctccccactgcagtctccgtagtagctggagactacaggaacacaccaccaagcctgcctaatttttgtatttttttgtagagacgcggtttcactatgttacccaggctggtcttgaactcctgagctcaggccatccatccgccttggcctcccaaagtgctgggattacagacgtgagccactgtgcctggccaaatggttaaagaaagttttctaaataaaaacagaaatgataaagaagtaaccaactcaaaacagattaaagatacaaatataagacctgaaaccataacactcctagaagaaaatataggggaaaagttccttgatattggtttggcaacaatgtttttaatatcaggcaacaaaagcaagcaaatgaggctatatcgaactgaaaagcttctacacagcaaaggaaacaatgaacaaaattaaaaggtggcctatggactgggagaaaatatttgcaaactatgtatctaataagggattaaaatccaaaatatataagaaataaaataaaaataaataaaaacctatgatgcttatttacacatacacactcaagaaggaatcttggaacatcgggggaaagaaagaacatggtaagaaaaaatataaataaatataatgggtttttattctcatgagtttctaaattatatttcacaactgaagcaaaaacaacactatgtgatatggttctaaatgtgtgtcaaggaaatctttaagacatttacattataagcaggacaggtaaaagggacaaagatttctgtactttacttgaactggtaaaatgatgacactgatatacttcttagttatgtatatataatgtaatacttaaaggatccactagaaaagctacataaaccgatacactaaaaaatactctaaatacatcaaaacagaatcctaaaacatgtttacatgcaaggaaaaaaagcacagaaatgaaaaacggagggaaaaatggaaggcaataaataaaatgacagacttgaattgtaatacatcaataattccattgaaagtaaatgatctaaatgtgctaattaaaatcatatttctctgggaggctgagctgggcaggtcgtttgagcccaggggttcagggccagcctcagcaacatggtaaatccccatctctacaaaaaaaaaaaaaaaaaaaaaaaaattagccaggcatggtggttcatgcctgtagtcccagctacttgggaggctgaggtgaaaggattgcttgaccctcggaggcagaggttgcagtgagccgagatcacaccactgcattctaggctgagtgtcaaagtgagactctgtctcaaaataaggataaaaatgaaaaataaagacagatttgtacttgtacagtggatttaaaaacatgacagacacaagtaagtgctatctacaaaaaactcacttaaaataatataatgatatagatagggttaaaagtaaaaggacgaaaaaagatatatcacactaacattactccaaagaaagctagagtgactatattaatatcaggtagacttcagagcaaagaaagtgacaagagaggtacatcataaaattataaaatggtctattcaccaagaagacatagtaatcattaatgtgcaccaatcaagagctggaaaatatgtgaaatggaactgaaagaactgaaaggagtaatagacaaatacacaattatagttgtagacttcaacactcttctcccaacaactgatagaccaactacacagaaaatcagcaggatacacaacaatagcattaaccaacaaataggatctattcaacatttatggaacagtctacccaatgtaattaatacaaaagtacataaaatacactaaagaaattcaatgcacatcttttctgagtgcccagggaacatttgccaagatagaccatatcctgagccataaaaaactcagcaaatattaaaaatttgaaatcatacggactgtgttctccaaccacaatgggattaaacttcgaataaaaaataagagaccagtaaaatatccaaacacttgaaattaaacagcacacttctaaataatttatgtgtcaaacaagtctcaagtgaaataaaaaatacatttgactgaataaaaatgaatatatgacatatcagaatttgtgggatacaactaaagcaatgccatgagggaaatttatagcactagattcatacattggaagagaagtctcaaatcagtaatgtaagttcccaactcaaaaacagaaaaagaacaactaaatccaaagatgtagaagaaaggaatgaataaatataagagcagaaatcaatgaaactggaaacaaaagcaataaataaaataaatgaaagtaagagcagattcttgaaaagttcaatcaagttgacaaatttctagcaagattgcaaaggaaaaaagagaaaagacacaaattaccaatagtaggaagaaaacaggagctatcactacagacacagcagatatcaaaaggatagtaagaaaatactatgaacaacactgcatacataaatttgacaactttgatgaaatgggtcatttccttcaaaaacacaaactaccataactcacccaataagaaacagataatttccatgaccctgttaataatattaagaaaattcaatttataatttaaaaatccacacacaaaagaaatctccaggcacagatggtttcactagagaaatctacaaaatgcttaaagaagaattaacaccaattttatacaatctctttcagaaaatacaacaagagggaatacttcccaattcattttataaaattagtattaccctgatactaaaacgagataaaggcaaataaaaaaactacaaatcaacatccctcataaatgttaatgcaaaactcattaccagcacactaagaaacagaattcagtaatacataaaaagaattatgaccaaatagaattcatcagagggacatgagaatggaaaaaaatatccatcttatcaacagtctaaaaaaatcaacatcaattgatgtgggaaaaagcatttgacaaacttcagcccattcatgatgaaaactttcagaaaaatgggaatggaggggaacttcctcagttaaaagagcactggccaaaaaccaaacaaacaaacacctcacaaactacagataaatggtgaaaaaagactgaaagttttctcacaaataatgagaacaaggttagactgtccactttcactaattttgttcaacataatgctgaaagatctagccattgcaatcaggcaagaaagcaaactgaagtcatacaggttaggaagaaataaactttctattttcagaagacattgtctatataaaaaatcccaaggaatctacaaaacctcctaaaattaataactatatctcacagaatcataggatacaagattagcacccaaaaatctactgtatttctatatattatcagcaagtatgtgcaaaacaaaatttatatttttatttttattttttttctacttttgtgttacattcagagtgtacacgtgcagggtttttacatgggcatattgtgtgatgctgaattttcaggtatgaataatcctgtcacccaagtagtgagcacagtacccaacaggtagtttgttagcccactcacccttcctccctgctctagtagtccccagtgtctattgttctcatctttacatccatctgtactcaaattttaactcccacctataagtgaaaacacaccatatttggttttctgttcctgtgttaattagtttatgataatggcctccagctccatccatgttgcttcaaaaaaacatgattttgttcatttttatggttgtgtagtattctacggtgtatatgtatcatcttttctttatccaatccaccactgatggacacttaggttggttccatgtcttcgttattgtgaatagtgctgtgactaacatatgaatgcatgtgtctttttggtagaacaatttatattcctttgggtgtatacccagtaatcggattgcggggtccaatggcaatctgttttatgttctttgggaaatctgtaaactgctttccacagggactgaactaatatgcattcacactaacagtgtataagtgttcccttttctcaacaacccctccaacatctgttattttttgacttttaaatagtagccattctgactggtgtgagatggtatcttactgtggttttgacttgcatttctctgatgactagtgatattgaacatcttttcatgtttgttggctgcttccatgtattcttttgagaagtgtctattcatgttctttgcccactttttaaggggttggtttgtattttgcttgttaatttgtttaagtttcttatagattctggatattagaccttcgtcagatgcatagtttgcaaatatcttctcccaacatacaggttttctgtttactctgttgaaagtttattttgctatgcagaagctctttagttaagtctcatttgcctattttttattttgttgcttttgcttttggggtcttcatcttaaattcattgcctagaccactatctacaagagtatttgctaggatttcttccagaatttttatagtttgaattcacacatttaagtcttttgtccatcttgtgttaatttctgtataggatgagagctaggggtccaatttcattcttctgcgtatggctagccagctattccagcatcatgtattgaataggattcctttccctattgcttattttttgtcaactttgtcaaagatcagatggttataggtgtgcagctttatttcagtgttttctattctttctcactggtctatgtgtctgcttttgcaccagtaccacggtgttttggttactgtggcactatagtatagtttgaagttgggtaatgtaatacctccagctatgcttcttttgctccagaattctttgactatttacgctcttttttggttccatatacattttagaacagtttttttttctatttctgtgaaaaatgacattagtattttgacagaaacagcactgaacctataaattgctttgggcagtatggccaactgtaataatattgatttttctgatccataagcataaaatatttttccatatatttgtgtgatccctgatttctttcatcagtgttttatagttctcctttagtgatctttcacctccttagctgtattcctcgatacttcattttttatggctattttgtaaatggggttgtattcttgatttggttctcagctagaatattattagtgtaaagaaatgccagcaattttttacactaattttgtaccctgaaactctattgatgtaatttatcagttctgggagccttttggtagaatctttagggctttctaggtatagaaccatatcgtcagtgaagagagatagtttgacttcttcttttcctatctggatgcctttttatttctttctcttgcctgattcctctggctaggacttccagtcctatattgaataggagtggtaagagtaagcatccttgtcttgttccgttcctcaaggagaatgcatccagctcttgcttgttcagtatgatgttggctgtaggtttgtcataaatggctcttattatattgaggtatgttccttcgatgcctagtctgttgagggtttttatcatgaagtgatgttggattttgtttaaggctttttaggtgattaagataatcatatagtttttgctttttgtttttatgtgatgaatcatgcttattgatttgcttatgttgaaccaaccttgcatctcaggaataaagcctacttgatcatagtgaattaactttttgatgtgcagctgaatttggtttgttaatattttgttgaggatttttgcatctatgttcatcagggatatcggcctgcggttttctgttttcactgtgtctctgcaaggttttagtatcaggatgatgctggcttcgaagaatgagttagggagaagcccctgctcctcaattttttggaatagttctagtaagactggtacaagtttttgtacttctggtagaattcggctatgactcaatctggtccagggctcttttgagttggtagattttttaccactgattcaattttggtgcttgttattggtctcttcagattttcacttttttcctggttcaatcttgggaggctgtgtgtttccaggaatttattcatttcctctagattttctaatacgtgtgcagagaggttttcacaatactctctgaggatcttttgtatttctgtgagattaattgtaatgtcatctgtgtcatttctgattacacttatttggacaatataatttttcttctttgttaacctagctagcagtctgtcaatcttgtttattcttttgaagaactagctcttggtttcactctttcttttttacaattttttttgcatcttaatttcattcagttcttctctgattttagttacatcttttcctctgcaagcttcgggtttggtttgttcctctttcctagtttcctactgccatgtcagattgttaatttgagatttttctaacttcttgatgaaggtgtttaatgctataaactttcctcttatcattgctttagctgagtcccaaagattttcataagttgtgtctctattttcattaattttaaataaagttttttgtttctgctttaactttgattttcacccaagagttattcaggagtaggttaatttccaggcttttgtatagttttgagagatcttctttgtactgaccaagaacactgttgtactgtgttctgagagtgagcctgatgcaatatagatttttaaaaatttattgatacttggaaagcacaatgtaaaagacaatgccatttataatcacacaaaaaattaaaatccaggcatgctggcatgcatctgcaatcccagctactttggaagctatagtgggaagatcccttgaacccaggagtttgagacccacatgggcaaattactgcgaccccatatataagtatacaataaatatttagatgtcaagctaacaaaacatatataagattgtatgccaaaactatacaatgataattagataaatcaaagataatctaaataagtgaacagaaagaacatacttatggattggaagacttaaagatgtcaattttcccaaattgatatttaaatttaatgccatttctataaaatttccagtgagatggccttctttgtctcttttgatctttgttggtttaaaatctgttttatcagagactaggattgcaacacctgcttttttttgttttccatttgcttggtagatcttcctccatccctttcttttgagcctatatgcgtttgcacgtgagatgggtctcctgaatacagcacactgatgggtcttgaatctatccaatttgccagtctgtgtcttttaattggagcatttagcccatttacatttaaggttaatattgttatgtgtgaatttgatcctgtcatcatgatgttagctggttattttgctagttagctgatgcagtttcttcctggcatcgatggtctttacaatttggcatgtttttgcagttgctggtactggttgttcctttccatgtttagtgcttccttcaggagctcttgtaaggcagacctggtggtgacaaaatctctcagcatttgcttaatggtaaggggatcaaatcaacaagaagagctaactatcctaaatatatatgcatccaatacaagagcacccagattcataaagcaagtccttagagacctacaaagagactcagactcccacacaataatgatgggagacttttaacagtccactgttaacattagacagatcaacgagacagaaagttaacaaggatatccaggaactgaacccagctctgcaccaagccgacctaatagacacctacagaactctccaccccaaatcaacagaatatacattcctctcaacaccatatcgcacttattccaaaactgaccacatagttggaagtaaaggactcctcaacaaatgtaacagaaaagaaattataacaaactgtctctcagaccacagtgcaatcaaactagaactcaggattaagaaactcactcaaaaccgctcaactacatggaaactgaacaacctgcgcctgaatgactactgggtacgtaatgaaatgaaggcagaaataaaggtgttctttgaaatcaatgagaacaaagacacaacacaccagaatctctggggcacatttaaagcagtgtgtagagggaaatttatagcactaaatgcccacaagagaaagcaggaaatatctaaaattgacaccctaacatcacaattaaaagagctagagaagcaagagcaaacacattcaaaagctagcagacggcaagtaataactaagatcagagaagaactgaaggagatagagacacaaaaaactcttcaaaaaatcaatgaatccaggagctggtttttcgaaaagatcaacaaaattgataggctactagcaagactaataaagaagaaaagagagaagaatcaaatagacacaataaaaaatgataaaggggatatcatcaccgatcccacagaaatacaaactaccatcaagaatactataaccacctctacacaaataaaccagaaaatctagaagaaatggataaattcctggacacatacagcctcccaagactaaaccaggaagaagttgaatctctgaatagaccgataacaggctctgaaattgaggcaataattaatagcctaccaaccaaaaaaagtccaggatcagatggattcacagctgaattctaccagaggtacaaagaggagctggtaccgttccttctgaaactattccaatcaatagaaaaagaaagaatcctccataattcattttatgaggccagcatcatcctgacaccaaagcctggcagagacacaacaaaaaaagagaattttagaccaatatccctgatgaacatcgattcaaaaatcctcaagaaaatactggcaaaccaaatccatcagcacatcaaaaagcttatccaccacgatcaagttggtttcacccctgggatgcaaggctggttcaacagaggcaaatcaataaatgtaatccagcatataaacagaacaaaagacaaaaatcacatgattatctcaatagatgcagaaaaggcctttgacaaaattcaacaatgcttcatgctaaaaactaggtattgatgggacgtacctcaaaataataagagctatttatgacaaacccacagccaatatcatcctgaatgggcaaaaactgcaagtattccctttgaaaactggcacaagacagggatgccctctctcaccactcctattcaacacagtgttggaagttctggccagggcaatcaggcaggagaaagaaataaagggtattcaattaggaaaagaggaagtcaaattgtccctgtttgcagatgacatgattgtatatttagaaaaccccatcatctcaacccaaaatctccttaagctggtaagcaacttcagcaaagtctcaggatacaaattcaatgtgcaaaaatcacaagcattcttatacaccaacaacagacaaacagagagccaaatcatgagtgaactcccattcacaattgcttcaaagagaataaaatgcctaggaatccaacttacaagggacatgaaggacctcttcaaggagaactacaaaccactgttcaatgaaataaaagaggatacaaacaaatggaagaacattccatgttcatggataggaagaatcaatatcctgaaaatggccatactgcccaaggtaaattatgtattcaatgccatccccatcaagctaccaataactttcttcacagaattggaaaaaactaaagttcatatggaaccaaaaaagagcccacattgccaagacaatcctaagccaaaagaacaaagctggaggcatcactctacccaacttcaaactatactacaaggctacagtaaccaaaacagcatggtactggtaccaaaacagagatatagaccaatgggacacaacagagccctcagaaataataccacacatctacaactatctgatctttgacaaacctgacaaaaagaagaaatggggagaggattccctatttaataaatggtgctggaaaaaactggctagccatatggagaaagctgaaactggatcccttccttacaccttatacaaaaattaattcaagacggactaaagactgaaatgttagacctaaacctataaaaaccctagaagaaaacctaggcaataccattcaggacataggcatggacaaggacttcatgactaaaaaaccaaaagcaatggcaacaaaagccaaaattgacaaatgggatctcattaaactaaagagcttctgcacagcaaaagaaactaccatcagagtgaacaggcaacctgcagaatgggagaaaatttttgcattctacccatctgacaaagggctaatatacagaatctacaaagaacttcaacaaatttacaagaaaaaaaatcaaacaaccccatcaaaaagtgagcaaaggagatcaacaacatttctcaaaagaagacatttatgcagccaacagacacatgaaaaaatgctcatcatcactggccatcagaaaaatgcaaatcaaaaccacaaagagaaactatctcacaccagttagaatggtgatcattaaaaagtcaggaaacaacaggtgctggagaggatgtggagaaataggaacacttttacactgttggtgggactgtaaactagttcaaccattgtggaagacagtgtggcgatccctcaaggatctagaactagaaacaccatttgacccagcaatcccattactgggtgtatacccaaaggacaaatcatgctcctataaagacacatgcacacgtatgtttattgcagcactattcacaatagcagacttggaaccaacctaaatgtccatgaatgatagactggattaagaaaatgtggcacatatacaccatggaatactatgcagccataaaaaaggatgagttcatgtcctttgtagggacatggatgaagctggaaaccatcattctgagcaaactattgcaaggacagaaaaccatacaccacatgttctcactcattggtgggaattgaacaatgagaacacttggacacaggatggggaacatcacacaccggggcctgtcatggggttggggggagcagggagggatagcattaggagatatacctaatgtaaatgatgagttcatgggtgcagcacaccaacatggcacatgtatacatatgtaacaaacctgcacgttgtgcacatgtaccctagaacttaaagtataaaaaaaaaattccagtgagatattttttaaatatatgcaggattattctaaaatatatatggaaaggcaaagctaaaactaatgtgaaaaatgaagaataaagtgagatgaatctactaaattccatgacttattatattgctgcagtaatcatgactgtgtgttatcagtggagggacggacatagataaatgggacccaataaagaaaccagaaatacacctgcatgaataagtccaactaatttttgacaaatatgcaaaagtaattccatgtgggaaaaacagtcttcaaaaaatagtggaaaaattggccatctataggcaacaaaaagaacttcaacctaagtcttataccaaatgtatcacaagctttaaattgaaactgtagatcttttagaaaataggagaaaattgttgagaactaaacctacgcaaatagttcttagacttgctaccagtagcacaaatccataaaagggaaaacctgggcatcatcgaaatgaaaacttttgttctgtgaaatatccatgttaagaggatgtaaatcagttatacactgggagaaaacatttacataccacatatactaccaaggactagtttccagaatatataatggactctcaaagctcgaaagaaaaaaaaatacaattcaattagaaaacgggcaaaaagacatgtagagacatttcaaagattatacacaaatgacaaataagcacataaaagatattcaatgccactaaccattagagtaatgcaaactaaaacgacaatgagatatcaatacataactaccagaaaggctaacaaaaaaacagtcataacacaccaaaggctgatgagtgaggatgtgcagaaaccaaatcactcatacattgttggtaggaatgtcaagtggtacagctgctctggaaagttaagcagtttcttaaataactaaccatgcaacttagcacactgcaatccctgggaattgatctcagagaaatgaaaacttatgttcgcacaaaaacctgtacacaaatgtttacagcagttttattcataaataaagccccaaactgaaaacaacccaaatgtctttcaataagtaaatgattaaaaagttgtggtacatccatatcatggaatagtatttggtgattaaaaagagaaacaatgcttcatgcatacaacaacttgaatgattctccaaagaattattctgagagaaaaaagacaattccaaaagattatatactacatgattccatttatgtaacattcttgaaatgagaatatgatagaaatgtgggaatagattaatgggtgccagagttataaagggcatggggagaaggggaaatggttgtggctatgaaagcacaacgtaagggatccatgtggtggtagaaatctttgtgttttgactgtatcaatgtcaactgataccatgattttggtatagtttttcaaagtgttgccatgggaggaaattgggtaaagggtcctctgggctctctctgtatgatttcttacaacttcatgtgaatgtacagtagttatctagcaatgaaaacatctgttaaccagctagagaaattattaacttttgcaagaagacactttcacttttcaagcaccttaaaatttagtgtattctagtgattattataattttatgagatttataaatataaacactagtagtcggtataaaaagcagcagttcaaataaaccggagaaactcaccatcttatatgcctgtactagcgattcaaccaacatgtaattgtattagaagctctgaggagtcttggtgagtagacagctaactttgcttaactactgttaaactttaaactcagtggagccagagtatttgtagtctctgtgtcacttggatgtactttgtcttttgatatagaaagaaaatttctgatttaattccaaagtatattttaaaagactgtttctacaaaataccaacatattttagtcaaaaattaagcatattgataattttctacaaacaaattggatcagcggctgtgttacagttgctaagggcaagctgacagtgactttactgcttttaaatttaatacacagttatgcacaaatatacattgatatgcataagtgcatatgcgtatacatgcatatacatatacacccgcatatatgatgttctcattagtatgcactcgggtaagaaagtgaaaatttttctaaggctcctttttttaaaataaaaactaatgaaagctagagaaaggtggcactagctctctttgaaaagggtttaaaagtggttatcctatacctgaattaatcactcacttaggctggtgtatttcagtttacacatcatgaagcaatagaacacagattagcaactatgatgtaatcctatgatttttacccaatggctgaaaaaaaaaatcttccaccacacaaagctgttgaaatgcatcttattccacacatacggtaggaacaatacttagcatcaggaaccaacaagtcagtttcctggcttcctgacttcttagtttaattacgtgtaggacaagcacatcctcctctgtgatctcacatctggcaagcacagctctcatgccaaggacactgatgttacgatttttatttctactattccaaggtgaacttctctcctgaatttccatgttcctactatctatccccgtgtttcctatttctggtaattatacacctcttcctataatcttttattttctgcagctttggtcttgctcacttttacacctaatactaaaatttaaattttatataactaaatattggtgctaatcatgtgaagtgaattattttaagaagaatgcattcatattcctgcattcacagacccagaaaataaagaggtaattattatgctagataaaagagctcgtggaagtatagacagatactagataacagattgttcataggtatatatgaaaaaaatattctagctccattgagttaaaatttaacagtagttgagcaaagttagctgtctactcaccaagactcctcagaacttctaatgtaattacatgtcggatgaatcactaatacaggcatataagatgctgagtttctccagtttatttgaaccactgcttctcataccatatactgcaggtgctatgagccaaaggttcatctcagaagcagtaaccaacagtaaaaagccgcctcacttacttgtgcacgaactctgcagtgtagctagagctgtgtgccaggacaacatgaatgatcagatgggcacaaaatcaagacactcaggttatgagctcaaaaattaggttcttctaaaaagtgtggctatcgaaatgacaaaagttaaaagtttcagaatatatgattattaggtgacacagatttccaagaattgagtgaaagcacttttccaggatgtccagagaatagacgaaatcagaatcatttgcagcacaggctccttgacaacagaaagctcttcaaaataagtgtaaaatccagcatacatgtgtcatgctttcctcttaattcattctgtcttccactcaagccactatcaatcactaggcaaaaggtatttggatgaaagttctccataaatactgaagaggatattttccttgtctgggccattgaagaatggcaaagataaggatggaaattaactagtgtagaaatcaagataattacacttgaaaagcagccttattatggatctttggaatatcatgaaaatcagaaattctgaaattgaattttaataataatcagaaaaaaaattgtgacaaatatgccaaggcaattcaacccataagagaagcctcttagacaaatggtactgaaataactgcataacatattgacaggaaaaaataaaacttagcttgtgatatagtgtatctcaggaaaacatggttaccaccttaacaaggaaaataagactgatagagtcaagattataaattttaatgcctgttagagaagtaaagccattaagaaacatacatcaattgaaacccaggaatggattccccggccacccagcacccacaaggaaataaagaggagacccatggcttccttctttctgggtaaaacgatggacagaagagaaggctgccattaataggagttagaagaaaccaggtaacgttttacaaaaatataaaggttcactatgctcgtgtgttggtttagaatccctaggcagttcctctacccacctgccaatgttttgccatggaccttcacagaatcttcaactggaaatgatgggtgagagaaagaagaacttctaaagtgtatgagcttcagtgaccattgaaagctaagagcagggaacaggaacccctgaggtatatatctgggcttccaataagtactaggcaggaaatactggtggctggggatgggtcagggagagctaagagagaattaccctcaggagccaaggcatagagcttcctaaagctggggacaaaagtaagagaactgaggcacacaagcgcttgacatcttcactgaatatactgctacagcctctaatgcagagaagagcactaaggtagaaaggctgggagtagaactaccacagtctgtaccacagaacacaaatataaatcctagacatggaacatctatctaaggattctggaaagtaaacagtagcagtggagaaggaaaccagaattagaagttccgctgaaccagcagtgagcctaccatttttcaccgcctggtatcaccgggtctagactcacagcccaaaactcagaagtatacaccagatgtggacagaataagctccagaagcagcattctttctagtccaaggagcaggaaagggagccccaaaggatcagagaagcagggacttacaatgtttagttttttcctagtttcccttctcttgttccctagccccagaaaaatctgcactgatggtggcagcagaaggatggcactcagatggcaaggtcatcacctaaagctctgaaggagggggaccttgttccttcccagaggagcttcaatcagaagagtaagaaacaaattcctaatacctttttccccctctctatcttctgactgttttgttccagacatagatgtaatcatgagaagtgggcagaagagaagaaaaactaatgttccagctttctagataaaagatcaggaaaggaggctccaatgaggctaaaaatgccagagagctccacaaagagagggaatcatcaaaggagcaataccataaagtcgtgcatgaagtactatgcttgcctctgagctacacctatgtggatctgatcataaacaccacaaagaagaccagagacgagatcacactggcctcaggtagtacacacatggaataaatccaaaaagtattgtgaacactatggaaagtcaggtgatattagagccacagcccacagaaggcaggtcagaacttgaggcctgaacctcacctggccaattgccagctaaaacaaaacaaatcaacattatcttttgaattaaagcaagacaaagaataccataatacaatatccaaaatatccagaatactgtccaaaatcactcaacatatgaagaacagggaaaatctcaactcatgagaagaaaagatcaacagataacaaccccaagatgacacagatgttggtttaaaaaaaaaacaaaaacagggctttaaagaacgaaatataaccttcttttcaaaagaagagcaaacagctgggcatgatggctcatgcctgtaatcccagcactttgggaggccaaggtgggcagatcatgaggtcatgagatagagaccatcctggacaacatgatgaaaccccatctctactaaaaatacaaacaattagccatgttttgtggtgcgttcctatagtcccagatactcaggaggctgaggcaggggaatcgcttgaatccaggaggcggagattgcagtgagccaagatcgtgccactgcactccagcctggtgacagagcgagactccatctcagaaaaaaaaagagtaaactcttgaaaaagcggaaagatagaatgtctcagcaaagaaacacaaaatacaaagaaaaatgttaaaactgaaaaattagagaaagcaaagtaaaatatttactggattgagaataccagaatggagatgatcaagaatcaattaatgtgaaaatatatagataggcattatccaatatgttcaaaagagaacaaaaatgaagggcaataataaaagttatagcatttatatcaacagcctcagaaagacaggagaaaaagtgtggtgcaaacatacatgtatctgaagaaataatttggtgaaagacaaatttgctgattcaagaaactcagtgaaccccaaacaggataatttcaaagaaatctatgtccaaacacatcataaccacactgcaggaaaccaaagaaaaaaataagaatatattgaaaattgccagagaaagaaactggggaagaataactctaatgactgtaggtttctctttagaaatcatggaaactagaaggaagtagaacatttttgaagttctgaaaggaagaaactaccaacaagcttttagaaaataaaacttgtaacaagttttgtttcattgtcatcaaaaagtaaaaaataattaggattcaggagctctatgccaacaactatcaaatattgctgagagatattaagaaagacctaaatgaacagagatttacatcatatttgtggattaaaagattcaatattttaagatgtcacttctgcccacattgatacagagattcaatgctattattaaaaagtcactggaggtagtgtgaggaaattgacaagctgtttccaatactgacatggaaattacagggacctagaacagcaaaaatatcttggaaacgaacaaagttctttttttaaaatcttattacacaatcaaaataatcaaacagtgtggtatttgcaaagcacaaacaaacagaaataaaagaagttagagtccagatattgagttgtgcatgtagagacaaagggttttcagcaaaggaaccaagaaattcaataaaggaaataaattcatttcaaaaaatgatacaaatgtggatatctacatttaaaaaaatacaacttaacccctaaacacacatcatagataaaaattaagtcccaacagatcatggacctaaaacataaaatctaaaactataaaacttgtagaagaaaacacaaaacaatattttttgtaaacatagggtaggcaaacgttcctagaatacagaaagcataaactagaaaaataaatagagttttaatactagactgcttctgttcacctaaagacgccattatttaaaataaatatgcaaaccaaagaatgggggaaaaattgcaacacatattttgacaagagacttatattcaaaatatgtaaagaactcataccactcaatgatttctttaaaaagcagtcacctccctcaaataggcaaaataatttaacaaatacataaatggacaataagcacatgaaaagtactcaacatcttttatcatcaaggtaatgcaaattaatgcctgagatataaatacatatcaattacactggctaaaaataaaactgactatttcaaatgttaacaacaatatcaatcaaccaaatctctcatatatttctagtggaaatgtaaaatggaacagctactttgagaaacagaatggttcattattttaaagtaaaacatatacgataataccagcaatttcactcctaggtatttatcaaagagaaataaaaatatatgcccataataatgacttgcacatgaatgttcatagtagcttaattcataccagccaaaaattggaaaccacccaaatgtataaatgtgtgtatatttatacaatgaactactaatcagcaactaaaggaaggaactacttactaatttatataatgacatgaatgaatttcaacaacattatgctgtgtggaagaattaagacacacaaaaaagcatatagttcagatttcattcatatgaaaccgaagacccaacagaactaatttgatccattcaatgcaattcctatcaaaatcccagttggctttttttttctttcttttttttttttttttttgcagaaatgaacaagctgatgctaaaattgatatggaaatgcagatgcaaagagcttagaatagaaaaaaatctttaaagaaaagagagaacacacacttctcaattccctcaattctaaagtttactatagtagtatttgtgttatttgattactacagtaacctagagagtttgttactggcacacagatagactaatagatcaatgtaatagaattcaaagttcagaaacaaaccttcacgttcatgttaactgatttttaaaaagagcaccaaagcaattcaataaagacaaaaatattcttttcaacaaatgatgctaggatgattagatagccacatgcaaaagaatgaggttggacccattccttaagccacacaaaaaaaataattcaaaaaagaccacagacttcaatgtaaggaagggctaaaactataaaacttttacaggaaaatcttcatgactctgggttagttaaagccttcttagagattataccagaagtaaaagcaacaaaagaaaaaccaaattgaaattcttcaaaattcaaaacattcatgttttaaaggacaatatcaagaaagctaaaagaatgcctacagaataggagaacatatttgccaatcatttctcgtaacagactgatacgtttacaaaaacaactgcacaagaatttcatagcagccttatttgtaatacgccacactgcaaacagcccaaatatctgtcaaaaggaacgtggataaacaaattgtagtgtattcataaagaaacataccactcagctattttttaaaaaccaagctatagttgtccccgcttatccacagggaatatgttccaggaccctgaaaccacatgtagtaccaaaccctacatatactatttttttcttataatacacatgtacttatgataaaatttagtttctaaattgtgcacagttaagagattaacaacaataataaaatagaatcattacaacaatatcctagagtaaaagtaaaataggtgttccttggaaacaagcactgagataccatgatagttgatgtgataaccaggctggctactaagtgactaacaggcagtggtgactacagcgtgaatctgctggacataagaatgactcacatcgtcagacagcacaagatgccatttgatttcatcacgttactcagcagggcacacaatttataacttatgatttacttacaggatgttctactcaaaattttcagactacagctagacacagataatagaaatggcagctactgaaaccttagataaaagaggactgactactgtaccaagacacacaaaatatagatgaatctcaaaaacattaggttgaagtaaagaagccagacacaaaagagtacacactgtaaacatttacataaagttcaaaaacaggcaagactgatacatatattacataaagtatatcaatgattgtttatgcagtggtgggtatgtggctgacaagagttaaaagagaatttattgtggtgataaagatattctatacctggatcagggtgttgtttcacaagaccatataaactcatcaaattagacaatgaagacatgcatttcaccacatgtaagttttacgacaatttcttaaagtaaaatggaaagaaagtatcatgcttcatggtgtcctatgcttctccgcctcatttcaaaaacaacacagagacatagaaggccattccagccacaagaggaactaggagattctgcgcttaagaaagttgaaggagaactacaaaccactgctcaacgaaataaaagagaacacaaacaaatgcaagaacattccatgctcatggataggaagaatcattatcatcaaaatggccatactgcccaaggtaatttatagattcaatgccatccccatcaggctaccaatgactttcttcacagagttggaaaaaactactttaaagttcatatggaaccaaaaaagagcccacattgccgagtcaatcctaagccaaaagaacaaagctggaggcatcatgctacctgacttcaaactatactacaaggctacagtaaccaaaacagcatggtactggtaccacaacagagatatagaccaatggaacacaacagagccctcagaaataataccacacatctacaactatctgatctttgacaaacctgacaaaaagaagaaatggggaaaggatttccctatttaataaatggtgctgggaaaactggctagccatatggagaaagctgaaactggatcccttccttacaccttatacaaaaattaattcaaaatggattaaagacttaaatgttagacctaaaaccatcaaaaccctagaagaaaacctaggcaataccattcaggacataggcatggacaaggacttcaggtctaaaacaccaaaagcaaagataacagaagccaaaattgacaaatgggatctcattaaactaaagagcttctgcacagcaaaggaaactaccatcagagtgaacaggcaacctgcagaatgggagaaaatttttgcaatctacccatctgacaaagggctaatatccagaatctacaaagaacttcaacaaatttacaagaaaaaaaatcaaacaaccccatcaaaaagtgagcaaaggagatcaacaaacacttctcaaaagaagacatttatgcagccaacagacacatgaaaaaatgctcatcatcactggccatcagagaaatgcaaatcaaaaccacaaagagaaactatctcacaccagttagaatggtgatcattaaaaagtcaggaaacaacaggtgctggagaggatgtggagaaataggaacacttttacactgttggtgggactgtaaactagttcaaccattgtggaagacagtgtggcaatccctcaaggatctagaactagaaacaccatttgacccagccatcccatttctgggtatatacccagaggattataaatcatgctgctgtaaagtcacatgcacacatatgtttattgcagcactattcacaatagcaaagacttggaaccaacccaaatgtccatgaatgatagactggattaagaaaatgtggcacatatacaccatggaatactatgcagccataaaaaaggatgagttcatgtcctttgtagggacatggatgaagctggaaaccatcattctgagcaaaccatcgcaacgacagaaaaccaaacactgcatgttctcactcataggtgggaactgaacaatgagaacacttggacacaggaaggggaacatcacacactggggcctgtcatggggtgggggaagcggggaggaatagcattaggagatacacctaatgtaaatgacaagttaataggtgcagcacaccaacatggtacatgtatacatatgtaacaaacctgcacattgtgcacatgtaccctagaacttaaagtataataattaaaaaaaaagaaagttgtcttctaaaattcttgccttatttgaaaatggaacaaaccagtataaaatctccatgtttcctggaagaatgctatctctgcctccggtatctgacttggaataaaagaagggaggaatttacctaaatctaagtgtcggcagtcctggagtcagcaggggttacctggagggcagagtgctatacaaaaagaatacgatctttgggaatggtatttttccttgaaagaatactaggaaaatctaaaggtttcaaaccattccaacttttgaaagatagtttaaagttggactaaatcagctatataaatccacagcattattctgaagatttctttgcaaattcctagaattttatctctttacaagtgttttatctgttggaataaaaaagagggtgtttaatttattaacttggttttatgtaaccttttgctcaacagaagttattgctttttacaatatctactctctatcttttaccttcacagtttatgaccctagtgtcaggcttagacgtgccttcactaaccccagatcataaaaatgaaaaaacatattctctaaaatttcccctaggaaagctaatattttcttctactttcttgtgtcttcttttctgatggtattatggttttatttttaatttcagcatttttatttaaattttctatcagattgatactgataaaatattttaaatactcacaaaatgagacatcagttaataccattcagatttcacaatttttaaacagttttaggatatctgcttcatcaaaacattaaataaatggacataactgaagactcccccccatcagaggtatccaaatttggcgtgtgttatttccatacatgttagatttttttatgttgtttttcacatccgccaagttcacacacacagatcgacttcattttaactgctggatattatttcactgtttgaagaaatcagtttattcatttgtcctcctgaggggccttgaaattgtttgactttctcatttttagaaacagtgctaaagagtaaatctttatatgagccacgtttcgcatatgttagtgattttctaggactgaaacatgtaagtgggattgctgggtcacaggctgtgttttggcttcaagtttactgggaaacagaaattaaaactcccactgacaatgtagaatttccatttctacatatccttgcctactgatgttttcagacttctaaagttttcccaaataaatgggcatggggtgctaacccagtgatgttttgacttacaatgtgcatttctctgaaagagaaatttcaatgtttattggtcatgacactttcctaccagctagctttgcatattttacaagtcttttatttatccaaaatttacttttggccatggtgtttgatagcaatgaaatggtatcatttactatataaattgtcacagcaagccaggcatggtggctcacacctgtaattccaccactttgagaggctgaggctggtggatcccttgagccaagcagttctagaccagcctgggcaacatggtgaaaccttatctctacaaaaaaatttaaaaaaaaatagccaggcatcgtggtgtgtgcctttagttccagctacttgggaggctgaggcaggtgggtcgcttgagcccaggaggcagaagttgcaatgggccaggttgtgccactgcactccagtctgggtaacacagccagactctgaaattagatagatagatagatagatagatagacagacagatagataaagatagatagacaggcagacaaaaattgtcagagcagccttttaaaattgtccattttattctcactaaattgtaattctacttccattatatattcctatatatgtgtgggtctacttcaaggtttttcattctgttctctagtttacttgaatatctttgtcccaacatcacactaatttgctttaccttcaaaataaatcttcaagtgtagtgggacaccatatccttccattatcttcatttataatcatgtcatatgtatttaaacttatatattttcatagtaatatttgtattagcttgccaaatgctgtgaaaaccttcttgggattctcattaagattatactgaaagcataaatcatttgggggtaagctgatatctttatggtattccatcttcccttccatgaatatgccatatatatatatctctttttatatccattaataattttctccatcaatatctcatacatttcttcttagatttattcctatatgccttttttactattttaaatattatagtttaaaactatattttctaagggctgatgattgatatgtaggaattctattaattcattttatatacagcaatcttctaaattttgactaaagattcctttagattttctacttagacaatcattacttgcaaataatctaaactatgctttttgcccagctcttatactacttttcttactccagtagctaggatcagaagtacaacaataaaatgaggcaatgacagaaggcgttctagtctggttatggtttttaaaaggaatatttctcacatttcatcattaagtacaatgtttactaaagattcttagtggggatatcctttatcaatttaaggaaatttccattttttaaaaaaattataaactaatattacattttatcaaatattttatactatgtgtgttgcgggaagtcagggaccctgaacagaggtaccagctggagccgaggcagaagaacataaattgtgaagatttcatggacatttatcagttcccaaaattaatacttttataatgtcttatgcctgtctttactgcaatctctgaacataaattgtgaagatttcatggacatttatcacttccctaataatactcttataatttcttatgcctgtctttactttaatctcttaatcctattatctttgtaagctgagaatgtacatcacctcaggaccactattgtacaaactgattgcagaacatgtgtgtttgaacaatatgaaatctgattgtaaaatatgtgtttgaacaatatgaaatcagtgccccctgaaaagaacagaataacagcaatattcagggaacaagggtgactgcttgcagggtcaggcagaatacagccatatttttcttcttgcagaaagcctataaacggatgtgcaagtaggagaaatatcgctgaattctcttcccagcaaggaataaccctgggtaaggaatgcattcctgggggtaggtctatagactgctgctctgggagtgtctgtcttatgcggttgagataaggactgaaatacgccctggtctcctgcagtacgctcacacttactaggattgggaaattccagcctggtaaattctagtcagaccagttctctgctctcgaaccctgtttcctgttaagatgtttatcaagacaatgcatgcacagcaggacatagacgctcatcagtaattctaattttgccttctccttgtgatctttattgccctttgaagcatgtgatccttgtgaccttctccctgttcatgcaccccctccccttttaaaatccctaataaaaacttgctggttttgtggctcagggttgtcatcatggtcctaccaatatgtggtgtcacccctggagacacagctgcaaaatttctctctttgtactctttctctttatttctcagaccaactgacacttagggaaaatagaaaggacctacagggctcttttgggggctggtttccccgatatatgtgtattgagatttgttttcccctttaatctattattactgtcaattatattaatgatttttccaatgttaggcagtcactgcattcctggaataaataccactttaaataagccttataaatgtgggctggtacacagcaccaagatcttggtttcaaataactctgtccattaacaggaaccaggtgaccttggaaaaattgctgattctaagacgggggtaagaaatacccaagataagcctggagcatcttacaatgccagaaagaaagaagaagtgctaagagaaaaaggaaaaacaacaacgacaacaacaacaacaacaaaaaacaagatgggagcatgtcaaaaagaccaaaagctaggataaattgagccaaaaaataaagcagtactgctttacaatgcaaagtataaaataaataccaatgcagtcatataaataaatgattgaataaataataaggaagaagagacaaacatcccatgcaggagaattcaaaataatttctgtagatattccaccctcaatgaagtggagcatatttcccatgtccataagtatgcgctacacatagtgacttcctcccaaagagtacaggagagaaagggtggtggggtggcaaagagtaactttacagcagagaaatctgacagacactacttccgccaaatgaccaagattcatctcaacagtgacaagctgggccaggtgtggtggctcatgcctgtaatcccaacacttcaggaggccaaggcaggcagatcacttgagcccagaggttcgagaccagcctggacaacatggcgagaccctgtctctacaaaaataacaaaaattatctgggcatggtggtttgcacctgtagttccaattactcaggaagctgaggtggtagaaactcttgagcccggcaggagaggctgcagagagctgacactgtaccgctgcattctggcctgggcaacagagcgagaccctatctcaaaacaaaaaaacagtgacaagtcatgttgataatatatacttttgatatggtgtgataaaaaatggcaatttaactcatggtttacttcccaaaaatatacccaaatctaatcgtcagaaaaacatcagacaaatcccaatgagacaaatgccacaaaaaacctaaccagtacttcttaaaactaccaagttgtcaaaaacaaggaaagcctgagaaactgtcaaaaccaagagaagctttaggagtatgataagtaaatttaatgcgtttcttggattggatcctggagcagaaaaaggacactacagaaatctggataaagcatggacttcattaatagtgtatcaatattagctcatcaactatgacaagtgtaccatgctaatgcaaagtattcataatagagaaaactgggtagaagatacacaaaaacactctagactatatttgcaatttttctgtaataaaaagtgtttattttttaaaagtgagttgaggatctcattttctattttcaggactagtttgcgtaacagaactttcaacagaaacgtataagcagtcaagtaattgatgcaggttgatatgagcatttgtaatatggtaagggtagtaataaaggctgcactgttcattaaatgatgtcgaaaaattagctattaatttggggaaaaatttctctctgatctctacctcatgtcaaaataattccatctgaaatttgcaaaaaattacattaaaaaactataaaagttctagaagataatgagaatgaataccttcatactcttggggtaggatggaccatttttatgcataccaatattgaagacaacactgaagtgttaaggacagaagaggcctctcagtaaactgagccagtgatatttcagcacaagctgaaacaacctcccagaatgaacagaaatataatctcagagagtttgtaaaaaatactgaacagtaagtatgaaaaacggtggtggcatttatttcctggaagaggaaattaagaacaaagaaaacaaatataaaacatctagtatgctgaggaaagttgccaaaaataaagatctgagttaacagaacaaaaaagcagacaaaattgactaaacaaacaaacaaacaaaaaaacagtgaagtaacatgtccaagctaacattacttaggtaactactggtggggatggactttggatccaggctggtctcactttcaagctcgcattacttctacttctacatatgcgctcacttagccattaaaaagaagtcatcttctttttagaagaaaatgcagtgtggtaccctgtactggatcccagatcagaaaaggaacattgctagaaaaactgctctaataaagtcttaagtttaattgtagtagtataccaatgttaatctcttagttttgacaattacatcatagttatgtaagatgtttaatgctaggggaaacagagtaaagggtaggcaggtgtgtaacttttctgtaaatctaaaattatttcaaaattaaaagcttattaaaaaataaaagaaatctcagccaggtgtggtggcttatgcctgtaatcccagcactttgggaggtcaaggcgggattacctgaggtcaggagttcgaaaccagcctggccaacttagtgaaaccccatcactactaaaaatacaaaaatgagctgggtgtggtggtgagcacttataatcccagctcctttggaagctgaggcaagagcatcgcttcaaccaaggaggcagaggtcgcagtgagccgagaccgggccactgcactctagtctgggcaacaagagtgaaactccatctcaaaaataaataatataatataatataatataacataatataatgtaatgtaatgtaaaataaatctctcaaaatgctgctttgggactatcttaaaacttgtaagtgtagagatttattgcataaaaccaaattttaaagaggcatgctttgtattgaagattttgattataacaggtttgttgatgactttaaaaataaatatcagcctcaatttaattatatagcttttctgtaaagactgcttacataatttcttctataccatttttcctttcatgtgaataaaaatataaaaaaaactgtaaacagtagtctctaaatacacatggtgatctagttgtgatgaactgttttccatttctgctacagacgtaacaaaagttctgtgaaacaaaccttgtaacagcaataattaaatttaaaggattaatagaacagcctgattttttaggagctgtcagatactgaaagaatcaggacttcagaaataaatgaattctaggagcagaaaagctgaagcatataattaaatagaaaagtcagaagagtttgactatgcaaaggaacagggagaaatagttactgaggaacagggagaaaaactaaaataaattaatgaaagtcagggctcatggtgtctccaaggaattgaaatgtgacaaatcatggaatgggaagggagatgataagaataaatatgaatagtattaagttcaatcacttaatacttaggccttgttagaagccctccaatggttcccatctctcaaagcatgagtcagggatccgttgagaccttgagggtgcacccattcccccaaccctccctacccccccaaccccatcacttttttctttctcttttactcttcaccttctcccctcactcctctcaagccagccctgcccgcatgcagtcccctggcactccaggcctttacatttgctgatacccctgccagaatccccctcccccagacatccccatggtaaaaactccttcacctacttcaggttttgctcagatactaacttttcagtgatttactactatgcctgttctattttatttatttatttagagacagggttttgctctgtcacccaggctgggatgcagtagtatgatcatggctcactgcaacttctgtctcctgggcttaaatgatcctcttgcctcagcctcccaagtagatgggatcacaggcatgcaccaccacgcctggctaattttttatatttctgtagagcagggttttactatgttgcccaggctgggctcaaactcttgagctcaaatgatcctcctccaatggcctcccaatactatgcatgttctattttaaatggtgagctcctataactaccaaactcccctaccctgctcttttattttctcatagctgcttctatgtcctaacattttaattacattgaatatctgtctcaccaatcactagactgtaagctgtcagattttgcctgtgttcactctttctccagtgcctagaatagtgctgggcacataataaatggtttttttataaacatttgcctaaccaatcaatacaaacgtgtgatttttcattaccataattaaaattagaataatgaaacattcgtaacttttccaaagtcattttttgagcaactgggcttgtccttgtgcctgtgttttctgggtattttctacactgaacttctataatgttttaaaaaggggttttgtctttgtaaaagactagacagctgtctgagatcatttcaactcaagtacattcaatgtcagagtgagaaagaattaaagttcattctttcaaggcctgttcttcctgtgagcttaaatgaaatttagttattacctgaaagagattcatatcacgaaaacttcacacgggcaaatgctcaaaatcatgatccactaagttaaaggaatcacaaaattcccaccttcccattttaaagatgaggaaactgacctacgaaagttaagttacttcctcatattcaactagaacgtcgctgacgaagtggtgagcaggagctagtcttaaacaaaagactgaaacattacagaatgacctagcccatcaacattttgaaatgcagtgaaaagtccagattggaaatgctcagtccaccatccaactaggcctttattttctccctcttgtttccatttcattgctcaaagatgcttgtgaaagtttccttatttatttgtttgtttttgggagacagggtctttggagtgcaatggcacaatctcggctcgctgcaacctccgcctcccaggttcaaatgattctcatgcctcagcttcctgagtagctgcaattataggtgcccaccaccacgcccagctaatttttgtatttttagtagagacagggtatcaccatgttggccacgctggtctccagctcctgacctcaggtgatctgcccacctcggcctcccaaagtgttgagataacaggcgtgagccaccacacccagccgtgaatgtttcttcataccatttgaacattcaagattctttctgcattaagatccctagcaaaataaacactgtgatcaccttcctaagtattttagcatgttcaagggccactgtgccttccagaccccactcaacatttggcatcttactctagccctttgatttccctgttgacagaagtatgaggccagcatattttacaaatgtcttacccttttcagtggatggcctgtcaattaactctcatgaaatcaaatggaagcagacttcagggtataaaaatgtactacttatctaattcttttactgaaagcttgcacacattccattgtttttccataagtggaggaaaaaataaatctggtgctgtattttcgtttcagaagtagcaacagcagttactccacgcatgcattccccaggtccccagacagtcatctctgatgttataagaggcacagaggcagatacttcggcaaagacagtctataaaatgaagttgctatggaccaaaataactgtattgatttttagtacaattcaaaatacaaggaaacatcagttttccaaatggcacaagctgaaaaggacaaggaaaaatatattgcaaatagtgaagagaaggaaaataataaagacaattacattagcaaacatcttggtgttcttttttcagaacactaagatggctgttgtttgttttttaagttcaaagagctgagaggtttgaattatgttgaactgttgctcatttgtggacattgtgcccactgctggaagtctgaccttcagaaaacaaagccttataatccttggacatgtgaacatcttatttaaagcctcatttttttttcaattaatatctctcactctgatggcaaatggcagagctgtataaattctattataaatacatcatttgccaaaatatcattaagtttgctgcaagcaaatattttccttagatatccttaatgaggcaaagtagctttcaagccagagacctctggatgttgtggaatgaggggacggcagtcaggacttaccatggccccctcacttgttctttgggcaacttctcgctgtagtcgggccactgccaacttctccctgaagaaacaaaaacacatgattagttgaccattctcagggtagaggtgacactggcatggccgtgaaacattcttttgaggtctctagaggaattccttccttggtttagctcacttcctcctctatactttctataaatatttaaactgattggtcatgaatgcattgttttcattgagtgtcatgaaatttgccatagattttacaatagccaaataaacgttaaatggtgagtagatgctttgcttttagttcattaacatatatcactcacaaataaatttttcatggctatagtattttagttgacttttctctatcaactttgcttaagcatttttaattatttttatttcttttgttgctctccacaccaataatattaagaagcaaacaaaatataactccttactacttttaaaataacaatagaaaatcatttgcatgcttgctacataacaggcatcatgctgggcaatgcacctgttctcatttgagcctgacaacaatcccatgggtgatttcattatgcccattttatagatgaagaaactgaggcccaaaaaggctaatacactgagtcctcagctggtatatagtagttttttggaatcaaattttagatttccttacttcaaagcctaaataaaaagtctgcttatcatttcttcagtgtgtaggtaatataaaatgtagacttaaaaatcagattatttatttattttagtactccttatttaacaatggggttcatttttagatcccttataattctgctttcacttaaaatatatccaatattcaccaaaatttttagaatacttttgtaaagtgatagatgactgcattttggacagcttttcaattgttctttaaaataattgattagatgtcataggggtaagtgaattcttctggtaatccctaaaatgttagctttagtaagtatttcccctgatattcttctactactatactactatcaagatgagaaattatttgagtgacatttcatcccttagtcttctctttgcccaggatcagctatatgcaatcagctatatgtaaacataaaggatgcagttcaatccccagaaaattttcccactggggaaaagagaagtgaaaacttcttctctcctaagtgcttggatctttgaaatgcctaggactaccaagaagacacgtgcttttgtttggttgcagctgggcagtcttttagtagaaatagttctctctgaataaatacctaaaggcacagactagaagaagggagactagactaggagacattccaggtatacaagttttgggagcctgtggcagcacctgtgagtacacttctaagaaggggcaacagagtagataggaaggagccacaaagggatggaagccatgtagagaggccaagtaatcaaggcagaaagctcctgtgtgttctctgactcaagttctgatgaacagatcaaataagttcaatgaaaagaacaaattaagggaacaaataattgaaaaagaaggatatgaatgaattctgttttaatatgaaaattaaacacatgaatttatctcttctctccccagaaactgttaaaaatgtagtatagaggtaacactggcaaatacttataaagtcaaagaaaacaggagaatcacatactccatactctatgaaccagcaattccactctgagctctaaactgaacagaactatatgttcaccaaaagacatgtaccagaatgttcataacagcactttagtaatcttataagctgaaaatgcacacacccattaacaatagaatagatatgtcaactttagcacagttacatgatggaatactatacaacactgaaaaggaataatctacacttaatcacaacaatgtatggaatactgcaaatatgctgttgagtaacagaagcaagtacaaaatgtatatactttatttcctatttatataaagtgcaaatagaagcaaaactcctataccatttgataagacaagaaaaagaaataaaatacatggatatcaaaaaggaaggggtaaaactgtctctatttacagatgacattattttctaagtagaaaatctgatgaaatttactacacaacttataagtgaatttagcaaagtcagaggatagaagccgatgaacaaaaattaattatattttactagcaacaaacaattggaaaataaaattttaaagcatctccttctaataatgtcaaaaattaaaacatttagcaaaagatttgcaagacggccacactaaaaactacaaaacactgctaagaaggattaaaggagactaatagaaacatatatcacattcatggattgaaagacttaatattattacactgtcaaaatctgtatcaaataaatctataaattcctattcactgatacatataactctaccaaataaagagcaagactaggtaacgagaaacaagaaatccaataaataattggatttttttttcttttcttggtaaaaagaagctcctggacaacagctgtgtaagaatccagagaataaccaatctggactgcagcaagaggatggagagcctcaggaggatgactccaagaataaaacaaagttgaaccaaaataaattacctatgtgttcgtaagtattgagaagagatgtagagttttattttaaagcttaagaacaagaaattggaacatgaaaacgtaagccaatggcaggaagtgacaattattcatgctagtaaaaacaaagttattctagaaatgcaattctaaacttctactagactcagctgtgaatgacatttatcattttaattattaactaaattaatttactatttagtgaaaaaagtagagaaagggaagcacagagaaacagttggtacagaaacactaaattcttatcttccataatagaaagataatacataatgtttaaaagtgatatagaaacagaagttcaggcatataattcagatacaaggaggcaaaacttagaaggtagatctagaagaaggagagtggctgtgtcggaggagtaagatgcagaggtagggaaggcagtgtgtacatcttacagatgttaccattgcatttgatttccaaagtatgtgcatgtactactttgattaaaaaacttcgcaaaacatgtatttttaaaaaccaactggctcatgttatttttattaaaaacattataataatgcattactagaaagataaaggatagattattcaccaaccgaagattcagcatcaaatgactcattgcctcggacctgagaggcacctattgagaagctttggtaaattaaggcaaaataagaagtcactataagcaacgagtctttggacaaacgtttttaagtacatactgcaaacagtttaacatgttacagagatattttaaatttaaaagtttctctttacttttgtaatgaagtataaagtacgcagaaaaatatcataaaagcacaggttgctgaataatcacaaagtgaacatgtccgtattagtcccacctaaacaaaaaaacagaaacactgccagaacaccagaagctactttgatgctaatgataattaacttcctacaccaatacctgaattcacttgccacactcttttctctgtatactgaaacatggagatatttaacttctcatctaaagtatattaaacacattgtctcatattttactcgactgtttattcaatatatttttcctctaaataagaccataaattcctccttgaccacaacagtagcaaccaaaaatgatgatccattcatttttgcaggtggtcagttgtggcgtagttagtatcttactgtaacagccggttgcctgagtggagattatatttagttcatctctttaacactactaaggccccttagtaggaacaaaataaatatttgtgatttgctgaatgaggaatcagttacagaatctaataccaacttgcctggcataacagaattttaaataatattaccatcttgcatttacatagtacataacgcaggtacactgcacacatataccctgattcccacagggtatcctctggttctggttaaccacaaaagcttttttacatacattctaaaattacgaaaagtacaacttccataggccaccagataaatatgtgagtaagcttcaacagagtaaattcctaagtaagagcactgaatgaggggactgtagaacagtaggtcccaaatatttgaatactgagttctcaaatatttgatccttttgtatgcagaaaaactgaggatcccaaagagattttgttgttatgggttattatctattgatatttatgacatataaataaaaatgtaatttattaaaatatttattaaatcaccaaaaagccaataaacccatgccaacataagtaaaacatttttattaaaagtcatcctaaacagtaattccaaaacaaaaatacactttgcaaataaagggaaaaaataaattttgtgagaagaatgatactgctttagaattttgcaactctctttaacgtctggcttaatagaagacacgtgtattttcacatccgcttcagcatttaatctgttatgacagaacatgtcataagacttctagaaaactccactcatggaagctgagtggaaaaggcaaatatcatcttagtgttatgacaaaaatagttttgatcttgcagttcctttgaaagggtcttggagatacccagggtcccaggaccaaactttgagaacttcaactgaaagacagatacggaactaggaatgtaagaatgttctagaaaattgccttgaatcctcattcttaattgttgaagcttcagagaaaggtttaatatatatgttaatggtatgttaatttctcacaagagcagtgtaacataaaagagacatttccaggaacagatcaaaagccaatcttatccccaccatcctactaaatgataaaagagtcctaatacagtgtaaatgttaggaacatcactactttatgcttaaaagagatggcctttataaactattaggactgtcacactgtaatgtgcttctcaaatcttattaattcaatttgaaagaaaaccataatggttttagtcattacatagtttttaaaaaggaaaatactatattaataaatcatgaaattttgtagactgtccacacattatattctttggcattcaataaagaaggaacaaaatgaatgaatcaacacgaatgggctatctctaaaggggcagcattctagccacttgatttggtgaaacagagagtaaaatacataaaaactagaaacaccgttttatatctgacctaccacatgagtggaggaatgcccaaattcaaacagccacgtggaaacaggtgatgcaaacatggaaaatttcagagtagtgtaggccacaggggaggcaatccccaaccccagcccggctgctagccttccgtatcgacaactggggaaattgcctaggtgtagacaactggaagttaccctgactcagggcagctaggtgatgaaggagcagaatttgcaagaacagcaaacacaaatgtcttttggggaccatgctccgtaattgttttaagacatttatgcaggaaatgcaacctattagattatccaacaaagatctctcaggggtccaagggacagttcaggggcctcccatggagtcagtgggcaaagccagtggcagctaagtcccacgacagcaagagcactccaactctaagttattttatatattaggcttctgaattatattcccttttaaaagtgggtttccaatgctaaaacacaacaaataagggattcctcagtaacttgtatattccaaatatttcaagtccttgtgtgtacattttacatcagctggagttttttttttttaagtagaatttgtattttatttttgcatgaaaacgttatttttgtatgaaagggtctttcttttctaaaactaaggaagtggtgaagttcttgacatggtaaaaacttctatgataaaatactcagtatttctagatgttatttctggaatcaaattatcaactcaatcaaaatattaaaaataaatggccctgtctttttcacagaatctcatttgtccttgcgtttagtagttcctggcacgccatattttcaaacctccatggtcccaatatatgtgtgaaaccaattgggactagtatctttttcatgcaaattcacagttcatataaacagctttgtgtagaaaataaagaatgctggatttgcaagctacccaagacaaattaaatacactcacatacacatacacccttgctcccatttaaaggcctcagttcatctgctggaaacagacaactgtgcttctgcaatgcatcactgttttgttttgtttgtggcaaagccagtagctcattatgaagtgggtattgactttatgattgccaaacaaatgcacagggatattttatcaagagctgtggattcttatttactgaacaggtataaaaaaagaatataaagaaaatacaaacgatgaaacaagagaccacagtacttacttctcttacagttaaatgtaaagacaacttttctctccaggaagaatgaaacagagctactcttcttactcaattttatatccaaatggacaattagttccaggtttctaaagcccttcaatatagccccagactatctgaactaaagatcataaacaacattttataggttttatatattcttatatattcttcagaataccactgacacctctgcaagttaagcctgtggaaatagtgttcccaatgaagccaacaggatgttggcattcgtaaaattcagaaaagacctgcaaggtttgcatgtttaaaaaaaaagcattccccaaggagaaagcagcttgcagaggaggaatatattcagtttgtgttatgtggagacctcaggctgcagggtgctacagagccatctgttgcgagagtgtcccagggcatgcctgttgggagacaaatcaatgttcccttgccactcttcaggaagcccaggacttatacccaacctgaatgggagagcatggagatgctgtgtgccccactctccaccaggcagatggtgcccctgtgaggatgccctgatggaagagcagcaacggcacttagtgtaagtgggaagaattatttctactcattgttaagtctcacggtcacaaataccctatatatgcaacgcacttaaaaggtatgaatccagctcacgtcaagcaaactgttaatatgtgaaatactctgtgagttgatgaacatgcaggatgatctgtgtgatcacttgatctttccaggaaaataaagtataacaaataaacatgcttacatatgaatttaaaaaggaaaaattttcttgggcatcttagcaatccaaagtcagtttcctttactgtggtaaagatattgtgatattaaagaatcccataatactctccatacaaaactctaggttcatgttagttttgatttttaggttaagtttctataaagtatttaaaacttacttatgtttatgtattaaatacacctatattggtttttattaattcagaatattttgctaactgaaactatataatccaacaataatggaaatttttatgcattcagcaaacacttaatgtgagtttactacaggcctggtaccattctagggtctgagaaataaacacaaataataatacagttccaaattcaaagacttcaggattgatagacagagaaagcatgcctacgcacatgcctacacacgagtgtcataagacgcagtaagtacaacactctgtattcaaagccagattttaaaacatggtaggtggctattttatcaaaagatcaaatctgaacttcctttaaataagaaggcactttctgctatttctaagattttttcaatttcagacttttcagcaacaaattacataggagaacagatctgtcctcacaaatattttaattaggaagaatgtctatcacatattctatgttattctctaacttcattaagtcttttgaatgcaatgctgttagacttttgttcagcaccatggtctgccactttggtgccaggattttattccaggtcacttctttgagagatactggacctattttacttttgcatttaaaaagataaccataatagctgatatttattgaatagttgctatgtcaggcactattctaaacacttcacatgatatacttaaacctcagagaatcccatgaggtaggtattattatcatctctatgatataaaagttaatcaaactttttggattaagaacccctttacactctgcaaaaaaattactgagaatcccaaagagcttttgtttttgtcagttatgtctattgatacttaccatctccaaaattaacttaaaaatatatattaatttaaaatagcaatagtaattatattacaggttaacataaacataattataaaatatgactataattttcaaaaatataataaaacaagtggcactgttttatacttctgcaaaagtctttaatatctaggtaacaaaaatgacatctggattatcatatttgcttctattaatacattcaatatgctgcaatgtcacatatggagtggactctggcaaaccactgtatactcatgagagaatgagaacaaagaaggcaaatatcatcttagtattcttataaaattctaagtattcttataaaaattcttttaaaatattcttaaaaaataacatcttagtattcttatttaaacaaaatagttataaaaacagttttgaccccgtggatctctaaaaaggtcatagggcccccggaggctcctggtcaacattgctaacatgcagcaatgcctgccttccatggataaatggaggctgctcatgcagactggaaagcatgcctattatcccactgctcaaaagtttaaatatggccattcatgctttaacaaatatgtaaaatagcaatgaatatatatttagctataatcctatttgttagaacttgtgcctctgtagctaccattgcctgttaccactgtctctactgccagtgaggtcatcacaaataatgcaagaatttggggtctccatggacacaacacatttttgaccattttaatgtgaatcaatgggaaaaccaccattacaaatttccaggaacacattgaattccaaatactataaatccacatttttgcagagtagaagaaaaatactaatcaaactcccaatataaacctatgctcaggcataggttttgttgtcagttaacaaccccctccaccccatattgtttccctgtgaagatatcaccaaatgtctatattgaaattagatagatgattactctcatttatgccttggggtacagagtcatacactaaaatcttaaacagaagattcaattaatcatcaaccttccccatttctggtggatcccaagaataagagcccggtggcgatctggtatgcatgtggggagaacaggtttgctcctctgaggaggccaagacccattctctccccacacagaagtgccctggggagtcacccgccgcagaggccatgacaatgtcgagtgccaggtgcacctgtcgtgtgggcagatggggagaccagcgacggcagtccctgagtaatggttaagttaattagcctttccatggcagatcatttaattactcatcccctctgacagggtgagaggagattttagaaaacttttagagccgcaactcatatgaaagaaatgtctttatatacttttttccaatacgtaacatcactgttgcccccaaaactttaaaacagcaacaaaatcactctgattatatgctttaggagactctatcaacatccataaagcataaaagtcggtaagtttagagcgtgttctaagttgtggatcttcacaggattttgtgcagtgaggtcagtcagcaggaaactcaacaggactggcatgtaaaactcaccaacattggaaaagcacaagactttaataaattgcactatgccaattaaggaatgtaccccaatcctcccaaaaattaacacagagactttttaaagaattcagtgtgttggaatacagagatagttagtaaacacaaactaacaaaaatcctaattttagtggcctgactttctgaaggtgtgttatccacaggcttgtccttaactagctttctggagctcctggaaaataaaacgtagccctctacatccttatcctatatatgtattctcaaaattgttcttctgctctcaagaacggtgcctcgaatgacacccacattttcattcattcgttcatttatccatccatacagtcactcatgcagtccatgaagtaacaagtgccttcttacctatttatctccttagtgggaggtaagtccctagaaggctgtgactttgtggtctttctgcatccagagcacaaacatatccttaataaatgaacgatcatgcttcagaacaaagatggtctcactgacttgaggcaagattacaaacgccttcgctcatattcaatatcagaaactaatcgcatgttccagatcttgacaaaataagccaataaaaccacacaagctacctgtactccctactacaacagtcatatgtgtagcattttgtacattttagatgctccatataatattggtagtaaatatccagtgaagaagtgcatttgtccttctgggttttctcctttttatttctacttggaactgtgagctttcattagaataatatatgctttcatcctcaaatttttgataaagttggaagagcctgaatttagcacaatactgaattaaagtaacccattttctcctcctcctctctggtacagagtgaaatcccaaagcactcctacctaaaatgtttctaaaatacatattagagcaaaaattcgcctaattttaatacagatatttctaatcttaactcttgcaattacttcttcctcgagtgtaaagtcaaacacttcaaaaaaaagctttccttgagatatatacttcttataaatcattgaagaaacacttaatttcttaattattgtggaaaatctaggtttctgaatgggtattccttatgttgccacgctctctaagaaacttggaattccctatgtttccaggtatacccctgcctctgcaaccccactttgccaccctgatatttcttctttaaattttaaaattccactaaaataaatctaggtttgtgttatgtctgacaattaagacaaacttttaaaaacaacagaactttattaataatgttcaagttgttccatcaattttggtaacattcaaaacagatgaactatatgtagcttaatatggaaagggaattcttgagggaaaaaaaacatgctaatcaagcatgctaatcatctcctaaggagcattacatacctgtggggaaagggggtgacgatagcccttacatgacaactaatttagttttcacgactttcaattatctatgcctctgaaatctcattctgtctctgttttgacaacggccccaacatagtatctgtgaggaggcttgagccatttatctaggctcagaaaaagaaggtttgtgagttccaaagggaagagttgaaggaggtactgatggaatccctgatggactgtcacacaggaaagtttatacactaaaacattccttcatttgtggaatgatttacacacacgagggtgagttcagctcaacaaaatggtggttttattatcattatttttttgagatagggtctcactttgttgcccaggctagagtgcagtggtgtgatcatggctcactgcagcctcaatctcctgggctcaagcaatccttttatgtcagcctcctgagtaactgggatcacaggtgtgggtcatcatgccctgttcttttttttttttttttttttttttttcggagtctccctctgccaccaggctggagttcagtggcgcgatctcggctcactgcaacctctgactcccgggttcaagagattctcctgcctcagcctcccgagtagctgggactacaggcacgtgccaccacatccagctatttttctgtatttttagtagagacaaggtttcaccatgttggccaggatggtctcaatctcttgaccttgtgatccacaagcctccaaaagtgccccagcctcccaaagtgttgagattacagccgtgagccacggtgcctggctgccacactcaatttttaaaaaatgtttcttagagacacggacttgctctgttgcccaggctgatcttgaattcctgggctcaagtgatcctcccacttcagcctccccaagtgctgggtttataggcataagccgccacaccgggcccaaaaaggtggtttttaggctaaattggaaatgctatcaatctattccacaaatattatgttgcttactaagttggaggggctttgctaggctctatggaaactacaatgatgagtgagactcagttcctgcagttacagagcattcagtctcagaaaacagataacacacctatggttcagcattatgagttggaaagtgtcccccaaaaatgcatatattgaagtcctaacccccagtactacagatgtggctttagagataggggcctttacagagttaatcaattttaaatgaggtcactagaatgggtcctaatccgacaggagtggagttcttaaaaaaagggaaaatttgaagataaacacacacacacacacacacacacacacacacacacaggaagaacaccatgtgaagatgaaagcatacattgaggtgacacttctacaagccaatgaacaagaaagatagccagcaaaccaccagaagccaggagagaggcatggagcagactcagaggcaaccaaccttgtcaatgcatcttggacttcagcctccagaacttcaagacgaacttctgttgtgtaagccacccccatctgcagtactttgttacagcagctctgacaaactaatacatccagatatattttaatataaaatctatcaactatgtatgtttgtacataatccatctctatacaaatatacatatacacatagcctgggaagatataatgggtgctccaagcaaagtgtgatgtattttgggcagaaggagtatttgattccgaccaggagaatcaaggaaaccttcatagaggaaatggcagtcacattttacaaaagttaagagcacaaaagtcagatgtcaaatatgaaaatttataactctagagttataaaatctttactgcaaagtgggtttttttccaatctaaggaacttcttcaacatgccatttctcaagagttgaagatgactatatgaatgattcaaatggcacacttcatagctaaacatccacaggcacacataatctcagccatagacatttttggtatgtccatcttcatattctttttactaagtctactgctatgcccagtataagatgctacctcagtgctttattaggggaatattgacttagttcatattccagagtggagacggtttgcaaacacatgtatatactctctggctgccccattattggagcatatgttggccacttgtgggtgtaaggagttaggtgacctgtggtcttgaaactggtctgcccataaccaagccttcactaactcaggtctctacccaactgagccattattaaacctcaggagcactataaatttactgacttttataaaccattcaactaaatagccttctctaaagcatttggtaagagtaatttgatgctctgatcatctgccaattcattttatgagtccataacctaacagaacccatctcactttcctttcagagtcattttcatcattgagctttgtatcctgtttagattcttcttttctaatcttttcaggactgtatgagttggatttctcctggttgcaagtaacagaaacaaacttcaggtacaataagaaaggggaggtatttattgaatgcggtatggtatttcaggaggaactgaaccaccaaactctaggagaagcaagagctgggtaagcagcaggggtctctgcagcaagaatttatataccacttggcatgacactccaacgatgccctagttgagctctggggactcttggtttctattccatcagttccacgttttaattctctggagtaagatcctgattggcatagcataggtgaggtacacaccctgaagtgaccagctttgacctgggagcagggtcatatagcacagtcttagatgtggtcctgtcccttataggttgggggcagttctaagagaaggaaataattgttagagtctaccacatgggtcgaaaatttatacttctactataccatcctttctttgaaaagcactttttatatatttcttaattaatccttacttggacctgtagcaaaaaaataaccggatctctttttgtttttggaactcaatagtttttgcatccatttcaattatattaactccatttgaggtatgccattaaataccttactaacattgagcctacatcttgttttcttcatactatcttgaccccttcctagttattgtgacttaacaatttatattaagcacattcttcattcttccctctacaacacttaaccagcttaagtctatatatttctgtgtattcccactgtcaccaccatcagcacgttttatactgtgcacattcctagaaaagttaactatgaaacactgtgtacatgttcacaaaattgtataatattagagccagagagtacagtcttaggaggcacacaaacaaatcagaaagtatctttctgttctattcctatccttcacaccattaccaggaagactgttcaaaataacaagatttcaagacacagacccttttaaaagaatgtccattgtaaaaatccagagaataaaagagaaagccagacttccctatattctttgtaaaaaatcaaatcgtgaccaaatgtggacaatattcaattagtacctgatttgacaagtagctgaaatcaacaataaagtcaacaatgagaatcttcagagggaaaaataaaagaacctaataacagacagcctagaatcttaagagaggtgaaatgaatggaaccaatctgtaaaataatatctattccactacgtaaaactctgaaaggaagaaaaaattcttagatgtgtaaccacctaggacactctcaagagaggtaaaagtgtttcagaaaacaggaaagcaattggtgggcaaacaacaggaaatgtttttgtagaaaaaaaataggataacaaccaggcaggaaaattctgtcaaaacaggctactggaaactttctgtttatacataaataaatctaagtattcataattatcatctatttcactgacacagtgagagagaacaaaataagaaatgagggcatttcttgtatcttaacacaagagaggggaaaagcaaatagtgagttcagacacagagccaacaaaaagccacttcctaaaggatatgagatacccatcgtgcccgaaggcagatgatagctctggtgctgagcacagtctttgaacatattttgtttacatttaagataaaagaggataatgataatgatgaacacttataaagtaattacattccgagtactttacgttagttattaacttgtttaatccttaccccaaccatgacgtaggtgctattattttccccattttacagatgttgaaaataaagtacagagagattaagtatcttccacaaggtcccagagctacacctggacacaggcactcttggcaccaaagtcctcattcttaaccttaatgctatgctagcaacatgattctagctggagttatgatttttatattacatataattgttcagtaatccggacacacacacacaaaacctccatgaatttcatgggaacctctcaaaatccattttaattcatcatgggagtcagacactgttctgcttgagttcagactcccagctcttccacgtaccagctcactggctagggaaagttactcacactctctctgtgggagtgtatctttatttacaaacacacactgcccctttctgttgggaagattttacttccccaccccactgatactagacttggcatctcacttgttttgagcaataaatcatggataaaagaagcacacataacttctgtgcagaaaacactaagagccagacaagatctgccatgttctctcattatgatcagcaatggtcaagaaggacactggcctgggtcctgaagtgcatataccttggagcagagcagctgacccaccacaggcatctggtgggcaataaggatgccactgtagttataacccactaggatctggaggccatttattaccataacataacctcctctctccactcatatactctctgtgccttaatgtcctacctccttctagcgttgctgtgggcattaaatgagttatttttataaagcatgtagataagaaacaaagtatgagtgagccagatactaacctgaagagtgcaattagagaaaagaacactagaggaaacattaccaatactaatcaaatcaaatgcttttctggttctcaaatccttttgactgagttctaatgttacactggtcaccctgagagctttttgcaaacttcttctcttcaatgctcccttcttgatccagtaataacacatttatttacatataattcagggctttactcttgctgacccaaaggctccagacagctttccttctgcaaagtttggttgtttacttagaccatgaagatattcctccttttcccattttcctcttttccctcagctatctttttctgaaaccgacttcaacactagtttcccatatgtaggaggcaattttagtgagatattaataactggtatctctttgtttttacaggtaaaggattagaaatcactgtgacaagtttgtttcttgagtttttacaggcttcaatttgctaatgtacaaaattttataataaagcatcttaccaattaatgttccacacaaatggtttttaggggatgctgctgccaaccattccaaatatgttgtaatgagcagatagcaagacatctcatgcccaagggaaagatattgtgaggctccctccaaaccatcttataaatcatagactactacacgaaggtcttcgagaacaataccctcattttagtgacaagaaatggaggctcaaagaataaagaatggagaaaatggaggctcaaagaggttgagtattttattgagaaaaatcaaagtgagttaaagagtaaaactgattacaacagagtcatccatggattcaaactagtcctctttccagggatgactgtgtttaaaaggaaaacacatggaaatatgagtacctctgtctagactaaaagacatgtttaaaaccaatcaacatattcaccctttgttacctaacatcttactgggttttaatctggcccattcacaaaagtcaaaggggttactagggaaggtgacaattaacagagcccagtttaactacgctcatgtgtgaagcaggttggaagggatgaatcaggatctaggcttatctaaactaagatataacacagacagcaagttactcctgctatcaaaaggctttatttggtacttacttgctgtataaataactcactagctatttgctctgaaacaacaatgattagaatggctctcatatccaacaaaacactgaaacaggcaacagacagggtccatcaaaaaaaaaatactaacggtacctatgactgcttttcactgttaacagtggcaaataaaaccaaaagttattctgcacacttaccactctcatgatctctaaatttgcttgtctgaaagaaatgtaccaaagattaataaatcttacaagaaaacaaatggaacatgtaaattgctgaggagtttgttccctttaattttatgctagtcattttccgaaatccagaagaaagacatttgctaaagctttgtgtgtcttctagcaaaaatcacttcgcatgtaactaaataggtacagaaaggacacactttttaagtgtataatgataaaactcagatatgtagtgtatgtcattctcgatcacaaaagctgtgtgggttttctctgtttcttagctaagttctcctgtctaaaagacaaaagagaaaacaaaaccaaagagaaaaggattctgcaggcatctatacacaagaaaggcataatattcaaaagtcacagagccaagcatggcagtgagtctgtagtttcagctactcagaaggattgcttgagcccaggagttcaaggccagcctgaacaacatggcaacactctatctctaaaaatatatataaattaaataaatgtttaaaaatgttttaagtcacaacaaagaatggatattgtcagagatcggaattccatttaaaaaatatatttctgctttggagaagggctcaagccattgaaaagaaaaagaaaagcactaacagacaaagttaggaactgaaatacatttaaaaggtcaaagggaaaacaactagaaatgtcctacttagtccaaaaggaaagaaaacccagcaacaaacagggactctcacaaatggagaatgtctttagcacaatacaataagaccgttgtgtgtgacaccttgataaattaaagaaacagaaacactgtcaccaaaagaaaaggaagaaaggaaggaaattcacaaatagtgcccacaaaagatggataagaaagttttaagagaatatgagcactgattaaaggcaagcaagaaaaacaagataggctctatctagctaagcccctactgcacaagcctattgtcttatttcctttggcactgactacaagagaatttcatcatatgtctaataatagtattatttataaaatagaagaataacatcttgataagaatatacctcaatggcaaaatgtctccttctatataatctgagtgtatagatgaaaaagaaatgttttcaaagtaataacaattacaaggcaatcagtgaacgagataagcacttgcagaaggagccacattaaatctattcaactgactggcttctgtgttatgtgagtccaagaatggataactgctgctccctggaaaaacctgcagtgctgtaaaaaccagcccatgccactgtgtctgtgggacgaggaaaatgttaaagaagcaatagagacaaatgggaaaggctgacaacacaactccttatacttcttaattcagcattatattcattgacctattacgtataggtcaatatgaagaaaaaggattttagaaatcacacactcacagatatggtccctgccctccgaaagctagaagttgttaaacactactttggtcattgaccttaccaatacccattttatgcaagcataaatagtgtctaactctataaagttatgttcaacactggccagtatccctatattattttgctgacatacatacatattgcattgaaataaaaaaatcaaaagagtattttcacaagtccgagtttataaacaattgaatatattcatccatatataaacatctatattctgctgaatatagatgcttcctatttcctagtttcatatacattatatgtataacttaactacatttaaataccaattttatataccaagtgcagcctgatgagctatttcaaagcctatgttgacaatttgctagagttgggaaaaaataaaataccttcaacataattagctggtaagtaccacattaagccatcactgtgtagctgctactattctacatgcttttacatgcatcgtcttattgaatccatacaaatctcttctttttatagatgaggaatcagaacttccaactgagcagcccacactctaaaccactgtactatataccccttctccccacatacctacagaggcgatttctttggagcctaatatttgttggctattaatggaaattttactttgctgtggaaacacgatcaaaccaacaatgactcaaatcattgaagaacccatcaggactatcgaaagaagggccagacaaccagactaaaacctgggagcaaacacaggctccaaactgcagcagataggagcactcctcatgagagcttaagggaggatcgcatgagagcttaaggagttcattttgtgacagggtttggccagaagtgccagaatgtcaggaagggagactcttatgaaggggatttcaaggctggtcatcagtggagagaactggatagaactccaatttctgaaaggtctgatggccataacataagtcctttagataaacaaaagtacactgcagaatttcaagacattcacacagcatggagcaaatcagcaacaaagatgatctgaacacattgcggggctcttacatttctttcccaataaaactcataaccattaaacaaaatgtactagtgtgctattctgccaaactatgagaccattagttctctggaccctgacaagtctgccttgaaatacggcagatctaggtctccacaacactgattctccatgaggaataagctagctcttggaacactaattccagtactgaccactgtatgttctttaacatgtcgctcatatctggagaagtgtgtcaggaacaaaatataaaactgttcgcagattttctgactttgacctccatctctcagttctcggctatgggctaaactgtatgcattctttataattttccaggtgcttttgaaagaaatgtagttcatcctagagggtgacaagagaaggctttatgtcaaattttacttttaaaatagttacctaaagttttaaagactgactttacttttcagaaagatgaaaaatgttaaggaaagaacaaagaaaaaatacatttagacacagtaagcaattcattcttaagtaaatatttatataaataagtgtccctcagtcgagacttatgaccctggttgttaattggccttaagacagaaattcttaaggccagttaacaaccagggtcataagtctcgactgagggaccccatccaactcagtacatcctcaatgcacgttaggtccttggtagagtctcatggaactgaagctacttaacatctgagtcttggattccttatcttcaaactctggtgataatacagtcagtcttcattactcacacaattataaattggtaattccacaattagaaattggtctgctcactcaaatgtatttgcaaccccaagatcaatactcatgatgccttcactgtcccttgcagacttgcacagagcagtgaaagtgtgagtgaccaatgtgcacattccaaactgaggtcacgcaaggggtgacgctccacagctcttggtgtccttttcgtgatctatttagtgccactttttgcatgtttgtgctttctgttggtgactgtattgattaaaatggcccccaattacagtactgaagtactaagtcctcctgagtacaaaaaggcaggctgggcatggtggctcacacctgtaatcctagcattttgggaggcagaggcggtggatcgctttgagcttaggagttcaagacccagactgggcaacaaggcaaaaccccatctctacaagaaaataataatgccagaaagtggtggctcaaaatacaaaatacaggctgggcacagtggctcatgcctgcaatcccagcatgttgggaggccgaggtggcatggatcacctgaggttaggagttcgagaccagcctgaccaacatggaggaaccccatcagtactaaaaatacaaaattagccaggcatggtggcatgcacctgtaatcccagctactcgggaggctgaggcaggagaatcacttggacccgggaggcagatgttgcagtgagccgagattgtgccatcgcactccagcctgggcaacaaaagtgaaactctatctcaaaaaaaaaaaaaaatgcaaaaaaatggtggcttgtgccttggtcccagttactctataggctgaggctggaagattgcttgagctgggaagtggaggctgcagtgagccaagatcacatcactgccctgcaacttgggtgacaaatcaagaccctgtctcagaccaaaaaaaaaaaaaaaaaaaaaaaaaaaaagctgtgatatgtcttatggataaaatgtatgtgttagacaagcttcaggtatgagtcatagtgctgttggctatgagttcgatgctgatgaatcaacaatacatattaaaaaggagtctttaagcagaaacatacataaaacaccataaggttatgcactgatcagctaaaaaaccagagccagaggctcacaggaatctaaccctgtattttccttaggagcaatggttcagtgtttaaggtgacttcatagaacataactactatgaataaggagaactcagcatatataccctaccagttgtttttaggttctgaaaaaatatacaggttaatgacctgtgaagtgaccagcataattaggaacgcaagggattttacctacctataagtaaaaggactgttctcttaggtgtctgacaaacaccacaactaaaaatatcaaactgagatacagcatatttcatagatgatgataggaaaaatgaaatttcatttgaatgtatcacttaagtcaatacattagaagtgggaaatattaagatataatttaaaatccatcaaaaggcatttggattctaaatcaggttaacattgttagacaatatgctatcaactctgctaattagaaagtcacagccttttattcataagccttcaagtaaatccaattaaaatggaagttcaagcttgggaatctcagtcacaggtctattacctctataggcttcaattatgaagctgtcccgaaagtaggaaacacagggtttcaactcaaagtccacataagagtagaaattcaccatttacattaggtatatcccctaatgctatccctctctcctctccatgtcaagttaacgggtgcagcacaccaacatggcacacgtatacatatgtaacaaacctgtaccttgggcacatgtaccctagaacttaaagtataataaaaaaaaaagagcgaaatctctgtatcaaatttaaaaaaaagagtagaaactcaccaagaaatgctcctattggctgaatctagaaaatttactttatgaaacatcagtgcattgcttattttaaaaaaaagctgtactttgataccttgattaattatgacaaattattatattcctaagcagagatagattttttaattttgtgtacaagtataacaaagtaaacccttgcttgatggagttaagaccactttaatccagatctccttaattcagaaccaagaacctagacaagtatttctttgttctatgaaaatataagaataaaaggatagcaaaagaataagtgacattaaaaaaggctaaagttttagaacattgcattaaaaactgaagaaaaaacttcaagactttgaaagcacccatttacatatgactttatttattcattcaatattcattaattccacacacacttattgagttctgctctgggccagccatcagaaatccccaggagaagcagatactgaacagcctttctgaagctcacagtctagtaggtgagacacacgtgtaaacaaatgcactgcaccgtgataaagacaattgaagatgtaactgcaaagaaaaatgttactcagcagaggctgctgctttgaaaataaccctttaaaagatgtctcacctcagcattgaaggctcctcctggggacacactttactaactcagctctagttaataggaaaactgcaaaaatgatgcagctacaattctctggaggtaggagggaaacctcatgcactcagactggattgtaccagcacctctccccttcattctcaagtcacttttgccacccaaacctcaactaatggaaagtaaccaagttaaccagaaggtgaaggcacgggtcctgcaggaggtgtttctggctgttacaagcacgggaaggaaagctccaccactgtggccaatgaaaacttgtcattcgctctcatgcaaaagagaacacaacttccatcacttgactaagccagaggttaactcacttagtcaagtgatggaaagtttcctcactttagtttttctcaaaaaagtgacactttaattatatgagcacacctattttatcctttcttacctccccctctacttataaaacaatatatctgtgattctatgtcttttcccaggtttagaatctgagtggctcatgtgcttgaggctcctggagagaaatagaatcagtggatagaactcaatctcccacatgggtcatggcgaaggcagtggcttcaagcccagcctttggtaaagtctctggtagtatcactgccagggccacaggaccgcagagcctatagcattctctctatgactaactatagaaggctctcagtcttgtggatgagaaagaagctccttcatgaaatggcttgtctccctgttaaaaagaagacacaggcaccgttgtttttgcttattttttctcactcagtcagtaccatccagtacttacttacatttgtctagtctctcctaaacgacttctggaaaagactccaaaatctttttaagcagccccaactagctacattccagagcaaagcattctttatttataaatgaaagggctcagcagtagcttctagccttatctcactcttctctagacaagggggttccatgaagacatgttccacaggtaggtttgaaaaaacatttcaagtatcaggggccaaggtcctgcttccagttcctctaccacataaatgtttagtcctacaacctgtctggtcctggttttctcattacaaagcaagaggaatgaatgaaagagggtctgtaaaatccccttcccattctctcagtctgtatgtaacctggtaatatatcttctattccaggttaatagtgaaccccaattcctttatgaggtccttatgttatacatacaatccctaatgttaaaacaggatttaaaatactattatacagtccatcatgttggattcctataaatatgggtttttcatacttgccaatcaaattaattagccaaattcacttatcaaagtccatttaatacattatgtgctggcatcttctaaaatatgttcacttattatgtttactagaaagaatttttaatgagcagctgcctcaaaattaattaatgtatatagcttccactataaagttacaagccaaatcccactaatacaatttcagtgaatagctcagactgcaaaatacagcaaaactccaactgctagcccatttatttagagaagcatgtgaatcaacaaatttacaagagcatgaaacaagcagttatgatattcatgtagattttgagtactatattccgtgaaataccacaacatggaattctagcaaatcaaggaaactctattggtacctcatatcttcctgtatactctatacaggaagtagaaatacttttctgttatagaactagactataggaaaatcaaggtatttgactgtaccagctagattctgattttttctattctctaaaaatctcacaccaaagaattattttacagcccattaactgatttccttcaaatcctgctaccttttatttatactctgtttatgtgctaaattctaaagagtttctgaaggaaactaaagtaggttaaataaaactgaaacactgctttgccaacattttttaaaaatcaaagtcaggtgtaattaaaagaaaatgattatacagcttgctagcacttgttccatttttaagaacaaatgttcagacttacctaggggatgtttccatctgcttctctcagtttggtttccatgctttagctttaactattatatgtaggcaaattaccaatgtctgactatctaacaataaataaccctggccttatttttttttcaaataacccttaccaaaactgaaatcatattttctcaaatcatattttaacagctagtcttacattagccagaaaggagacctcaccatcacaatttggagaaaataaacacctcattattgataacactgtctagagttgcgcattccggagttacgaacttagccaccatgcagatagaatacctactctcctaaaggctaaaatccaaaattaatgtgaaggtgtattttaagaaatggtaaacaataaagataataaaatagtaagataaaaccattaaacagacacccagtggccaatatattacaattggagataaaaatatatgcatttctggcttaataagttagtgacttagaacagtacaagagtgacatggaatcacagaagtgacaaaacttggccacaacaaagccctgatgaaaagcaaattgctccaatacagtgtccgtacacttcacccttgcatgcccatctctgatgccccccaaagtagctgcataactgatttatttttcatccagatggctggcgtcctgtacagacttacaatgctgactgtcttggggatgcttattcagtgagtcttgaaagccattattcactaatttcatgtggaaatgaaatttcagcctcccattgtgtacgtataacttgggtacttccaccacatacaaaaagtgctttttgccaggcgggagaggatgactggaatgcaaaacccttcctgcatgcctccctggcccagacccaagctggcatatggcagttccaccaaccacctccatatagaacactaggtgaatgctttaagcaagtcctaataatgtgatttacaaagcactcactggatggctgtcttctgcctctattttcattcaggataggagattaatcttatttcatgaaaagcattttactacattctgtttcttgcattcaccctcctccctacatcttttttaaaagaaaaaacaattttgctaaaattctgtatatctaaaaagaatcatgagtttccaagttttcttaccttactattttcttattctagaacttaatcctcaacacaggatttactttctgtttcaagcctgtgactagcaggcaaagaaaactggtctttagagagcaagttaaacgttttagctaaattcatgtgctttgaatgaaacattcccacgctgtgcttataaacaactattgatattttctgtaacttcattccagaaattgtttgcttttaaatgtcagagagctctcttcctcgccctattttgggttttatttcagtcggcagtgttgctcatcagtaataaatacaaattcttatgtagagacacactcacatcacatgctggagctgaggagctcaaagtattttacaaacatgatcaaaatcactaatgacttccagctctggaatctgacttctggatctgtctcagaagacttatttacatcatctttgcaaaatataatttgtatttataaacacaggcatttatctagtacttagcaatgaatgcaagtcatagccctggcactgacattcatttccaactgtggttccaactgaacttcccagagatgtaagatatgactgtctatggtaaccttcctcctttgattctgaggagtaaacggcatttcctctcctcttctattttcatctactctgccacataactcttcctcaccagtggcatctgcagggggacaagccctccttctttcacatatcccaggaacgtggtttgtccactaggccttctccaggcttgtctctcagatatatgaatttcagaatgagatgggtgatatgcatgtagggatattttgcatattaaaagtaaaaatagccgggcacggtggctcacacctgtaatcccagcactttgagaggccgaggtggttggaccttgaggtaaggagttcgagaccagcctggccaacatggtaaaactccatctctactaaaaatacaaaaattagctgggcatggtggcgggtgcctgtaatcccagctactcagaaggctgaggcaggagaatcatttgaaaccgggaggcagaggtttgcgttgagccgagatcacactgttgcactccagcctgggcaacaagagcgaaactctgtctcaaaaaaaaaaaaaaaaaaaaaagcaaaaatgaccaaggcaaaatagctccattctgaattacacatccaccttctgaaggtaaccaatgctgtcagaatccagcttggtaaatactctgtttttcttttcttttcttttcttttttttttaactgagagaacatatacaaaatcaactttatcttatcctggaatcacattctactataatgaaagacagatagccttgtctcaagaaaagtaaaagcaagaaagtagctctagcatggaggtgatacccaaatataaacagggctggtttcagaatttctaagcaggcttccaagaaacaatctgattggaagcagaaggcaacctattggtcttgaagctacatttgcagaaccagatcacccttcttacttggattgtgggtttactaagagtgttggagtgggtagctaacggagattctacctttaactatattaatgcaaactgtggtatagccctggaaataatactgctactgcatgcaatatcatcagccagatctttcttagaagacagctccaatctatcgactttaaaagaaatacaaatgaatgagaaaatgcttttgaaaaacagcgaagacactcaaggatgcataaatgtaaactgacaaacatgtaaacaataaagcaaaagtgaatgtctatttctcctcctctcatatcttgcagggcactaccgggaaagtttttttatagtaggcctacatgatagagtactttgtacaaaagatcagagcatgattagctcaagcgttagatgaccataaaactggagttacacaatataccccaatgtacagtttatgtcacaaaataaaaagaaagacttcctcataatcatgtttctttcacattttaagtgtttggtgtttttgactaaccatattatgctataaaatcaaaagtaatcacttttagggtcctttgagaaatccttcttcatacttatatatattttttaaaaaggctaggagcaacaaatcctggattcttccataatttaagtgcaacccccattttttaaatcatgaaatagagtttaaattggcaggagggggagctgcccaacaaagttgtacctagagagaacctttcctgtaagtcccttttgaacaaataagtggttctaatcaaattgtggatgtatgatgagattctcaaaacaaaggaagtctactcctctaggagacactagattgaatgaagcatttcatagcatttcatctatggaagaactaggccctctcctgaaaaatacttgctttggtccctaccataaagcagcaaggtagtaaaggagaaaatgctgtgacagtgttttcttttgattcagtccagtagctatggaaactatcttttaaatgccaattggtcctcttccctgcaactacataaaataaaaccatttcttaccctcacggatgccatggctggaagctccatttttcaacacgttcaactaatctaagccctctcccacttttgctcagtatttgcaagctgaagctatcatatttgattgatactatggatttaaattagaatacacatgaatgtacttctaactaaggctgcgaggagtaataatgcccaaaccacaagtaaacatttgttaaacctgcttgatgtgctccaagaaaaacaacgtttgcttctttctctttccctatatctcttcttctgaggtaaaaatgcatgtaattcccatcacttgtaacgtgtttttcttttcagtgcctgtgcatataccataggccacaagctgcaattcagggtcaagagtttccttctatttacaaatataaaaaattaagatttttcttttgtggctccctcaataggaaaatggtagacaagctaaaatataaactgatactagggtctgactgtttttctgcatggatttcaatcctatcccattcaaaacagaatcatctccagagatctatttctagatttattcattgtttaattttttgagatttgtcatttttatttccttcactatatttaaacttttctttcagtaaacaagtttgataaagatggatattctttgtgtacagcttcctacttcaatatcaccttagttcatcatctttattgtcaaattcccttgtaatctatctctttgtaagatcctccctaaaattttgagatttgcaaatgcaaaatacaacaaactgttatgttccaacatgcattaacttttctcactgatttttttcagtgtgacttttctctttaacctccaatctgtctcatacaatttattggtagtatagtatttatataaccctattttatgcacagttagcatgaatcttaaaaaattaagggctacaatacccaagacaattctaaaggacaacagaattaaaggacttaaccacaccttaagaaatgccataaagatatagaattaagacagtgtgtttgaagcaaaacatataaatatatatttaaaaaaacaggcccatgggagaaaaggaggagctagaaagagactcacagttaagactgtcacttgatatacaacaagagtgacaaggaaagtatgggaaaagtcttctcactatatgattatgggtcagttggacacccatatgaaggaaagtaactcttaatctttaattcataccacaaacaaaactcaattcctgagggactgcaaatataagagagaaaataacaaagcttctgtaaaaaataaaacaagaacataagaacatatcttgatgactttggaagaggcaaaggtttcttaacacatagcaagtactaagcataaaggactttattaattttaataaatctataaagggaaaatgtatttgcaatatctacacccagttaaagacttgaaaataccaagtgtctgtaggcaaatatgtggagaagacagaggtctctgccactgctggtgggagtgtaaactggtacaaacactttggggaactgatagaacacgtgtatacccaagagccaacaaaatactcaccaaaaatatgtacaaacctgttcatagcagcacattacacagaagacccagaccaggacatacccaattgtccatcaacgatcaactacatcaataaatcatgctatattcatttaatgaaatgctgccccgtaactagaatgaagtgtttacgactacttgcaatgatataggtaagtatcacgaatacaatattgaatgaaaaaacagcgagaaaaaaacaaaccataagtattgaattattctatttgtattgaattattctattcatacagaggtctaatatggggaaaaaccaatttatggtaacagaaatcaggatagtatttgtgcatgacaaacaaggcatggagtgaattcttggattctttttcttgacctgggtgctaattacataggtgttttcactttgtgaaaaaccagtatactaacacttgatttgtgtgctcttccgtatgtatgttacacctcaataaatttttttttaattaaaggcgcaatccctattttcaatgaacatacaattaaattttgaaaccagaaaacatagaggaaaaacaggagaatgttaacaggaaacaggccacaagtagtttcaatcagcacatattcagcaaattcctatgcttgtggccaatattttaggagtgattgaaacatttataagtattgaaaaaattccccctgctctccaggagtttataactcagagcaaaaaaggatttttttgatttgatcaggaaaaaaaaaaaaaaaaaaatggaggtggggagagtcatagcagacactaaacaattataatgctagggcagtcaactagcatatgttgcaacagctgtgctgtggggattgagaaagaatcatggttggggtctgaaattatcaagaaaggcctcatggaagagacgaatgtgaccgtggagtggaaacatgcatagcatctgaattcacagtgtgaggacccagcaataggaatgattccagggagggaggctgtaggggcaaaatgaatggtaactgagtagacggagctttcctggtgaggtaggtaaaggggagtcactgaggaagaaaacactgaaaaccaaactgtattctaatggaaaaaaaaaaaatcactgtctatcctcaaatggagcaatgacatgaaaaaaagcttgttaaaaatatgtatccctttaacaatactgcttgtctctggaaactttttcaaactgtaggtcacagcaaattagcaaggagtaaaatcgctataatgtatggtaacccattttccctaaaagtgaaatagaaaaaaagcagaaaacaccacagtgccctacacagatccttagcaagaatgtacgtattccagctgatgctgccgccaattgctggaatcagtgggtaagacatggtgtgggcaacgtaaggaatacatacaatggctgcctcatccagcttcattttgtgaaatagcattgtttcttgaaatttttgtttttgtgatttacatgtgtgtgtgtatatatttgcatttatatgcataccgcgttgaaaataaaatgtgtttctcactgcggcttccaatcaagaaagtctgaacaatattcttccagaagtggagttctgcagaattcatttgaacaaggagtctatgcccaaataacattaaatgaggagatgcagaataaatgaatgagcaaacaggtagtgttaaaagtctacattaagacatgtagaccctccccaggttgtgcttcagccttaggattatttactcctccttggattccctgtatcccagaagttactcaatccagcatccttttcaataacatgaaatgaggctggaatttaaccatttcctaaatccaattcttcctgcctgcctgatctatctagcacgttgtgaggccttgcaaatagaatcatttatatcacatgcactatttaaagtaatgttagtttgtatttttaaacactgttccatttataaacacctaatacacacagccctgcttaaaaagaatcaaataactggcaatttggggcagaactgtgagatgtcttcactttaaattatcttgatatttgtcatgtttcttcctgattttcaacacacaaatctagcttcagggtggctaatggctgttttatgatagtctcattaatgacgttgttataaaaactgtgagaagcattaaaaataaatttttacataaagtgattttattctatgttaatttcctacccctttaaaattttgcagcattcaattaaaatcacataagaatttccaaaccccttcaaattttacagcattaaattaaaatcccataagtagcctccatccatgtttccacccccaccactttaaattaaaagggaaactcactagaaacccaaggtcttacgctattaaaagcattccaatcagccacacaaagtatttattgtgggacaacatccatgaatagttaaagacccacttaaaaatatgaatatgttttctttatagaagcttatcctaggagcagagaaggccttcattcattctgaaacctggcaacccggaagtaggcagcatgaaatctctcaagtgtacactcacttcctgttttgcataggttagcctttctccatgctccatagttctgcaatttctcccttccacatcctattttctattgcggctacttcaagtcatgtgtgtctcatgttacttgttccagagttaccctaaagtattttcatatgtgactatactaggaaaagggaattggaaattgtaaagtcctatgaggggattagcagtctccctgccaatgaggtcatgtgttgactagtcacattactgatgaagtgttcaaagcaactaagaaatttatcccaaaaagctgcattgatattctggagaaactgtttgttattacttaggaaggaagttggctgcatgctaaaagggaaaactagaacttgtccatgtgcagttgctttcatatcagctggtcacacaactttcgttgatttcattacagcccctgggagaaggtggtggaatcataaagctaccttgactaagtgtggtgagtgatctgcactgcctctgtttgggactatttattcctaaatctacaccccacgccacagaagttgggcgtcttccacttcccgccctatgctattcagaaagggtttcttttcttctaccttatcctcaaacaaaaccacccagagttccatcacaaggccacctgctatttttagatggagatcctgggcatgtgccctgggctcgtctcccatgcccttcctctgcagtgtgcactaaacagggcagggaatataacatgtgagaggatttcagaggagggcctctggtccactgggaaaaaggcagcattggtgccaggaccctggtttctagtccaaattctgaggtcaactggccatgtgtccttgctcaacccatttgaactttcctaggtcttagtttcctagtttataaaatatagggacaagactggacaatgttgagctgcactgcagcttttaaattctcttcagtgtagagttggataattcatggttttacagggacatccttgactcagactgatccagcccagagcacatgtctaacccttgactgctccggttcgttccccaaccagatcaacagacccaaccctggtccttggaaaagtccatttcttccttccttcctgagttccaatttatcacatcttatcctgagaaaaatcatctgctcctcactactcagttttaaattggcagtatccctgaacatttcttggtatcttacttttaaatttgtttttcttgctcagcgtctgccagagagatgcctctaaattcatttaacctggaccgtgtcttcccctttagccattcccttcccccatcccactacctgaatcacccctacttatgccactgcccctgcccctcccacccaataggtctgcattctcatccagaactttgaatgagttaccttacacggtaaaaggaactttgcaggtgtaactaagttaaagatcttgagatggggaagttatcctggatttttttggcagggctcaatgcaattaacaaaggtccttgtgaaaggaactcgaaagagtcaaagcttcagaaagagatgtgaggatggatgtaggggtcaaagtgatacctctgccagaggccagaaaccaaggaatgtgaacaaccactagaaagtggggaaggttaaattctccctgagaacctccaaaatgaatggaaccctgccaacagcttgattttagcacttttgacccccagaactatgagataatacatttcttttgtctcaagccagtaagtttgtggcaaattattatagcagcaacaggaaaccaatacactttatctctgattgttctaggtacaaccaccttcaggctgacttgacgttagtcacccttcctccttcaaagtaactgttgattgaggacctcctatgtgccagctctgtgatgggttctgaacaaaagacaacacagattcaagctctatgtctacgaagctgacaatctgacaataaattctgacttgaaaccaataactacaaatataatgagatctacaaaggaagcacatacgcccaagggaacacaaggtggggcggtttgggaagggccctaacctagtctttggaggaaggaggttgaagctaagtcctgaaagatgaggtggcagtatcctggagaaaggactcaaggcagccagcaatgtgcttctgaagcaacgtaaagaaggcaggtgaagaaagaagacagaaaaggcagaacatgtaaagccaccaccaagggttttattattattattattattattattattattattattttactgcaacctaagaagagaggttttaaacagaggaatgacaggaaatctgaaaacatcaggatcctgagacatcagggaaggaatgccagagcacaaggagaaacaatgggtccaagcctttgaggttttgtttcaatgaacagatattccccaggaaggaatacctattaatccacagctatgtgatcaacctttatcaggaccttgacgtgagggtgaggcagccagggaacagcccaggtctaggcgagcggggcaggcagagcggatgatctgcttcaccaccgtacatttcctatgggttggagccctggacagctcagccctctgcctcaccctggacacccaccaccagcttagggcatgtaagacagcatgcaggtgtggttcctctgcctcatcctgggtacccaccaccagcttagggcacgtaagacagcatgcaggtgtggttcctgacaccatgtggagggccagccgagggcagggccacctgcttctgaggcaggctctgctctcctgaggttctcactgcctgctattttctcagtggaaacaggttctaaattgaaaacaggttctctcgcaatttttaaaaagcatttaaagaaaatacagccaggggcaatggctcatgcctgtaacccggacactttggggagccaaggagggaggatcacttgaggccaggagcttgagaccagcctggacaacacagggagcctacatctctacaaaaaattagttgtgcatgatggcacaaacctgtagtctcagctacttgggaggctgaggtagcaagatggcttgagcccaggaggttgaggctgcagtgagccttgatcatgtcacagcactccagcctgggtgacagggtgagaccctgtctcaaacaaacaaacaaacaaacaaacaaaaacaagaaaagaaaatatgctttcttcttaaaagagaaagaaaatatatgcccctccatatctcaaagtttggcatccatggattcatccaaccacacactgaaaacattctttaaaaataaaaaaaaaaacccagcataacagtaataagaaaacacaaagaaaaaatacagtgtaacaactgtttacacagcatttacattgttttaggtattataagtaatccagagataacttaaagtgtacaggaggatgtgtgtaggttatatgcaaatcctatgtggtttggtatcggggacttgagcatccatggattttggtactggtgaaaggtcctggaaccaatcccctgagcacagtgagggatgcctgtatctgctgctagccacatacagtggagtggaaaagaaaacagacaaattttttttttacccagaccctaaaactgccattgagctcccccaaagataggccaagccttgcatgaatttgccggactttatttggccacatggttttgacttcattgggcacaggagtgttaaggaggatgacaacactaaacacagcatttagcacatagcagatgccaaagtataaaaaaagcatataaaatcattcattattgactctacaaggcactctatcaaactgtaacctaaagcagagatttgctatgcaataatagttcttatttaatagatgtgaagatgagaaaagccctcattcactactatgaaatatatgcatctaacaaaattacacttgcatcccagtaattcatacaaataaaaagaaaaagaaaatataagtgaaatcagtgtatagactgtaaagaaacatgaactcaacatttatcttaaaaagcatattccttttaacagcaatgaagaccagacacaatccaaatgcatatttctgccccaagagtaatcaactgcattttgtttattggagtggttctttgaaattgaggccagaggccctgaaactatgaggaagtctctcctaatgtttggccacagtcataacccactaaaattttaatttttattttaatttctttaggaaaaataatatttcacagacctttagtccaagaattggaactgcataaggtaagggaaagataggctcagtgagttaaaagtgtccttcctatactggaagcatcattattcagaggatgatgacattttcatccccacatctcctgattaaacaaacaagagaacagaagcttggttttcagatgggagaggtgcttattatcaatgaggagagagttcctggtagtaaggattacttagaagagctataaaatcactttgcccagaggcccttaaatggaaagaaatccatctgctcatgttcgtttggatgtaaccattcctagaagcagttgcagaaaagagatgacttgaacttccattttcactacggggctctctttctagtcacagccaagtagaaaacacaaaagcacaagctcccaacaacatcacaactcatagacatcctaccattggctggagctgggtcccctcagcagcacagggactgtcagatcagaccacgagaggtctttgcgtacagtaatgctgccgtgaagcagtcccttttaaactccaatggcatgtttcttctgccctgtcactgatttagacaaaagaaggtgccctaagatttttctatgcccctgggggtctgagcccccatgagaccagaggttttttaggccaaagtcaggctgcccatgggcaccaccaaagacaaatggagaaagctttcctcaatgccagccaaaaatagggtctacaagggttctaaagttatagtgcatgatgcccataaatttaaattcatgacttacttgcaactggcagaattcgttccaatgtccagaataatatgctgaagcagccatttacaaaagcaagccacaaccctttaccattgtccttcagcaggcagccagcctcagggggtctgcagatagcaacttgtggcacgtgaggtgaagactctgtcagtcccattcattcacttcgccagccttcttagagaataatgaatcctgtgtttcagggtaaagatgccaacctcaccaagactgcctcttgctaaagtgaataaccataacagagttcctgctgggcaatcaggcaagcaatccccaacttttccactcaacgatgcaaagtacaccaagaatgcccaatgcatttcaaaatgtaacccaggttcagctctgtggctcagaaagcagattccttaagaaattctgggagagagggaaagagaattaatgtgtctagaagactcactctgtgccaggcattctgccggacctttacataacttacttcatcaaacactgatgataagcttacaaagagcttaaggcaagtattgttcttccttatttcatggaagaggcagtatatcccacaaattaagtaaatgaaggctatagaagacagaagttaatcactgggtttcacaaaggcagaaagtggcagagctagataagatttatgccctctctaccacccaaggcttcctttcaatgcccccatgccttggactccctcaccccccgtttcatcatatttatcccttgaatggaaccaggatggggaagcaatattccagttgtagaaactctggggtagagcttgagttctgcctttttcaagctaggtgacattttaaagatcatttaaactcctagtctcagtttccttatatgtaaaatgaagatgcaggccaaggccaaatgtgtattttagtgagaaaaaaagggaaaatatatgtaaaagtgctttaaaattataaattcaaatgtgagaaagtgtcatcacaaaaccactgaaggacccatgccagacatgtcccaccagctcccctacaatgtggagctcagagtaagagataaggctggactccagcatgttctttaaagagcaaccaggatatctgccttccgtcaactccaggagtaacaaaaataagcagaaattcacttctctcactggcattgactcattcattgctccactgcaaaagcctgggaaacatgcctaaaaaattttagatgatgataactatagcagctgatctccaaagatggcccccaatgacccctgtctcccaatattcatgacctggtgtaatctcctcccacagcgaaaacaggttggtcctgtggcatgctgtgatctatagaacatgagagaagtgacacaatgccagctccaggactaagccttaggaaggtctagaagtttacacttttgccctgaaccaccatgtaagtagtcctgctagagagagcatgtggagagatgatatggagggaaaaagacacccagtcaccccagaggaacccagctttccatgtctgatgcttcagtaggaagcatcagacatgggagtgacccatctcagatacttcgacgaggctgagccctcaggtgactgaagtcccagacaatatcatgaggagcagaagaaccacccagctgagtctaatcaactctcagaattgtgagagatagtacagttgatattgttgtaaaccctaagtctggagattgttattcagcaacagataatatcaacaaggaggaaaaggtatcatcatctgatcctttactatgggtttcgtccttcacatacataatctaatttaatcttcactataataatttgagataggtattaggacaccaatttataggagtttgggtgaagttacgtaagttatcctaggtcaggatttgaaacccagctgtggtttgtaactgcaaagcccattctctcaatattcttgttatgtttttcataaagtatatcacagaattactggtctctaaagagttgaagaactgggatgaataaaaaagaagtgttactaaataaacatttattttaaataatataataaataatgtaaatggaagcaatgcagtacagtgaaaaaagagctttcagttaggagcctggaacttgaattcaacttctgacctaatcattagctgtgtgaaactgaacaagcaatttgactatgaaaaaaaagttttcttttataaaataataaaataacttcttagatttttgtggtggttgtcagaataaaatactggacataaaggacttctgcaaacaaaaataaaagaaagaaaaaaggaaaaatgtcctatagatacataaagaactgctgttgaattaacttgagagttctccacttcatagttaccacggaagtattcagttcccaaatatttgtattttcctgcctccttccaggataaatgttcttataaatactgttttgtttccagagctttgggacacatcactcttttaaaaatgcaaaataaaataaactgaaagataactatttaatacatcacttctttattaatatttttggaagcaaagccatgaaaagcagaaaccctgtggtttctactgaatagctacattttcccaccccattgatccactcacttatgttagtttccttggggggaggggtgtaagtgacagctttagggaatgtgtgtacaaatacagtcctgacacagacaaacagagggctcctagtgcgaatggatacgaaatgaggtctacaatagataatggctgttctgttcagtggaatgagatacaagatgtcccataaagacaaactctgccccttgggtgggcagtggcagctaagagtattaaaatagcccttgccaaccattgcttagaatccttgcagcagcttttatcctgttttggaaaccaaatggtatctctggtagtctcagcaatttatgtaacattctgtcatcggaagtaaaatctaggatcagaatgggtatacaaagcttacattacagaattaaaaacaagtgtttaattaatgaacaaattatgtgcaaactcataagtatgaactgacagggagtaaggaacatgctttcccttaaagatttaaaattttatttttccaaaggccccaagtctgtatatatatcttctattatgtaaataaacatcgtgcttcctatttcaaagtggaaggaatgatggttaattaaacccgaaaaaagcaatctgcttgatgaaataattggaaattttaagtaaaccaaagaaatataatctgatcaatttaattttgagtttttcacttagtttggggttaatggtactaatctaacactaatatgtacaataattgtatgcttatatttatgtgatatattctcacttgtttgacatattatcattgaacaaataggagccttaccccctctattgaactcgataatataaaaatagaaattacattgaggcatctagatgaaacccttcatctgaattaacaaccccattaggaaaaattgtgaccccaaaataaccactgtagagtgattatggctcatttggcatatgtttattccaatcttcctaaattgcttgtaattgttttattataaatgttaataatatataatgtttacatctgtatttttatcaaataacatttaggaaactttagaaaattatcctaagtccacatattaaaaagcaaggtcaatattctcacaagcatacacaatttgtagtttaaaaaaatagataaatgtaaaatatcttcagtgtattataaccacctaattagaaaatgaatgtgcccacatgaaccagtagagacatatcattacctcacattcattggttgtcactctacaattaatggaagaaatgtacagtcaatagtttaaaacaaagtgaaagttcctgtttcaatctagcacactagaggccatttattaacataaatgtgctcaggtaagtgccctttggggctgcagccctcatcctctgtgtcttctctcctagattcatatagtgacagaagaccatttaatcttggctagtcaaacagtgacaatagttagataatgaggctggacacatcataattttccctacttaccctctacagactgtaggacctacgcgcgcacacaatcactactcaaaagaaaagtgcgaattttgcaattataccatgactttatctaatgtagacagccaaaaaagaattcaggaatcaatacgaactttttcagcttgaagtagtcaacatgctcaaggacactgatatgtctatgtagcacaagttaatttaatattaagataccagtggtcagaaacctgtcaagcaagagcataaagaaacacagctgaaggttttcaaggccatgtgaagtgccaacaagcaatataactaggaacaaaatggatccagatactttatgaaattgcaaacaacaaaagagaaaaacattcagaaatattcacactaataactactagtctgaatcatttgtaagctcccaaatgcaggaacagaatcataacaggcgtaagaatggagagaagcaaatacagagaacaaatgagttattaattaagcagctaaatgcatttatattcataaatatataagaaaactaagacacttacgataactactctgataaacaattctagagaaaaagcagcacagcttttcatcatacagtattgctttattcctctgccttttttgtaaatattgagaacatttctcaaaaatagaaaataatcagggaaaaagaaaatcattattccgtgtaatctcacataaatagctgaaaggccagatgcttaactttgtgtacatagacaaaggagaacatgaagattgtgaacaaacctagaggccggttcttggagaccagagagacaaatgaagggacccaacattatgtgctaaaatctttgcatagaaatgaataaactcaaaagagctggcagcaacatctgtgtgacctttatactgtgcccactctcctttcagataaaggtcatgatgaggaaaaccagcagaagtgcacctgggccacgcaaagaaccagattcccaactgtagggtgtagagtctcttttccacattgtagatactccctcagcctacataagcccattccagtgcaggaagcgctaaagactgcacagagtcactaagggcactattacttacacttgacttttggcttgaattagctgggttgcgttttaagtgcattttattgagaaagcatttggactatacagtgcccaccaaaaacagacaaaaaccaaaaacaaaacagtgcatgcttgtaaagacatccctgtctcattgggtttggaatacccttggagcacctcactgtctttgactactgcatagaagtagtttagaaatctgaactacttgtgactaggcccctaatcactccttgctcctcactcaaatccaacctctgcatcattttcagattcatgttcctaaaaccacctacccaacatcacctctgactcaaaattgtcaatggcttccaacagcatttcctaagatagcctctacaaacagcccccacaatatgttcccttaagaataaattcagtggctgggcatggtggctcacacctgaaatcccagcactttgggaggctgagatgggcagattgcttgagcctagcagagtttgagaccaacctgtgcaacatggcaaaaccccgtctctacaaaaagatacaaaaattagccaggcatgatggtgcatgcctatagtcgcagctactagggaggctgaggtgggaggaatacttgagcccagggaggttgaggttgcagtgagccgagattgtgccactgcattttagcctaggcaacagagcaagatcctgtctcaattaaaaaaaaaaaagaagaagaagagaagaagaaaaccaaaagtaacagattcagtgatcaaaactattttaagaaattcttagagagaacttctgtaggagagaaacattttttaaactttctcccagcttttcttactttttcaaccatggggacttcttttgactaacagttctacaatatccaacagaactagccttccagaaagaggggtcttgggaaatgctggcccaaaaggtgaagttcaaattccttagcatgcatgtgatgacccatattaatgggtctctgctaccgctccacctccacctcccaccctctcttccaggtgctcaggtccctgcctgagctcaagccctctgcggggtagagtgctctccctcctcatgtctaagtcccactggggtcagctgatactctccttcccccagctggcctatcccaaccacaccagcctcatccatcactttatcttccaatctcccattccactgatttccttcttctaattcccagctccacattaagtgttttgggggaatcttacaggctttgtgtcctttttcttcacctaaattttaagttccttgaaggcatttgtattttataaataattttataactaacttataactaattacatattataactaattactatgaactcatgaaacctaagatcttgtacgtatgttaaataaatggtatgttttaatgaaaataagatgagtttctccaactatgtcagtgtagcaagaggaagagggagatcatgtcaaaacagaataaaaatctcagagtaatgtaatttagcagagtgactgagggatgtcctcaaagcaacatcaggattccaaagttctacaaaatcatcaccagtgccaaaatgttgaacaagaaaccacagatacaaagtcgtggtgtgcaccaagccctgaaattgactgtccagtgaaaaaagaggatatattccctaatctgatctaaagtagacacaacgattcataggaagagaagaaaaagagggacaggtcttttggggtctgttaagtgccaaatcagataatttgctaatttctaatacagtaaatccccaaatttccttcctttctacgtgtcttctattcaacacatatttattaaacacttactaggtatcaggcactgagaaaaaaaggcagctggaaatgtcttggggaaaattgggataaagtatgaggtacagagacacaaaggtttcttccttctgaaagccctagtaaaatgagaaagcaattttttaaagtatattaatgcaatgaggatgaggcagcctaaaataagtaagtctcatctaaaagctgtcaaaagccataagtgggcagatgcatgtgatgtcaactttatgtgtttctttcatttctttcaagaaccagtgactttctgttgccaaatgttcaatattagaataaagaacaccagtggtaatcactcttttaagtccaactcattgcctgacacatggtaggcacctaataaccatctgttgagtaaactaataaatgaacagatgagtgaaaaaaggcaggaaaggaggccttccacctatgcacagaaatgcagtgtttagttggaacttatttggtgctgtaattcctttacactggaacacagtgaagggtgggttatacagatcaatcaatgccttcttgagttaattcacaactcccttaaaaacattcttattaaagatcaaaattcataggtgaaacaaaatatttagatagccctacatgattcttctcccatgtcacagtaatgcaggcaaatttaggactcctacaataaaagtaccatgccagaattttgaataaatagtccattttatacaatcacaataggaaaaaacagtggagcgagtgacagctgaatttggacgcctgtccctcggacggaggtaaaaagaactgcactacgatattagtattttaacaagtttatgttttaaaaaagtgactaagaggaaaaacaaaagtagaacagtctgggagaaggcaagctgatacaaatttgcatcaggtgaactgtgtgttatatattgaatctgactgtaatgccagtaggttgaattaattcatcttatcttacttacaatgccatgcttaacatttggcacatgtgggcatatgtgtgaaacttgatacaaattaaattagaaaaaaatgttggtagtttacatctcattaatagaaaaaataaaccagaaaaattactgatgataatgtggtctttagactaggaagaaccttacaaggaaggtgaggaggatcttttcccaggaggtatttgcaatgaaaatgagcaaagaactgagaaatggaaaagaataaattctttgctgtgtgattaaaaaagcccaatcttttctctcgcatttctataatgctgtgaacggagtgtaggggatcaagagattgttgaacccaaatacaaccctgtatattgtagttattacagaaatcaccttcaagttttccaaacgattcaaagtaccagcaaaaaccacccaaggtaggcttatctcataggataactctctcctttgcaacccacagtgttttatttaataacaccgctataacacttaagtttaccttattatataataattctaacataacagagaaaatatctatttcacagatatcaatactgctgtctttgaaaaggtccaaagatatagtatgtttctgacacagaccaggtcttaataagtgacagatgtatttattatgatgatgttccttactatgatgctattattatttcttatcatacaaacccctcttccagctgagaataagactgtgttcttcatctttgcatcccttgcagcccaagcacagtgactttttacaagcatttgatgaatttaatgttaactgaaatgtcgaagcttatctttaaactaaactggtttatctcatgaactgacctgtttgtatctcaaggaaagaataggtatcatcttccatcatacttgcggagggccacactccctctaaaagtagctgcagcaatatttaataacccagagacttaggttagctctgaactaaaatgctataatatttagaaatgaaaataatacccaggaatgccaatgtaatgccaatgccaatgtaattgcttcaggttataacttccctattaatgattgttctctgtagggtgcagggaggaggttgagagacgaggttaatgtgaaatagccagtctcatccagtccaaagtgatatgaaaattatattaaaagaccatagctgctaacatctgttggctttcttgtgtgtgggccactgtctcatgccctaatatgtgttagattttattcttaacatcttataaatgcacataatttttttttatttttatagatgatgaaacaggttagagagattcataaactggccccaaatcacatcaataataaataagggaatcaggctttgagttcagacctacatgttcccaagtttgaaggagtaatcccacataacatgtgttcttagcaacattctgagttcccaaatctccggctatttagaggccatagttttacctatagcagcaagtgctatgacttatgttcaagacctttcaacacaacacaaaatgattagcttctctcccgttctctaagcccttcccacctgctacagtacctggaaatctaggtaccgacatgcttcttaaagcactttgtaggctatgttcatgtctgagatgagtaacaagttcacagagcctgttcatttatgccacctactctctgagagaaaggaccatgtgaaaacagtgtttattaggagaaagaggatggaagggcgtaatatccaggaagcaatccccgtcggggcaacagccttcaggagcaatactgcacctctaccctgcagcaagaaagtctcaaccacccacattcttattcatctacagaaacccaacaggacaaaactattaaacgttttaaaggaacaaggtatcagctaagtatgaaatggcacagttccacataaaaagcaggaaggcttgttctccaaaaatgccccttggtaaatatttactgggtgatggcacaaataatagggccgctgattagggggttacaaagaagactgacacccctgagcccggatgatgttagccatcagcacagtgctcttaactttccctgctcaagtctctcatgttttatagaaaaatttgaggagtatgcctaaggttggaatcagcctcacctctctctcaacttcatttgaaaacctgaagctactaaagtcccttgccagaagagggctcacccgccccactatgcccaatctaacttcccaaatagatctacattgtttgcattatgtgcttttcattgacatataatcaacctagagatttaggttagctctaaactaaaatgctgtaatatttaggaatgaaaataataaccaggaatgccaaatacagagtcacaggcttgagtaaacaaactctctaggaaaaaaaaaaaaaaaactctacatgtctaaaacttgccaccaaccttcatggttattaaacaataaaaagctcccttgggcatcttgaaccttcctcataacagaccttgccctaggattacttcttggcttatctgttatctagtcatacccaaagccagcccccagccataataatctccctatggtataccaccctgcttgtaaaacttctttgaacaaaagttttcaaaatgatacacaagatcagcatgatatctgaaatgcaaaccaaaatttatgactatcagctagcattataaaaaccatttctggaggaaagtcatgaatgatattcacaactaccaagtcagaagggctgccctccatgttcaaggagtggagaaaaggaatctacacaaaggccttctgtacatcctccctaaaaattattttaaaaaagagaaactgccatttatccatgtgagatatgactggttttcaaagtaatgggtaaaaatgaccaaaaccttgattgtcttcattatggctcacataaggcacacaaactcttttttttatattctaagtacagaaaattgcttcatttctcaagtaaatatatgctagaaacttgcggatatctcaagaatgctttgtagctaaagaaagtaacatcattgcctactcattttgcttaatttgctagtctcccagcaactttgtgctaacactttcatcccattttagatcctaggataaggcaatagtccagagccctggaaagcctccacctccagcagttcaccaggccactgaagccccaggatggagtttctctccaagacacccttctggtaatatacatgttacgtgcatttcacttatcttctccaagttacattccagtaactaagcttcagaagcttcttatgaattgtttattctgtgttttaaagctccatcagctgttaggatgatttgcaatatttttctttttggttaagcaggattggtgagcattactgggccttttggtggaatccttgctatttaaaattcctgctgctgggattaatggagataatgtctttgaaagccttttgtaaactgtaaagtcctagtcaaatgtagtgtgctgttatcacattaaccatcatagcaataaccataaaccagctgtaatgggggctttaaaatgctgaaacccatttgggtcttgtctttgctccattcccacccccgggggcctacaatggtgcccaacatatgggagcctctgaaggaagttttgtttggaggaacaaatcagtgactcagaaacatcacatggttttccaaagtaatgtccataggcaaaaagaagctaagtacgacaatttaaataatgaaaatactctgccaaaaatattggggtcctggaaagaaatgctacagaacaaagttcttctaaagagaattgatttgataatgaaatctggtcctttacagtcagactgggaaggagaaggagtagagacaggtgcagaaatttattagtccagaaaatgttagtccaggatggctcagagaaggaggctgccatcccagaaaagggaagggaggctgcagtttgagagggagtatcaaacagaaaacaaaaaacaaacaaaacccccacaaaataggcaaaagctactcctgcaaagaacattataaatgcaggctttttatctagactgtgtctttaaagtggtggaaatgaccaattctgtgtcttaggagggaggtggcatgaagccgggaaatgactgaggaagggatactgatatgaaatgatttatttctggaaaatgctcttgtaagcgtttgcaggaatagttctggttactagaggggtagtctattttaggtacctatgtataaggaggagtgaacgagtgaacaagttagtggggatgaaaataaaaagggaagtggtagcgtccagcaacacgggcctcattcataaaactcagaagcctcaaggataagaagagaaattccggggtggctgcctgttactcagcaagaaagcgaacactggcttgctggctcagcacttaacctgagatgaggatgtcctaacagccctttttctctaaggggtagtgtagggtggggtggggccaaaaggagaggaggaggaaggcctgccacccgggaggtccctaggactcagcagcagagagggccttgcaccagcgctccgctctgttccagaaaatatcctatttctgaccatcaatcagcattaagccagtttgggggctgagctttaggcacaggcagttgccagtagcaacagggcacacgctcctggtgagctgggcgggaggtggcaacaagggaggggccgcctgggcaagtggcctgcagctgggcagacaaggtcagggatctcccctacacgcgcaagggaggcagtgcggagggtgggggaggggggatcgtggcattaggtggggacaggcgcgccctgctggggccgggccagggagtggcccaggcctctgacctcgctggggagcagggagggagttttcccagtggcacagctatgcccctgccaaacccaatggcctcccggcccgggaaaggcgccactccagtggcccctagacactggagtcaaggccaagcgacaggagaggcgctggccctctgcttgggaggaccacagaactcaagatctgcccctcccctgcagcccctttacgcccccaccctttaggagtctctggaagatgccaacgtggaagtgtttctgcacgtgtgtgtgttttcatttgtgcttcccacacaaaagcgaggccccacaggtggagaggagggcgtgtgtgcgcgcctgtagagcggggctcgggctgcgtgggagctgggcggggatgcgcacacacggaccgactcccacagactgtcccccttcaggtgtcctggtgcaggctttcagggaagggagagcccctaacctcgccccacctcccaaaacttctccccctgccgtcgggctatggtaaaggggaaaggacaggactcaggaccttgagggaggcattgagtcagagggcagagaggggtcaaggagacccaggcgggaggcgcggaagcatacagtctgcggggacaaggactgaacggggtagtgggagccaggtgccgaagggctggggctagggtggcggcgcgcagggggcgcgcctgggcggggagtgggctggcgtctccttacctggccttcggtggagcatgctgctgcgggctgggggcggggtgggcgctgcgtccccaggggttgactccgcagcgccttcacttcgggggcagcaaggcgcgcgctgcagagccgggagttgccaaacttgccatgtccagagcgcggaggcagcctgggccacgcgctcaccgcagcccgggcacctcgcgctcctccgctttgttgtgttccgccgccagtccccctgcgcctgcctgccagtgtccccgagccctctcctgccgcgggacgtttcactggcgctcagggaggcccctcgggtgggcagtgccactttcctcctggaggcgcgcgttaaagatctgcctgggagcgcccggcgggcggctcggcttgcgctctgatgaggaggctggggcccatcgattcccaccccctacccactccccctcccctcccctccgccgggcccccccatcagaagctgcttaggatcggcgctgtcaaatccagcccatctgctgcaatcataatcagtctcaaccgaacggttctgacaaatctccgcctggagctggagttggagaagctggagagtgaggggcggggaagggaggtgggggtgaggggacgatggggaccgggcgccctgagagggggcctggagccttctattgtctgcccctaacggaggaactgaaaagggaagcagggatccagaaggggaaatagtgctttcatttcctagtaagaaaaaaaaaatctattcccgcaggtccctggttcccttcacgcccccacccccagcctcagctctgtctgggtggaacgaatgtctgctaatgaactaaacaaacaggtctcttaatcttatcatggagctgacccagagactggcacagatatccaaagtatcataattggcaggtaagagctggaactaacagccatttgtctggagtcagaagttggttcccaagtgcagttgggaataaagctcttgggggggagaacggccgtgtagtgtagtgtaattggccaggaagcttggcccttggcctcctgttggcatttccagagataaaaggaaatctgctttgggcaagaaaacgctgaattccccttagcctcattttgaatttaaaagattcgcatatttttttttctttttctcatgaaaatactatttttcaagaaatgctattttattagaaaataatgacttcaaaaattgaaaattttccaagcagaaattgctccacctgtagatgaaatgagatgctcctttcaataatatactttgaactattccaaaaattccactttaatacaatcacatatatttgtactggtgatagattcacaaggattatctcaaaaaaatgttttcaagtataatataaatggcagtagtcctagagacatacaaacaagtcttaaagcatggaagaacacaaccaatgggattatgtctagttttatacattcttctcaagtgctgggaaatgtccaattaccttgaatgacagtatttgtttgggaaataatttgttggataaacaaatcaccagtggaaaagttgaagaaaattttaagccctttattcagataggtataagagctaagcaaaaataaatataatttactgtgaaaactgaataaaattctaaattagggctcaaatcattcttttgctttatgctatacttgagaaatgtgtgcaagccacattaagcactcacttatctaggcagagactgtgttttccacttattttatagcccagtggtgcttacaacagcactaggcaactatggacactctatgaatactgatggtttgaaattttgatttacaggtcagaattaaaactacatacatcatggtgactttatagctgaggcaaagtggagctcaagtgttactttcccagtaagcaaatcatgtaagtcaaggacaactactggttagattttacagcctttttttttttttttttttttgagacggagtctcgctctgtcacccaggctgcagtgcactggcgcgatctcagctcactgcaagctccgcctcccgggttcacgccattctcctgcctcagcctcctgagtagctgggactacaggcgcccgccaccgcgcccggctaattttttgtatttttagtagagacggggtttcaccgtggtctcgatctcctgacctcgtgatccgcccgccgcggcctccaaaagtgctgggattacaggcgtgagccaccgcacccggccgattttacagaatttttatgaatatttaagtttagagtttttcattgataatttgtttaatgtgtttattactattcaataaaaattttgctaaaattaacatggtgccaagaaatgagtatttcaaaaagggtcctctcttacagaatgaagtatcatgctggtgactaatttaactaacattgtccaggaaattgctgttgtccaggaagagaagagttgagccgagtgtcaactactaggcttctggcaccatcctgcacaagaaattggtaagttctactgtgttatttcctagcttggtggtctcagttgcatcacagctaacttatagcctaaattgacaggcccacctccaatttattaattccttggtcttaacttcaaaatatatcatctcatgtttactcaattatttattgaacaatcactatgtgtcagtgttggaatatatgaaggaaaaatcaaacaaaaattttttaccttgtggagcttacattctggaggagaagacaagttagaaaagagtacataagtaaattataatgtctattagaaggtaatcagtgcaatagagaaaaataaagcagagtgggctgggtggtgcacaagtttaaatacaagagttctcagtaaaaatctcactgagaatgctaagcctgaatgaatgattaaaggaggtgagggagcaggcaagccatgcaaatatctgggaagatggtcccaggaagtgggaaaagcaggtgtaagtggcccttaaatatgattgcacctggcaaggtctaggaacattaatgaaaccttgagaacaggacacagtgaagggagaggtcaatgagggtaggcttagaagacagatcactgggtggggccaattaaaggacttggaattttactccaaatgacagcggaggacacaagacacagagggagtgacatgatcatctgacttttgtttaatagatcactctggctcccatgttgagaattaattataggagcagagaagggagcagggagatctgttattaggctattgcaagaatctaggtaagagatgatggcttggactgggtgatagcaagaaagataatgagaattggtggtgattttgaattgctttgaatgtagagccaacaatgagtggctcgaaagaaaagagggagtaaagagtaactccaagcatttggccctagcaaccggaaggatgaagttgctattaattgaaatgagaaagactatgggtggagcaaattttggtggaagaatcagcttatatgggttaagactggaatgcctattaagttaaattttaaaaataacttacgtaaagctcttagaatagttcctgacttttcgtaagtgccatacaaatgtttatggtggtgattattattgttattaatgtttgccaaccaaaatgagatgttgaatagacaattgtaccatgattgtggtggtagttgcaaaactatattttgttataatccaattgtacactcaaaaattggtgaattttattgtacgtaaactaaaccttaaaaaaattattaaaaaacaaagaacttactctcatgttttaaaagggagaatatggaactttcccatctgagaagaagcagcttcggaagtatcaccattttgtatacccattgaaataactgatgtaaataaagatcaccaatagatgctaaagccattaagtaaaggtttgatggaaaatagtgaggtaggtgaatagggtctggaggcagagaacctaaggccgattcacgctgacttcctaaagctaaatcaaaaggaaaaccccaactttccacacttaagcaacaaaagtactggaggctgctccctttacaaaccaccctctcctttctgcgtggcagatggaaaattgaaagtatctttgattggttgctttccacaaccaatcagatgcttgcatagggtgtaacctttgtaacttcacttcagcctgattggttgcttccctccgactgattgccggccactccttcatttacatagggtgtacaccaagtaaccaatgggaaaactctaattctgtactggggctcttggatcctattcttggacccgctcccaccctgcggagtgtacttttgttttttgttgcttcaaattttttttttttttttttcttttttgagagggagtctcactctgtcgcccaggctggagtgcagtggcatgatctcagctgagtgcaagctctgcctcccgggttcacgtcattctcctgcctcagcctcccgagtagctgggactacagtggcccgccaccaggcccggctaattttttttttttttttttcctatttttagtagagacagggtttcatcgtgttagccaggatggtcttgatctcctgacctcatgatccaccagcctcggcctcccaaaatgctaggattacaggtgtgagccactgcacccggccttgttgcttcattctttccttgctttgtgtgttttatcaagttatttgcttaagaagccaagaacctggacaccctccaacagtaacaatagaatattccaactacaaatactgcctcctgactttttgttaactgcgaaggggaaaagctgtattagacaagggagaaatcacctgacatgtttctccttatgtgatgctgtatgaaaagttttttgcaatatatttttgcaaaaaaacatgtttaatctgagtctgagcaaggcctttgctataattcccaccttacaggaaataaagatgatagaggaacagataaatgacatcacaaggaaaccattaggcatagcggaatatggaacttgctagaggtcttcaaaaagtcagtgttcatagagaattaaaaaagtagaggcactatcatagattgaaagagacgtgacaaatgcaactaatgggactgggcatcagtgcaaaataagcagctataaaagacatttgggacacgattagagaaattcaaataagactggtattagctgatataatagaattttcattaatttttctgggggtaaaagtgatactgtggttataaagaaagtagtccttatttttaaaagacacatactaaaatatctggggttgaagtatcatggtatctaacacacattttggaaaaaatatctgtgaagtaaaaatattaacatttgttgatgctaagttgtgtgcagataaatattttattattctggtcttttaatttttctatatatttgaaatttttcttaataaaaattgagcaaaatatacttataaaaatccatgctcaaaaagtaattataggaaaattagaaaaatttagaacttgatgtctcaaaaatatccaaattataagatggaaagaaaggagtatgtagaaggagattaataattttagtggacatgtagaaatgaagaaaaatggaaataaatgttcaaagtacccaaacaaaacagaacaaaaaaaaatagaataaaagaaatgaaatcaaagtctaataaaagagaacacaaatcaatacaggatcaataaaacaaagtctggttatatgaatgaaaaacagtggagacataaatcaataagcttagggataataaagactatataactaaggataaaatagattttaaaaataggactactttactatgagcaattttatctgttttcaaacttattgacataaagtgatcaatgtcctaaaataaacttttaataaaattcaataatccacggaatcttgaacaatcaaatagattgaatcagtagttgaaaaaaaatttgctgctgcataaacataggtccaaaattttaaacttattccttgagataaaatttacccaagttgaatttgtttttagcatatgcaccgttatgcaaccatcaccatccccttagaacaatttatttacccccaaaaagtacctattaacattcactcctcattctccagccagaggcaaccaacaatctgctttctatccctgtagaattgcctcttctagacacttagtataaatggaatcatacaatgtttagccctttctctggcttctttcccttagcataatgttttcaagttttgtccatgttgtagcacgtattggtgcttcattccttatttccaaataatattccactgtcttcatgcaccacattttatttatccattcatcagttaatgggcatttgggttgtttctgttctttagctattataaataatgcttttgtaaacattcatgtacaagtttttgtgtgggcatatgtattcatttcttctaggtatatacctaagctgtggaattgctgagtcctatagtaagtgtttaacattttgaggaactgccaagctagtttccaaagcagctgcaccattttacattcccaccagcaatgtctcagcgttctaatgtctccacagcctctccaacacttttatcctttgtttatagtcatgctagaggatataaagtgatgtctcatgaattttattcgcattttcctgatggctaatgacgttcagtatcttttcatgtgcttattggtcatttgtatgtgtcttctttggagaaatttcttttcaactcctttgtccattttcacattgggttatttgtcttttgattgttgagtcaggggctcattacccaatcttcacaaaacttgaaaaaatacagaaactctaataacccatatctcacagagagttacagggaattttttagaagggggaggaggagaaaaaaggaagaataggaggaggaaaggggaaaactaggggaagggaagaggaagaaatatttttatcaggttagaaggactctgataccaaaagtaaatataggctgtatgggaaaggaaaattaaggaggctctcaaaaattcttaagaaaacttaatccatcagtgtggaaaattataacagtagtaataataatggttataattaaatggtgttactaaataagatttatcctgcaatgtaaagatgatttggccctagaaaaatctattaatttccaaaaaaaaatttgggggaagataaaaaaaattaaaaagataatcatttcagtagatgctggaaaattttaataacattcaacacttattcagggtttaaaaaaaaataaattaaaaaacatttcacctccccaggaataaaagggaatgcccttaacctgataaagtttgtctaccaaaaaaaaaaaaaaaaatctataacacgccttatattaaatagttaagttaaagaacatttcctttaaatttttcctctagacaaggatccttccatcaccacttcattttctctaaggtcttagagcagttattatttatcaccaatattatcagcatctccacagaaaatggaagagaacccagaggcaaatcagatatagtaagagagcagtttgtttactagataaaagaacaatataccaaaatggatagtgttcttaagatatgtaccaaattattagaagtgtatactttttaggagatcccacttaaaaatagtaagaacaaaaaaaaatttagaagatacgaataaacttaaagatgtgaaacacctttatagagaacactttgttgaagggcttaaaagaatggagtaaatagtaaaacatataaaagtgatggattggaagactcaatcttctggcttaatctttaaatgtgaaacattatcaaccaaaatctcagcagatttatacactcaacttaccagcgagtcctaaatttatttcaaaaaaggaaaaggcccaaattagccaaatatatttagtaaatgtgaaacctctaacattccaaaaagggtcaggtaccttactataaaacaatgtaattcaacaggtaagagatgtgggttaattggaatagaaagagaccctagaaacagactcacatttatggactcagggtatatgaaagaaatggcattattaattattggggaaggattactgtcaaaaaatggcaccaggttaactttctatgtgataatggaaaaaaaaaaattagaatcctacctcaggccatttgcaaaacctaaactcagattaaaaactaaacataaaaagcaaatttataagactttttgaagaatgctttggaggatactttcatatcaggcggggaagtataatgaagcactttactgtattaaaattttaaaactttgtaaaaaaaaaaccataaacaaaatgaaaagtcaaggcatagactagaagaaccatgaaaaatatgtattataaacagaatacatatcctaaatttgtaaagaaccacaaatcagtgggaaaaagtgaaaaaaaaagtggggggaagcatagaaataggcagttcatagaagatagttaagtggcaataactatattaaaactgcttaatatcagtactggggaaatgcaaattaaaacaacaatgaggtagcatttcatgcctatcataattccaaaatataattcttattacactatgtgttggtgaggatgtgtagaaagacctcttccacattgcaggtgggaataatttggatatatttattaagttgaaggtgttcgtactctgtgacataggaaccccatatctatgtactcacggaaaaggctcacacatacacacatacacacaaccacacatggaactcgcacgaaatccattatattaaatctcaaacttcagtatgttctggaaagtataaccattataaataccacctgttgataacaatgcaataaaacaaattatttaaaaataaaaatagaaaactaacatttaagcaactcttcaatgaaagagattacaaaccaaaatttctaaatttctgaaaaatgacagtgaaaactaccggatgcatttacagcagtggttacagaaaaattggcagtcctatgcacgtgtatcaatgaaaattaaaaaatataaataaaatttcagctcaaaggcacaaaaggaaaaataaccaaaagaaaggaattaagggtaacagtaaaatgtagtaacaaattaacaaatcagaatctagttgcctttcttttttaaatagatcactacataacttaatcatgaaaaaaatgagggaggtgaataaatcaccaataaacagttgacccttaaacaacacagtatgagctgtgcagatctacttatacacagatttttttttcaataaaagttatacagagtatgcctgtctcccgttctacctcctccacccattccacttctatcacccctgagagagcaagaccaactcttcctctttttgctcctcctcctcagcccatttactgtgaagacgaagaggatgaaggtctttatgatgatccacgtccatttcatgaataggaaacattttctcttccttatgattttcttaatagtacttccttttctctagcttactttcttgtaagactgcagtatataacacacataacatacaaaatatgtgttaatagaatctttatgttatcagtaaggcttccagtcaacaataccatattaatagttaagtttttgtgggagtcaaatgttattcagggaattttgactcttcaggggtcagcacccctaactcctatgttgttcaagggccaattatacaagataggaaatgacaaatgggaactaactacagaaacaaaaattaagaggcaactttatagacgtcatatacatggaaaaaacttgaaaacatggacaaaattgaaactttctttggaaaatacatttaccaaaattggctctgttagagatagaaagattaatcaactcttctagaaaaaaaaaaataccaccccacaaaaacatctctaggcccaaaacaaactcccaaaggcagaccactccaatgctccacatttacttcaggacatggaaaatgaagaaaaactttctaattatttttataaagcaaatatagcattgataatttaacctgcaaaagtcagttttaaaaaaatgaaatgacagggtgatgtcactatatatatcactgcaaaaatagtgaataaatatgaccaaaacaatgtaacactacattaaaaaaatatcacggccaagtgacatttaatccaggaatgcaagtttggctcaatattaattgatcctttagtatatgacaccctgttaataaatctaaaggaaaaaaattacaagattctctacacaagtgtttaaataatctttgagaaaactgaaaatttaacactcttcctgatgaaaataggaattgatgtatattttcttaacatcataaaacatatcatgcacacatatgcttagtcctaacatcagtatctcacttaagggggaactacttgagacactccatttgatcaggaacaaggccaggatgtccgctgcctccacttctattaaacattttattggattcaatgcaattatgcaagataaatcaaatggaggcataataattggaaaagagcaagtaaaaactgtatttgtagatgacatggtagtactcctggaaaatgaagaaaattatgataaaaaattaacttgataaaatttagattcagtaaaaattaatatatagaagtcagttgctttcacagacattgatagtaaactggtggaggatatactgatagagaaaacctcatttacattagcaacagagatgaataaatatgtagggaaaattagaagtcgaaatgtataaaacctatctggggaaacgttaaaactcctgtaaatcacaaaaatagatgtgaagtaatagagacattggctgttctataacagaatgactcaagattataaagctgtccgttctaagttactttataaaattaacacgataccaataaaaataacaaggttctttgggagctagactagttaatacttaagtttatgtgaagaaacttccaagaaaaggcaggaaaacactaagaaagaaaatccaggaagagaaaataaagtatacagtaaatttactataaagtttctaaaatgaaaacagtgtggtgcaggtgcgtgtctagacaaccagggagaaacaggtttgaaaatccagaaatagatccaattatctatggacattcaacatacaataaaggtggcatttcaaatcacaaagaagggactttttaaacaaacagtgctgggacaattcgttggccatttgaccaaacataacattaaatgtatacctcccaaaccatacacaagaataaataaatagatccaggatctaaatgtaaataatgaaaccacgccatcacaaggaataaaaaaccacaggtgaattcctttatcagctggatgaaaggaatggttacctgacaatgactcaaactccagatgccatacaggattagtaaatttgactatgtaaaatttttaaaatagtatggtatatcagctttctatggctgctgtaacaaattatcgcaaatgtagtgacctaaaacaatacaaagttatcatcctacagttctgtagattagaagccccacaggcctcactgatgtaaactgaagatgtcaagaggactgcatttttttctagaggctctaagaaagaactcatttctttgcctttcccagcatctagaggctgcctacattccttggtccatggccccttcctccatcttcaaaagccaggaactttatgtctcttacccttttctgtagtcacgtctccctctgcccacaaccaggaatggctgttagttttcaaggacctgtgattacactggacccacctgattaatccaggataatgtcttcaactcagagctcttaccatctgcaagtcctttttgccatgtaaagtaacatttttaaaaattctaagcattctgatatgtatttttttgtgggtaattatttttcctaccacacatagcaagaaaaaactcaaaaacaaaccaaaaaatatttttaaaataaattgaaagacgtctgacaaaatgggagaaaacatttgtagtgatcacaaataagaggctaatatccatccctaaactacaaaaaaaaaaaaaaaaaccctcttaaaataagggggaaaggccaaaaacttaatagaaaagttggctatagtcatgggcaaacaattcacaaaacgacacgcaagtggcctttaaacataggaagaggtagtcaagctcactcttaactagagaaataaagttttaaactacgctgagatactatctctcattcatcagattgggagacatttagatgttgatcctttattctattggtgcgactgtgggtaatcatgcagtcttatacattgctggtagaaatataaattagttcaaccattttggaggaaaatttgacaataagcaaaactctattttcatttaccatttgagtacacattctcactttttggagttaaccctgaaagtgtacttccaataatacaaaagtgcataggcactttgtttattgccgcactatcactgcccactgttgcttaaaatgtcacttaactcatccttggtcactatatatccatttgtatccctattttatggcttatccgtcaggtttggattgtatactacaattcagatttgcagtccttcattgggcttctacaccactctctgcatagaactgagtaaatgtttgctgatttgaacatttttagggctaaacaatcattttgttttcaaaaattttattttggaaaaaagttctcctacataactaatatcacatagctttattaattttgaatttaacccagattgttgtccaatatacttttttttcacagttgttactaagtttctgttttatcacagccagtcttaagtaaggaaattagatttatttaataattaaacctctatgacaatggcccagggccaactgaattcagcacagcaacttagaataagattctactggactttctatacttttcagccacaactgagcacaccgttgttctatgatagcattattgtcattaatgaaatgtataaatggaatgcaactaaatagtgcctggttaaatagttcctggggcttggtaacaaaacaaataaatacacaaccatactctgaagatgaatgttcttgtcttaatttagttattcacacaaccatcattcattaggaaattaatacaatcaggttcatgtgtcaggttcttagaatgagaagtgtatgatccttaagccaaaaaaggttcattacttcaatttttaataatacatcttctagatattttattatctgtatccagatcctctttagactgtctcctgaaattactatgcatatatatacacatacacatatatagtacctgtatttattgttatatgcctatatgctacttttactggaatacttccctttatatttgaggacctctatttaagcaaagtaataacctaagtacaaacagggaaaaaattctccctcatgtacacacatgcatatttttaaagtttgtccaaatccatcacaattgaggcttagattagcatccacatgtctgaaatggctgcataagggggaagggtggtatatatttaaagaaaacttgcatttaagaaattcattattgaccccttaaccctagcatagggatagtttcttttgttttctgttcgtttgtttatttatttatttatttattttttgagacagggtctgactctcttgcccaggctggagtgcagtggtacgatctcggctcaccgcaacctccacctcccaggctcgagccatcctcccacctcagcctcctgagtagggaggtcccggggcttagcagagtggctccaggggatggcttagaaggacatgggcacaggaaatcaaatttgtgatgacttagatccttcttatttacttatttaggagttagtacatcaaggttgcaaaacatcccaagaaaacaatttttaaaattcattctagatcaggaattggcacccacaggccaaaccttgccagttctatgtaaatagcgctttattggaatagttatacctgttcacttacgtatcctttgtgggtgttcttgagctaagattacaaaattgagcaatttgtgacagtgacgatatgggtaccactcagaaaaccaaaaatatttactatgtggtccttaacagaaaaagtgtgctgaccctgctacagaaaatattgccctcttacaagatgtcataaacaggaatgcatactttcaaaaaactattaatgattataattttgagttatactgacacaactagagcaattaaatccatgttataaattctaaggagtcttcaagtttctgatataacttgttctacagcacatacattgctgctgaatatcagtgacattccgtttttaacagtaagaatagaagtgattttagctaattaacttttgaaattaactttttatagccagcaataactacagcaagattatttctagataattaaaatacagtgctcctaatgaatggatatctactataactttgtttataaagacaagtatagttgcttatatcatttcaaattgtgctttgtgtattcaaaattatatttttttcaaaatgtaaacttgggttttttcaatctatttatttttatgaactaggactacaacagttgccaaatttctaaaatatcttataaaatcttaaaattacaaagtcactatttggtaattaaaccgttaaaaatatcaagaagcctgggcctcagaatttcttatgaaaggaatagagttttgagaggtattctggagagatattggaaattaacataaaggaaataatgaaagctgaaattgatacctacggaattgaaaaatgttagcaccatcacaagttcttaaaagttaagaactatattctaggaacttaaagaatgtgttctgcctttctactatttttggcctgtgtaggcaggatattttggaaggataggctgggttgtaccatggtgacaagcaacccctagatctcagtggcttgaaacaaatgcctatttcttcttcatgctagcttttggtggggactctgctcatggtaatcattttatgaccccagctttagagaaaccaccatcttgagagctgctggttgccatgcaagaagaaagagcatgttgggcagttgcagacccacagttaaatgcttcaatttggagtgtcacttttgctaacaattcattggccagaacgtgtcccatgaccccatccatcctcagaggagcaggagttgcaattctatcacgtgcctataaggaagagggctggatatatttagtgacaactcattaaatgtttagggtaatgattaacgacccagccctccagccaaactagttaattaatgtttgtgcttcatttccctcatctgcaaaatgggaagactaaacctcataaaactgtgatgattaaatgacttaatacttgtgaagtgtttagaacaatactgtcatataatgataaagtattattatttctttttaacttttgtacctgccaccctggtcttcagtgccaaaagcagagatgagggcaaaaacaaaagtgggcagtcttaggaatgctgacctggacccagtagggatgcctacaacagatattcttgagaaaagacccatgaccaaatgaaagagatcaaagatgctaggatttccttataagtaacattgatccagaaggtatgaaacaagccattagcagagcaatgatttatttttaacgggaattggaagataagggggataaaaacacctaaactgaaaacaggacttttgtaatatgaaggccagaggatgaacttagggtgtggtcatataatgtataacatggatgcaatcagtggaagatgctgaatagggctatcatatagcatgcatatttgggtaatacggtatatgaatgaatctcttctaatctgtggtttagaaggcttacaccaggctaaacaggagttcaagtaaatgactcccactagaaagagctacggctacaaagaagagaaatgggagcaaagtgaaagtcaacccaacaattatgtagaaacatagcaagtggtagactaatgacatggttcattcctaccagaattcctgtttcctcagtactggcagcaatgagattgctctgaatccatgatcatccatatgtattaaaacaatccttgactgttggacaccaaggagatgccaagataaacagacatgatttctctcttccaggggcttattgtttaacaagaaagacatagggtattaacctaccttaacataaatcagaatgaagtaagttttatactactcacataagcagaacattatgggagtagagaaggagcagaggttcatttttaatatggaatttgggaatgcattttggtggagatggcattttaaatgagattttaaagaagaggaagggatgaaaatggatacaatgaataagataacataatatcatgagaagccaggaaaatgggtaagattgaccatttgaaggaggtagaggagaaatagtttttttttaaaaggaagcttttgttcctttgttccttttgtcctttgttcacccccagtaattcagcagcacacactagactgtctcattctataattgtatgtatttctatcattctatagattctatagatataattctaaaatcattctataattttatgtttatgactcccttttatttacctaaaacattaactataatttttaaatggctatttgatgttaattttatttctgtaatctttaaatgtaagcgctacagttcacatttttctagatggtcacaaaacaaattcaaaagataataaagctgaaaaggattttttttttttttttgagacagagtctcgctctgttgccaaggctggagtgcaatggcaggatctcggctcactgcaacctccacctcccaggttcaagcgattctcctgcctcagcctcccgagtagctggaattacaggcacctgccaccatgcccagctaatttttgtatttttagtagagatagggtttcaccatgttggccaggctggtctcaaactcctgacctcaggtgatccgcccgcctcggcctcccaaagtgctacgattacaggcgtgagccaccgtgcccggccttgaaaaggaattttaagttaaatttttgctttatagataaagaatccagtgatcaaatgatttcctcataattgtagagtggcagactcaagaacttgtagaactcatatcctaatactgaatgtatttgttactttaaaagataaaataatcaagaaaacaacaaaaatgagtccagggttactcttgtggttgctctgtgagtatcatttgtcagaagcaaggtgaatgatgcctataagattgtgcatatatatatatatgattgtatataatataaatagaataaacatagaattaattactaacccctaaaatgtctaattgaggagtcaccaattcaagcttgtctgtgtttaggacaaataaaaggaagccctaccccatagagtagggattaagttgatggaactctttacccaacaggaggtagaagaagttggaaataaaaacagattttaaatggcttatataaattaatgactggcccatcacacagttaataagaaaaaaatagtatgtgtgggtcatgttatgcatgtttgaagttgacatcaaagaagtccttgctttgccaactctgccaaagacagatggcacgtggccatgatgcaccgtggcaattcttgcttctgtttgtgaaactctccaaaggctgtgttttggaagtcatgagaaattgctaggttcctgggttgtgaatagaagatggacattcaaggaaccaatctctatctgtatattaaccaagacaactatatctaacattttattcccaaacaggagcataagggacatttccacattctaactttacatgaagactcaggactttgaaagcccatgagaaagttttcataaggatttatccacaatttcttctttgatttgctcagatgtgaagcaggaaaccttccagacatcctgaacctctgaactttttgtggattgcccatcaacacaggcaaacattcatgaagcaattcaaaaatctcttctcactgcattataagcatgtccttacgttattcatatatcaagagcatgcccattcccaacccacaatggaatgtgagcctaattacatgttcctttggaataagatctcaccagcccaggagtgtcagaaaccctctatcatatatacgtatcttgtttccaaaatgatcttcccaagccaccctaacaggcccccttcagaatgcttcctgctgacaagtgaatctgctttttgcctttcacccaatctcagctcatgctttctctgtgaaaatatcacagaccacatctgacagtggtccagctaattaatgtactccaatgtctagcaagcatttgacaggaaaaataatctatacagtatttattgcaaaatcttcaccaatgtgacaaagatgaatgtaaactttacataatcatttttcatttgttatccaaagttgaaagtgattttcaaatgctaactttaaaattatgatgaggaagataacagctctgctttaaaactgcttggcaatggaatttctatagtataatggtttagcaatgagctagaaaaataaactctcttgctaatgtagtaaatgggccagaaataaacttctcagggatttgggtggtggggtggggtgagggaggggcacacagaggggatagtggaattggatttctggaataaatgatctgaaacccttagcacactatatcttcaaaaagcaatgtcttcctttatataatgcacgtatcaccatcacgatacgagagcaactcgaagaatcttaacgtataccacggtaaacacctacggcacccaactcagtctacagcaggacacccaaaagttaaattcactttggctgtggctgtgctccaggtacatattttctcatgagctttgtttctttgttctagaaccatccttcccaatattccttaacattgaaattatacatgttaaattaattattgttcatttaactgatgagctgaaactcacgtccttccttttgaaagctaaagtaatcttctaataaaaggtcaggaattatcaaatttacttgtaattattactaattcttctgtgacttcttttttttttttttgaggtggagtcttgctctgtcgcccaggctggagtgcagtggcacgatctcggctcattgcaagctccaccttctgggttcacaccattctcctgcctcagtctcctcagcagctgggattacaggcgcccactaccatgccaggctaattttttttgtattttttagtagagacggggtttcactgttaaccaggatggtctcgatctcctaacctcgtgatccgcctgcctcggcctcccaaagtgctgggattacaggcgtgagacaccacgcccggcctcttctgtgacttcttaaccacaaataaagtcttggccttggaaaaaggaagatctgaaacagaacaaggcaattaaaaagtgggtggaggaagtataggagtagtggagaaaaaagaaaggaatggattttctaaatttaaaacactctttgccctttcctgaaataatgacttatattctttgagttcacaagagagtaattggatatgcatgatgcaatgctggaattttaggtattttgcctaaaggttattaacaattagtaccactaggggaaaaatcataaagttagttagaataacaaccctctctcaaaggataatgaaaactggacttgtaatctggtcataataaaaatatattatgtttatattggagcctcacatgtcaagaggaaaactcacaaactagaatatgtccaacaggtggccatgactaaatgaagactgaaaaacaagttgtatgaggaccaatgaaggaatcttcctttgaagcagtaaagactgcgaaaaaaaacatgaaaaactgtctttagataaatcctttaacaggaatggtacacagaacagggagatgttataagtggagctactgatgacagcattagagccaaagggtgaaaggcagatgttgagtcattcaatagaagaggtgtctgatctcttcctatccaatgtagcagaatccatcccatactatatctgaaagatgaccactttgctttgacatttgcagtggtacagaactcactatctcaagaataccttcctcgggatggtaataagtatgagaaatgccctttctagttctaaatttcttctccacaagacaactcattccattttcaaacaattattagatctatccatctcttagtcttctatttgtcaagcaaacatctccaattcctcacatcattattaattcagtattgtgaaccttgtaccattttagtcaccagctttgtggataatctttggattgtagtgtctgtaactgacatccaaattaagtgctcttgatatggtctaactagcaactgaccccatccatatttctatttccaaagcagagaaacaagaaaatcaattggccaatataactgaataaatccaggtaaatacatatttggctttcaattagtcaggaagtctgaatttctagaggatattgaagatacagcatcagacaatgcatttgtctgattgctgacaacttttaatttccctgttcaagaaaatcgatcaatgtgtgttagctaaacacctgttatgttcaaccctgtgttagtcatcatttgatgtgtaacagaagtgtaaggccaggtacctacaatatttgtagagtcaatactaaggtacatgaaataattttagagtttttacaagatatacatcattatgtatacttatatgaaatagtctcaagttcagcagggaagactgggcccaggtgggctgaggaatgcatgtgaagaggtagggaggcaggaaacttgaaggatggttagggcttgtctatttggaatggagagagaggccacaaaggagtgcgtgtgtagaaataatgagtaataaaggaggtcaaggttagtagggacgtgtgtggttacaaatagaaatatttggatttgtaccataacatttctattacaacttcctttctcccattccaaacatgcttggttttacagaaaaaacttccaggactcagatttccatgggtattagtttgcaaactaatccctgatgagatattatgaggagctaagagagtgatgctagaattctcaagtggcaatggcaaatttcagggctgacttcctggataaccaattctttttttttattctgagcatgggaatttcagttcatccagcagaagaaatgttttttgatagatgtgacttttggtacattttgaattatgtcatcttggggacaaatggtcccaaaagccaaggtcctaaatgtgtacatctgatccaactctaagaacttttgctcagttgtgacgtcaaagaatttctattttagagtggtcttctgcaactgataccatccatatttctgtctccaaagcagagaaacaagaaaatcaatttgccaatataactgaataaatccaggtaaatacatatttggctttcaattagccagggagtctgaatttctagagaatattgaagagacagcgtcagacaatgcaatttcctttaatagggaccataacctcagagttgctgctctgttttttaatattgtacaattaactttttttttttttgcagcacactctgcttatagcttctgtggaaacttaaacattattcaatagaataatttcctggaaaatcttttgaaagtggtcacagccctgaccttgctctggtgccctgggtccaccagcatgctgtttcattacctcaggaaggtttggtgccaagagacagtccaagagttagtgcataaagaaagctaggttcataaaagaattaatatctgccttctttcaaggagggaaactgccacttccaaccattttatgcatctatcacttctcttctatcttcatcattcaacccttcaactggcctacctagatgacaggtaaaaattatagatttttaactcttaagaaataactgccgaagtcatttcttccaaaccattctcattaccaatgggaaactcaggcccagaaagcctaaatgacttttgcaagaccacagagtaagtagcagagtcaggacttaaactccacattgcagaagatgaaccagggatgatatttttaaaacttagcaatggtatgacaaaatcaccaaacagttagaatagagcctctgattgtactggtgtgccattaaataccagccccaactggattacagtgtatatcagtaatactttaagggataaagagaaaaaatgtgccacttactatcaagctatttaaaggagctaggtaataaaataatcataatttatttttactgttggttcttccctttttcatctttttgccttttttttccattgtctttcttgttactaatcctgtgaaaattcaccctctgtttggcagcccgggtcattgttatttgtgctaagctcctatattattagtctgttatcatattgccataaaaaaactacttgaagccaggcgaggtggctcatgtctgtaatcctagcactttgggaggccgaggcaggcagatcacttgaggtcaggggtttgaaacccgactggccaacatggtggaaccctgtctctactaaaagtacaaaaattagctggaaattgcttgaacccaggaggtgaaggttgcagtgggccgagatcgtgccactacactccagcctgggcaacagaacaagagtccgtctccaaaaaaaataaaaacaaacaaacaaacaaacaaacaaaaaaaaacagcacaactacttgagactgggtgatttatacagaaaaaaacattttattgattcacagttccataggctgtataggaagcatgggtggggaggcctcaggaaacttgcaatcatggtggaagccaaagcaggcacatcttacatggccagaggaagaagcaagcaaaggtggaggtgctacacacttttcaaccaccagatctcatgagaactcacgcactatcacgagaacagcaagggggaaattcaccttcatgatccagtcacctcccactgggcccctcctccaattctggggattataattccacatgagatttgggcagggacacaaatccaaaccatataagctccattctgcattcaagtgtatgttggtcttgccaaaattatcaataccttctccgtaaataccactttcaagccttgtaggttaagccctgattatgtttgtaaaagtagcttgatctacatgtctacaattgttctctaatttgctttatccaaatggaaaaaaaaacacacaatattttaggccttgattttcatcatgaatttttaaaaatctaaaattgcctcttcattgtgttatttcaaaatcatgagatatcctttcattgcttctactgataaggttgtttgtaactcaaaatcataattggtagatcaacagaataaaattatgagatacaaatatacatttgattattattgctactggttagagccttcactatgacatgcagtgacatgctcacagaaatgacaagccctaaaacttcttgctttttggttaaacactttatgattaaacatttcaatctttaaactttctaatagtatcttgaaattgtgtatctcattttaacatttttaagccacttagacaaatgactttttgccatgcttgcttgactttttttcttgcatggacttacagataaaggtggtctcatccctaatgaacatatgaggccacaagaatttctcctttttttttttttttttttttgttgttgttgttgtttatttttgatacagggtcttgctctgtcacccaggctggagtacagtggcaggaacaaagctcactgcagcctcagagtcctggactcaaaccatactcccacctcagcctcctgagtagctgagacccaggagcactcaccacttccagctaattttttgtagagacaggatcttaaactcctgggttcaagcagactgcccacctctgtctcccatgtgctgtgattacaggagtgagccaccatgcttggacagtttctcctcttgaatcatcaacagtccctgtaaagtctcaagaaaagtgtttggagtatccataatgtgctaagtcacttaggaacaaagttacacaaaacacatccccagtttttgtctctatgctttcaagatgggtgaaactttatgtttgaagtttcatgttttatgccaagcatgatgagagatagaggaatgggaagacttggtcttacaggttaaagatgtgaaacatacaaaacatgctctcatgagataattagacaaacaagtcagtgtgattgagagcaacatgctgggaactggtttagaggctcctggaggtaaggacagagtcactgttacatgtttggggtattttgctgaagcatcgcagaggcagcattgtcctcgtcaacaggagatggggcgggaggaaaggagagcagagggctgcaaccaaagcaacccagggtccaggtgacagatctcccctattggtaaaatgtgattcatgtggtagcaccgcactgggagcttcagtacctttaactttctctctcaggcttttacacctggtgaacgtctagaataactgccacagaaaatacatctatgacatttaatcactgagtgttcgagagaaggcaaagcccggacaccaagtaagccaggtacccctgaggcaaactccagaggcttccctgggccgtgaaaccagccaaagaaggcaaaattcacccaccctccaaaagacgtttgcgttcccacgcatgttctccgccctgagatagcttagaacacagctctaccaacgacttttcatttccattaacctattcctgattctttgattcaaggaaccttgccatccttagctctttggattatttatgaggtctgatttataatacaaaattatacagtgtaccatagttaaaaccttgaaggaaaaaatgcattttgtatttcttcttcttggagaggcccaaacacccctccccagggttggaaaggagagtggaggtagggtaatggaactccctctcaggcctctgaatatggagaaattaagaagaatgggatggggttgggggacagaggtagtaagcaaacaaatgacttatttttaatctagagttacccatttggagagagatacagggttatatcctaacggtacctttttaaaaaataagtcataagtatgctcatgccctaacaagttagtgaatttttccagtaaaattaaaattaaatagaaagccatggtaaattacccatttcatttctccttctagatttaaaaaaaaaaaaagaggcactttgtcgcttcttactgtgagtgcacttcagccttaatacatgcatttatgtcaagggggccatttacactgttgtctgctggagtttttcttctttcaacttagtagggaatatttgtaatctttattaccccaaataaatctacaaaatgccttttgcttgaggccttttattttaatttcagataaataaatcacattaggttcctggctgtcatattaagataagcatggatctaaaaataacaaaagtgtgttttaagctaatgtctttagattaaatagtggtaaatttctctgggtgacccccaaatcgtattgatgttgggatattttttggtacttttggagtgtttcttgaagaatataaacctgtttaaactagaagtggagtttttaagtcatgtatgggcctacttgtacagtattattcaaatccaagcttcttgcggtggcagtaaatctatcttttaagtacgaatatttccccagttacattagggatcaattttatatctttgttggttaatagtgactccatctatacagtggtttatttattaactataaagatcctagtcctgaatttctcgtcatcctctgtactgttagagcttaaagtcttaaagacaattcaaattcaatgtattccattactgactcttcatcagccctcactccaattctgctcctaatcaagccttggttcaaaatgccacctcctctgggaagccttctttggacttctgcaggacagagtctcctaaaatgtgttttatagaaccccctccatccctcaatgccccagtggaataatcttgataaatgtgaaatgtttcttgcaaacaaggtttagagtgaagaggaagggataaactcccaaggttaggacctaaatatatgttctatgatgaattaaagaacagtgggcagatttgataagaaacaggaaatcacagatagaaagtgagtgcagagttttaccctgaccctttttgtgtctccttgccccagaaaacctggattcaaactctaggcaccccctaattagacacatgcatatcacatacaggtgacctaagtaaactataatgaagatcgatcccaaggtgcaaggtgatatcttctgggtgatctggttcaatcaaaccagatgtctttctggacgtagttctactaaaccctgttgttgctggaagaaaggttcttggaagacagtgatgttatttcatcaggggcttcatggttataagaagcctgaacactcccttgcttctctaaagtatgaccagcagtctataataagtatcctttggtggatagcttatcccatagctctccctacgaccgttcaggaataacataaccattgaagcatgtggcaatacccaatttcgagagccctggtttcatctcccttgtgctggacagagggcatagctgagaggccagactcttatcctggcaggggtctgggactgtctgcatctctgaaacaactcctggtgggtaattggggagtgacatttgatgggtttccagggtggctctggggtctgcacttggctgagaatacagctatgatttagaaattcatcccaagggttgagaacagggaaagataatgtgaggcacgctagccctggtctcctttgacctcagcagggtgaatcagggatgcagaacaggaaaccatgtgctgttattgagttggcatagcgtgatgttttgctttcagagcttttattgctattacagagcactgagctctctctttgtttgctacacattctctccccaagagacagcctcttttcctcttgagggatttaaaaaacaaatcatagttcttattttattcagtgtccaccattaagaattcatgcagagcaattttacttgttgccaattaagagctcccagtggaggtctatgattacagtgaaggcaacctgtttaatactcggcgtccccttagtctacataaattaaccccatgaggatagaggcatgctaattcttaagatgcctggatgataggattcttagatacaggatacacagaaggtacatcttcaagaggctctgggcctgactcttctcagagagcatgtcggctttttcttcttacctgtattttacaactacaagataatttctagataacattttagcaaagaatatttcttcctcaaggatagaataatggcatgtggcctcgcagcaagcaatttctctctctcaatttagagctggagggaacgttagaggcaccagggccattaacctctagctaaaaatgtatagatatatcaaaattatggagaacatgaatgagcattttgagcatggatcattttatttcaatgttcactctacttagttaagacatatttgaatcataaggagaatgaaagcaaagtttttacccaatgttttcctatttctgttcttagaataagaatcacatgcaagccagaaaggaaaggtaaaattccattttaaaaatcttggatatataaaagtaattatcttttttttgctagaagggatgagccttagaggatcttcttctgactagggactatacatgctttaaaaattagtcttttactccccctggtgatgtaggaaaccatcagttcccccgccttgggaagcaagagttaagtcttttacttgggcaaatggtttgtaatcagtagtttagattcttggaagtttgtactgaggctttgacttcccctcaggaaattagtgaggaacttgggattgaggttcctacaggttgactttccccttttaccaacaacccagactcttttccccttttaccaacaactcactgctagatgcccttaagtcacccagcccagtaccagtgaagcaggtggtacaagtcatatgtattctatatttggatagcagttagatagatcaccacttccctcgatatgttccttgaaccttagagtagatgctctaagacagataggatttggagttttatttttaaagtaaaaaataaaattttatatccaatatttgcatatacgcagcacatgttagcaggattaatggctctgagaagttctacaattaaaacaaaatgtttaagacttggttttacctaaaattttaaaaatttatttgaccatggagtaccctcatttttcttaaaatatctatgacatagtgacgcagagtattggtgtttcttggaatatactcaggaaaatgcttgcatagattatttagaccactgatgctcaactgtgagaggggacgactttgtcccttagggaatccttgaaatatgcccagagacatttttgttgtcacaactgagggatactactggcaggtggtgtgaaagccagggatcatcctaaacatcctcccctacaatgaagaattgtctggccccaaatgtcgacagtgccttggttgagaaaccctagtgcagatatagcttgttcaaatgaggcttaggtgatctggaatccgtggttggtagctggcactctgcattcagattttgtcatttgattttgatcatggagacctattactcattcttcattaccttaaggtttttgataaaactgtcaccaatttgacttatgaaaatttgaaataaagatgctaacagtcctttcctgaaacaagcccctccttggctggggaccaaaccaactgcccttataacactaacaaattagccaacaagattagaaattatggctcaggagtcatgcagccagaggccgcaagattcctcacatgtccagctgctcctgtgggtaacatcattatggtaaaaccaaagattggtatttgaggtgtttttcagaccctgcattctcatggatcaactggcaccatccagaaaggtgaactggctcatcaggtcttgcagcccccacccaggaactgactcggcgcaagaagacagcttcgactccctatgatttcatcccgacacaaccaatcagcactccccattctctaacatccccacccccaccgccaaactatcttttaaaaactctgacctctgaatctcggaggaggctgatttgggtagtagtaaaactccagtctcccattaacacaaaaagaaagaatatcttaagtgaatacttggacattatctagttgagctactggcaagttgttagattgttccattagtcatttctactcataggttctttgaagctttctatgacatttgtattatgtagctgtatcattgcataatatttaagtgttatttaaaaacatgtgttttataaatgcaatataatattccagacaccatttcataatctcagtgctgagtaatcttaaatactagctatattaataccttcttttcacagataagaaaactccatttcagagatgttatttagcagccagtttatgcaggccagacaagagtccaagtccccaaaacctccagtccagttttcttcctattgtgtagtattatgctgctctcacttttttatatataattttacatttgtggcttgaaagtaatttcaatgccataagcattcataaattcaatttgtatattccacctgtttattctaaactcttaatatgaggccgcaaatggataaagattttttatcacttgttaggaaagacattttcagcacttttttcttatgtttcttgtcacaaatatatttagccaaatcagaaatagcaacaaatgatataaaaaaattctttttctcctaatattaacttttcacattagaacaaatagaagtacaggaaattatggttgtgtttcaacctgaactagtatacaggttgtcacagtgtgtgtgtgtgtgtgtgtgtgtgtgtgtgtgtgtgtgtgtgttttaaatcaagcagggagatacagagcagattaaactcaccccgacttatgctcaagtcttagactaagttctagattctgactccattctcttctttagatgaattctcagttttcctctttaggaaggatttgttgctatcaaaaagacaattgagcttttaaaggactgctcattgctagacagttatttatgaactccataaattcctttgcaacttgaaaacccagagatagattataggtctatttcaacagaatattagacaggaccccaaaataaccagttatctcaagagtgttattgcaatatatttttgtgtcacagcagatggttatgctataagaaccaactaaagttggttaaagactagcagccccctccatggaggaaaggaaactttttaatctttgcacctagtcctatattatttatccaagtcttattcaccaagtggcaacaagagtatgccttatttcaaccatgcttctgatcagtcctcaaaggtggtagccataaattaatcctgaccacaattattattggaagatctagatgttcagaacttgactctaagttagctccagtataaatggaaggccaccagttaacattagcagcaatgacaaatagcccactccatgacaatggtagcagccacaaatcaaaggcatataaaatcagagaaggagcctatactgatttatgggagcatttgtttaacttcaggcaatctggttgtgcttgtgaacatgacatgctattcccatgatcccctgtatatcacagattctattctaacttatgaacaagcacttaaaaatttaatcataaccagaaaggatttcctacactgttcactgtcactcacatattcttctctaaaaacaatttggctacagttgttgttatgaaattgtaacaaccatcataaagcctgtcactttaagtcagtgaagtcaggatctgttggcaaaaatataatcaaaagtaatttcatgattcaataaatagtatataaatctgctattattggagttcattttctttcaataccacccatttccatcttctcaatggaattattctgactatccaagtgtcattattaccttctattgttatttaaatggagcatttttattagatcctctgacactatatataaggctttgcttcctcagcagtaataattccatttctgaaggaaaatagaagtaactgtacagaaaattctaagctctcactttatgttaactccatgcctgaaatggaattttaatttaatcatatctgagaagacctaggtttttattagctacctcaagaaagtaagaaaaatagccctttccatgcaggttgttttggttcaaagagcccatgaaaccattattcatctataataatgcgtgtaagatacacttactaaccaaattaaactctaaatttctttcatcagatggcattcattattttttgtaaatttttcttttggaagatgggaaaaataaaatattccgtataaatagttgaaataaaacattataccggttatacagttttaaaaatatactttccaagagatctatggaaaatataattaaaaggatacaaccatacatgttattgctgatttaattaatacattggttcacaaaataaaactatcagaatcaggttatagttctcaaagacaaatctagcaaatattgcatcaattacataaaattaactggtgtgcaacatgacgcatgtatacatatgtagtaacaaacctgcacgttgtgcacatgtaccctagaacttaaagtataatttaaaaaaataaaaataaataaataaataaataaataaaaattaactggtgtgtccattagggtcgaacagacttcactgaatttttgttgtatcctaccagcagtttttctatgtatagaaatagaatattctctattactgtaatcagaggtctgtcttccagtataaaaacaaatataagaatataacaaattaaaacatatagcactttacccaagacctagaacgcctgaaagaagataaattttgaggttattagaatttttacagtggcgcaacaagaagaggcaacccggcctggtgaggagccccatggtgatggatttggatgaggtctagcaagaaaacaagagagttagtaagtatttacctgccatctctgtgtacagagagagcactctccccatgccgcaaggagatgaaaagaaataaaggggccgggcccgggggctcacacctgtaatctcagcactttgggagtccaaggcgggtggatcacctgaggtcaggagttcgagaccagcctggccaacatggtgaaacactgtctctactaaaaatacaaaaaaaaattagccgagtgtggcggaaggcacctgtaatcccagctacacgggaggctgaggcaggagaactgcttgaaccagggaggtggaggttgcagtgagccaagttcctgccattgcactccagcctgggcaacaagagcaaatctctgtctcagtcaatcaatcaatcaatgactttaggggcttactgagggtgggtgagacaaatgtacttaataaaacaatttcggtacaatatgaggcatcacgtaattaagcaccagcatatttatttcatagaccgctagcaagactaatgaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctctctaactcattttatgaggccagcatcattctgataccaaagccgggcagagacacaaccaaaaaagagaattttagacgaatatccttgatgaacactgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaattaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagcgcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaagcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaacatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagattaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattgaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaagaaatgctcatcatcactggccatcagagaaatgcaaatcaaaaccactatgagatatcatctcacaccagttagaatggccatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcacaagaacaaaaaaccaaacactgcatattctcactcataggtgggaattgaacaatgagatcacatggacacaggaaggggaatatcacactctggggactgtggtggggtcgggggaggggggatggatagcattgggagatatacctaatgctagatgacacattagtgggtgcagcgcaccagcatggcacatgtatacatatgtaactaacctgcacaatgtgcacatgtaccctaaaacttagagtataataaaaaaataaaaataaaaaaaataaataaataaataaataaataaatcttgaagcaagcaaggatcaaataatttgggctctagttttcacattacaattttgccattccaagatgatagtttcttagaatctaacagtttttagccagacaaggacttagtatatattctgtagtctaactgaaatattttagatcagcaaagctataaaggatgctacctgagcaagcaaataagaacatgaattgaactcacctccagagactcctgtgttgctcctcaagctgagtcagcagatgctcaatgtatttattggagtccatgtattcctgcacaagcagacaaagacagatgaaaactcactatgacagtccccaccatcctaagaccctgaccttatctctacaaggagtatttttgacaacattatccctacttcccttccggttctaggattctctgcttctatgacttgcaatcatatgtaaatactattttttcatgtcctatgatagttttgtaaacaaatcacagaagtgaactgtcattacactgagtcagcattacaatcctcttattcacagaagaaaggcctaaatttcatagtcatctaaactggagtctgtgttctactgtatataaatatttctgccaattatagaaaaagaaaatagacaaaacagttcttgattttactggtcttatgacagtcatgttccagcaaaagtaatgttttcaaactatgtagaatgttttatataaatataatatatacccatattcattgggcacttgtatacactaatggacatgtccatttttcttcaactccatatatacacacaaaacagtgtatttgctttttttttattcttaaacataaatctttggcttctaaaaagacctgaaaggtatggtgtattctgctctatagaaatgtatatgtaaatttatttctctaaatcaaactattttcctgaaatgtatctgaaaaaaaattaaagaattcacgtgttacatgagaagtaagcagaaaaatccataggttattacaatggatttaatttgtgatttctgcatacgaggctcatatgcaatggtgtttcctttgctaacctggagcaaatacaacctatacaaattcttttgtattgttttcctctgaatctggtattttattccctttctgtttagaggtctaccgtgcaggcctctgcttctacattatagcagccgtcgatggaacagtattcaatgatttcaatgttaaggcacccaagaaagctagagttccatttctatagatttgaaataaactgggaactttgattaacagtgacatttttctttcagaaatataggtttcttttgaaatgctatacataatatactgctcttatagaaatattcactataataaggtgaggggctgggagaaagacaggagttgatcccatataatggaaagggaccagtcctgatttcttttgatcctggatctacccatgcggccttgaaaagccttttttaccttcccaaaatgtttgttagactagagggtatactaagtccttgtctagctaaaaactgttatgattctaagatactgtaattctgttatagataattagctaagaagttttatgcttattgaataaacatttattttcaggtgactactcaatagttatttaaacaagaccactgggaatgttaaaaacaaagcagaaagctctgctactgcaggaagttgcaacatacatggttacgcttttaactgtcctgatcaaggctaaaccatgatttagaacacttgacactatcaaatacatgaattctcaaatatgttcagccaagaaaaactaaatacgttgttcccaagtagaaataaatgtacagatcttaaagttattcattttttcttcacttaacaactatttttaaacatctgttagatgcgaagagctgttctaagtgctgcagatacagtaatcatcaagagggggaaagccactgccctcaaggagcttacagtctgtcaaaggggttatactaaataagtgaacggattcgtttcatgttggttacgtgctatgaagtaaacaggtgataggaaagactttgggaggagcagctttgtcacgtgaagactccagaagaagactctaagcaagtgatatttgagctaagacttggaagaggagaaggaaaccatatagagaaaagggagccagacattacaggcagagaaaacaccatatacaaaggtcctgaaatgtgctgttggaggaacagaaggaagccagtgggtgctgggaacagggactcagggatactgggtctaaaatgaagttggacagttaggcaggaccaaatcatgtgcaagccttagaaagcagcttggacttgtcattttgttcattctgattatctcaagtcagaagttgaagctgaaaggtgtagtgatgacaaatgagactttagtatcaaagagactgaggttcaaatcctggttttgatacttactagctatgttcccctggtcacattattaaatctctctaagccttagtttcttcatcttcgtcagagggataaataatgcttcatttatggaggcattgtaagtgttaaacaagaagtttaagtacatacataccatcatgactgccaaatagcaagcatggcctttttcagagtattatgtacctcttttcaaaaggaagatcactttacaaggtgaaggcattattcattttctcttctcttgccaaacttcaagatttttaagtgtacagttcttaggttatacacactaaatattagaataggcagttaggcagagattgataatactgatctctaatctgaatgtagttgtcactggcttgtgatttcaaagctatttcaaataaaaatactagctgcttccatttaaactagctttatcctgttttccatataaataactatgatgacaaatcttaaaccacttaaaaatgggaaactaagattattgattcttcatccctcttttcagctttattttttctctatggcattcttacttccaacattcaatatattttacttatttattaaggtattgcctcaatataacgctaacaaaaatggattgcgaaaagagacattaatcttacatatattttttgttaagtgaaattgtttttgctcaacctgaaataggaagtaccttcatacctgtatcatttctggaccctgaactggaaaagttagttacctaatgtgaaaacactatcataggattataaaataggattactcctagggggaattttgtggatccctttggagattaactccaagaaaacaatggagggtggtagcattggggctggcagtggttaagaggaaactatggtcaccataagtaaaatgctattggcacagtggctgcaagagctttgggagcaagtacatacaggaggttattgtacagagacttcagtatcccagcatgcctgcaaaggcgaaagaaaaggtccagagagattttttcagagtaaactgaaaaaatgcaacatggaacccatgaacaagtactgtaggacaagagagaggacatgatccttaatcataaaagagggtgtgacggtgaaaattatttacataagaaagatatgtaagcattttagaaagagcctcagacatgctgactagtatccagaaagatgtggtctctctgacacatgtgaagaaagttcttttttaatgttgagatgaaaagacagcagaattagattttaaaagataatagggtgagcagccaagataataaaatgacataaaataaagacagggctgagtgagctaagaatttcagggcaacatacaccttacaggcagaatggaaatctatttattgctgtcctgtgattcttattatgaggtgactctccctaccatgaaatggtgcttcagagaaagcaggcaacaggttttggtgtattggcactgaatcgttcatacagatgaaagtctatttctcaatatctcatttgggaaacaatcaaattccccaacccaggccaggtacttacatactcctcttctcctatttctacagtataagtcaattagtgtacgtatcattcagttagtgaagagcaagcatcctgtcatctagggagaaaaaataaacacccatatccacatatcccttgatgtcagtgttcactattcctaacacatatctatgaaaaatatcaatttcccaagccttgctttgttcagcatgcaacttcctacctcattcagcacaaagatactattaaactattgttactaacttgatgaacatcctattctactggtttctgttagaattacgaaacccaccttagatacaataaacagtagaattgacaacgaaaacttacatacagtcctgaggaggataaacttaatctgtaactaaattaagaaataaaggataaggatgaaaatgaatgcagatgtgattgataaaaaggccagaaaatatcagtttgtcaaacaatgatagaatttgagtacttgataagatttgaaatgcaaacaacaaacaaagggataaagaaatatttcagcacaggggaaaaaataaggacgtgattatgtacatcaaaaggactcatcactttccaggtagagttaacggaaaacaatccacacatctattggcacaagagttgaaaaaaaatagtgaagaaaaaaaagggggacttgtttgaatgcttatagctcaacaaggagcaaaaccacatagctccatagcttccagccaccccaaatgcccattgaaattagtttatagacaaaccataaatattattcccaattaagtagctcctatataacaaagcaacagaaagacattctcaggcattcatgaattcataaaatacaggacctacatcttttaattaaaaacttatgtttttatgcatatgtgtataaccaaaaggtgtctgtgtgcaggtaagtatatgtacatatactatgcattatctatgcacatatgtaatacctgagcaaagaataaaaaaatatggaattcacaatataaaaagaggcttcaaaggaggttcatccccccaaaaagatgttttaaaaagtaattacaaaacaaacataaaatcccagagagaaaaagtggaatatacattatctatttttgtgatgggcagaaggaggacaagagggaaagaaagagggaactgttaatagaagggtgcataaatcactttgaatataggggaagaaattattgttctatttttttttttttttttttttttttttgagacggagtctcgctctgtcgcccaggctggagtgcagtggcgggatctcggctcactgcaagctccgcctcccgggttcacgccattctcccacctcagcctcccgagtagctgggactacaggcgcccgccaccacgcccggctaattttttgtatttttagtagagacggggtttcaccattttagccgggatggtctcgatctcctgaccttgtgatccgcccgcctcggcctcccaaagtgctgggattacaggcgtgagccaccgcgcccggctattgttctatttttgactcgataataaaaaatgcttaagtataagggtgtgttttgcctgtgtatgtacaactggggaaagcaatttggtgatccatgttgtgattttaagacatccgtgcccttttgatgtagaaactccctgtctagaaatcagcctgaggaaataatcagatgaaagcaaatgatattcattgaaatactatttgtgacaatatgaaaagactgggtatgtcttattttccaaaactatagaaataattaaaataaagcatgcttttttcgtttgaagaaatacaattcttttttttttttttttttttttttttttttgagacggagtcttgctctgtcgcccaggccggactgcggactgcagtggcgcaatctcggctcactgcaagctctctgcttcccgggttcacgccattctcctgcctcagcctcccgagtagctgggattacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgaagaaatacaattcttaaactttgtaaagaatatataataaagtagaaaacagtgtaatgctaagtgaaagaaggataaaaaaactgcacaatccctcttatcacaatttagaaaatatatatgaaagattaaaagtaatatcctacagtaaatggtaatattatgggctaatttaattttcttctgtaaattttttctttgtctatagttttacaaaactatatgctcattataaaaatttaaagtaatggatattatatagaaaaatacagtcccagaaaataatgtccatgaagatttgattataaattttagaaagcttgatctgaaataccacaaggaaaccatttcctttatattattctaaagctaggctcatgtttgaaacaatgaacccccctttccacttgccctcgttagtgttctgataaaagcatttcaccaaagttaggattaagggggctgaaggtggggggcaccaagttacaccaagtcatattttatgttttaaaaattttacaaaggtacagcattaaaaagacatctgttccctggctaaaacttatgcaaattagaatcattttagagatatatttcaggaagtttgcctttcacttcttttaatgcacatgtttcagggcaattagtatgaaacatttaaagtgattagaggtttatagatacactgaacattgcaggtctttgtagcataagcccatttaatgtgaatctcctattgtctgaaataggtcagttctgagagaggcccattataaatgaattctaatgatgtgaggatcttaagtatcattcatattaagtggagtttaaaataaaatcgtgtatcaaagcttgcagagatccaaaaatccctccaaataatcttcgtattataatcagcataacttatggcagagcttgtgaaatcctgccagcaattttgtgactagtaacatagaatccccaattcacctttgggcaaagcagcaccagcaaggcggccagctgttcaaatcaacacaactatctgcaattaggaaatgactaactaccacaacaaagtaatttttaagcgggggagggcatcagttcttctcttaataaaaaggtatacctgcatggtgaatgcaaaaaactcaaataaaatacccactttgggaactatacagacaaggtaataaatagaaaggtgtctcataactaactggcatctgtaccaatataaattcttccgaggagacttttttaaatgttaaacaccacaagcaaatcaatttaggagtcccagcttgaacagatccatcctcccaccgccatcttagcatcagccatcttgaattcctctttcccattgcctcctcaaacagctgcaacctggcttctaaggcagactttctagtggagctttcccattagagcaaatgatggcctccgcaaggtggaatcccaggattttgcttggtccttgtcttatgaccagtgcctacagcacttcacattttaaaatcatactctccctccctggtattctctgaaagtgtctccccgtattccatcactctgaggtccagcatggcctgtgctgctcaatcacgctctgcaggtccaatcctgtgagtctggctatttcccaaacaggtccctttggatgtgccacatactctttcgagtaggccatccttcatttctgtgtcctccaacacctaccacagcccttggaacatctcaagcactcaaaggtgtgttaagtaagtgaaagagtgaattaattgtctggatgtaaccaggctcatgagagaatctgagattaggctataagtggtcttggtcttccaaaacttttacttgtaaaggttttgatgatcatggagacattaggcagtcatgacaagatggcagaaacagtgtttttgttttgttttccctctcctctcatacaccactcaatgtgatgcttctgacagcagatgaatgggaatttttccctatacgtcaaccaaacaattctccagcagacaccagctaggtgtcctaaaatttaactcaattctgacacgatctacctggagatagcatcacatccctcagggtgagggctcagtcccataagactgccccggcttcagacaccaatcacaagtaccacagtgggctgccacctataattctgatcagccagctataaatcagggttcccaccacaacatcctcaagcttgattaatttgctacagcagttcacagaactcaaggaagcattttacttaggtttacccatttattgtaagtgatattacaaacgatacagataaacagctagatggaagagctgcataggacgaggtatgggagaaggggttcagaacttccatgctctctcctggcacactgccctccaggaacttccatgagttcagctatctggaagccccttgagcccagtcctcctgggttttatggaggatgtattaggtaggaatgactgattacatcattggccattggtggtcaactcaaccagagcttggtaggtagggctgaaagttccaaccctttaatcacatgtttggctctcctggcaaccagcccccatcctgaggctatccaggagcccacagtcttctaaatagaacaaaagatgatcctatcacccagaaaattctaagggatttaagagctctgtgccagatgttatcactcagaaaataagaaacgttttaggatctctgtgtcagaaaccaggagtcaaagaccaaatattagaacaaaaggttatcctagtaccctatctacaagggttttaggagttctgtgccagaaactgggaagcagagaccgaatatatatatttaatcctagcagttttctaaattactttttactcatgattttattctattggtactagccagaaatgacattccaaactattgataatttcacaaaataagtgcgtttttctaatcttgcaactctgagaaaaatttaggtacattgctcatctatggcatgtaaatcacatgagctgtcaaagatttcaacacagtaaaattcacaaccaaaatttgctttcaaatggagagataactgatgataagaaagcatgatgactagcaaactgcacagagtgaaaacatctctttataacctctgtcatatatggaaatttcatcagtatgaattaacagtgacagaatttagacagatagcacatgagaccattgaaaagcctcgtgacctgttatttggtaccaaggcagtagactaatgccgatcagactatgagtacagcttagcagatcttcagagtaaaacatacttcaatttgttggatactgcttaactgttccctattagatatttttccccttttaaaaaaaatcccccatctctctccagctgtagctggacacactgctcccaagctagaaattatgtttcccagtctcctgtgcttcttggggtgaacacgtgcctgagttcaagccaaagagaggtaagcagaaatggtttgtgcaatatccaggaaatccccagcctaaagacaagacactgcctattgtgcactcttcccctggccagaaacggtgaagccttgggctcagagacagtcctacatgctaaggatagctaaagtgatagttcttagagcacctatctactgaccctagtctttctacctccctttggcctaaataagatagaaataaattcctatcttaattaaaacactgtattttgggctttctttgttactgtacacctagcctatgctacaagtaatataaatattggtcaattcttttcaaagttaacatggcaaactgtgaaatacgaagcagcagtcatctctatattactttattgattgatgttgtttgtagatgttatagttttccaaagcactttgacatccattcacatttaagcctcacaacatctttgagtcatggtcaccatttcaatttagaaaactaatgctcagattatggttaagtaatttgcttagggtcagacaataacagactttaaaagtctgtttttgctcagttcagcacattttttcactgccctaaagaatgcccttcccacagctaactgccctcagagtggattttatgttggttagatggaaactagctacagaatgaccccctccaccgcagccctctccaccaatttgtagtgtgtgctggggggaatctggctagatgcaaagccataaaacaaaaatcaagaaatgagttttcaaattctaccaattgggcatctgtgtaagtttggctttggttccactttgatttccctgccctagtgcaatgagggtgagggcagaagttaagttgtattctcccattcagtattctattctattaataataatgaaataaatctacacaaaagttaaacaatttttagttatatttgacaaagatgctattactaatacttagatattcttttttaggtaaaaagagttatacttatttttcagcaaaatagtaactattgtatttctcagcagcctgtactattttcttaaatattgtttctatagcagcttgggagataaacatatattggtcaaatgaaggaattcatttaggtggaaaaaataagttcacttattttgtttttgttttttttttctgaggtagaaataaaaactaattcaactgtcctcaagttctgcaagtcagtaacatgtcatttgtcagcatggcagtaattgtgtatgtttttaaaaagtcaccataaaaatacaaatgacataattagaagagtcctcatttcaacctctatttttcatttgatggagaaacactggtagagccttatatgagtgaaaagtcttaggaccccagctactctacatgaaagaatttggccatggaaagttcaaagactaatttaaatcccagcattacatccacacacagcaggaattgaccaatgatccattgcatcagtacactgtactttcagacatttccttctacccaaatactggatcacggactgccatttcattcactacagtatatcaggaccgcctgagcctatgattatcaatatcattcaaaatctggccaggtatgttctaattttctctcccattactccccaaagctatcctgggagtccagtgaagccaggctccttgctttttctgaacaggccaagttataagttctttgcagtctcagcacctagcacaagacctgcaaataatagatggcaaggcatttctagaaaccagggtttctagaaactggaattgggttacggcatcaagtagggaaaacacatttgtttgctgctacttatggctcccatctgttcatctgagtcacctggtgggctagttaaaacacagattactgggtcctgaccccagagtttgattcagtgggcatgcaatggagcctgatattttgcatctctgagaagctcccaggtgtttctaatgctgctggtctggggaccactctgtaaatcactggcttatggtaaccaggattagtttactgattaccccgattaccacccactgtcctcctaaagagattaataaggccagtgtaaataatgccagatgcaattattctgcaaatattttcaagggttaattatgttcaggcactcttcaaggtctgggcaatacagccatgtacagtgcaggcaagtctctgcctgcatgaaggtaacatttttgtgagggagacagacaaaataagtggaggtaagtggaaaaacaaaatagagaagaggaaaggaggggctgaagtagaggggtggcatcaacatagactggtggaggaagaccacactgaagacatttgagcaaacacctaaaggaagtgacggaactaaccgaggtggctactttgggaggctcattctaggcagacaaaaccagcgtaaaggactctaggggcaggaatgtgtgccggcatgctgcaggaacagcacagaggccagtgtggctggagtgcagagatggggtgaggggaggagggtgatcatcacagctgcataagcccttgtagggactttgcattttgttctcagtgacatagggaacaattgcagtgggatttgatttgaggagtcaaatggtatcacttaagtcttgaatggatccttctggctgctgttgactgaaggaatagggggcaggggcaggagcagctgaggccactggaaggagatcaacatcactttcactagggaggtcaccaggagaatcatgctaagttgttggattcaggatctgtttcgaagatggaggtaacagaacttcatgatggattcaatgtgggatatgaaataaaataaaaatcgaagataatatttgatttggggcctgagcagttggataatgtgctattttggggtaaatttgtgcaaggggtgttgaataaattgttctcctttggcagtgaagtttgtgacgtcattacatatgaaagagtagatgtcaaccaggtcgttagtgctcaagaattttggattccagtgtgtatggatataaacatggagccgtgacatcgaatgggattacctgaggaaggaaccacagtaaagaaaaaaggacctagtacttggaggttgagaggagaaaaaaaaaaaagtaaatgaaggagaggccagtgagggaggaacaggagaaggtgttctaagaagaaagtagtgttaaatacaatcagtggtcaagtaagacaggcccccaaattggccaccaaattggccaatatagtggccattagcggcccgacaaaaacagtttcagtggaggagcctttccaaatacctcacttggggtagaggttggggaaaggtgaagaataaagacaaaattttatgccaagggtagggagaacaagtaagaacaaagctttttcagaaaatatcataaatatcatgtgattcttgaaaatcagtctccaagagaccatggggctacggaggcccttgggaaaagggtgcattccaggtcctatcccagagattcaggttcagtaagtctaggaataagatgggacccagagatgtaattttaacaagaacttgtaggaggatgttgccagttctccttgggacacttttggagaatggtctcccaaacagaatttctggttatttccgatgacttaacacaacaaaacaaaccaactgccacaaccaccatgcaaccaacacactgaacctttccttgaaacacctccaatacctattctaccaaagtgaatcagggccttggattctcttgacattcaaatgagattggggacaaggtgataaacatgaagactttttagaaacagagcagatggtgcttctcatgttggatctaggaactcttttaggaaaacctagactgcctatcccaggaagactccttttgctacacaagaggaccgtcaaactatttaaaaattttgtttcgtttttatatttatctttaagagacttccctcaagaaagaggttacttcctgcagtgtgaggagattatacatttatgcactaacacataaaccttgcttggattttattttctaagccagaaagcatttgtggatgtgcagatttcagtgtgttgcctgttaaactgcatttcttacttatgggcactgaacataaatcacccaagaggagcgaacattcctcctggagtgaggtatttcaaagactgcctctactgccgctgggtgggaatgggtggtgcccaggatctgatcacatttatgtctctattttcatggtaaaaatgtgaagacaaaagtaatggaccagatctgagttctcctggctgtcatgggctgcaggctgttgtttgtattaagcagctgaacactgtttgacttgtcttggtgaaaagaaacactagctctatcttgttgcttctcctccaacaaaaaggcagcagaacaagtgaatcaccatgactgaccagcatgttttcttcttacccctaaatctcttctccatattaagagatatactaaggagaccataggcatttatttccctgccactggcctcaggaaataaaggatggagcgcctgaagagaccttctcagacctagtattttgcacatgccctcacaaaaaataaacgtgtatcaccaatagagaacatgaaagcaaaccaaaagtcataaagcattctggaagtcagaaagaagtttccatttgattgacaaaagctgcaaaaccagaacccaaaacacatccaggataaaatcaccatgaagatgaggactgaactgggaaaaactgcaagctcagattgaacataagagcaggagggacctcttgggcaatcgtctgtgtgatatttaagtatggtattccatggccacccccctccttccagcaagtggtaggagagattgaactcaagataaagaactgttctctactgaggattagtttccatctaaggaggtagagccatgaggctgggtggggttttggggttgggttctgtgcaggtgtggaggcgtcaccagggctgaattcatgggcacctccccgcagacactgtaggcctattcaatagaacctgctctccagtcaaggctgccaactcagagggcttctaatgttatgtggagagccctgcatccttcgccagctgtagccgacttagtgctgaaaacacttgaacttgcccaacatcctccacaaagaggccaactctatagaaagacacttagcttcctaaggactggttaattggtatttcaatgtgatgccctatgccaacaccaggactggtataatgggtataggtgcaaagcaggacccatctggctggcaatcctcatttcagatctttacatctgaccatgaaaaggccaagctggaaacaaaagggtggcagagtaagaatgagggcctctgcctcctggaaacagaggaatcccttcagggggctgtgtatattttcactgtgcagctcctctttctcgtttgctatcttagcaagccctgtcaaggaagaatgtggaaaagggaaacagtgggaaaacaggaactcctgatactacagaacccttttctccttcaactttacctccagagactgagcctatgtcatagttgattctctaataccagcataaacagctttcaggagaatcatgcctcagtcaattgccaatcatacagggaagattttaggatggtttaagaagatggagagaaaggatttatgaagtagtagatacccatccctgccccacccaaaataaacaactcagtagcatatacttctcttttttccaataaagagactgtcgttaaatacaatctgtttcttggcttcttctgctctcaactctagcttgtaatatgtgaagtaatttgagattatcctcagaagttccacagatatcttgtggtacaaaatgattaccaatactgtgattaaaaagtgcttttataggtggtaacctggagggctgatacaacctgatgtaaacagcactgctgccttgtttgaaaggtaattagaaagccattttgttctgacagtggagaatccgattcaggagaaaagtttcttctctcctgaggggccaaaccaaatatgtgatggaatatagctgtggcactctttgaaccttctcattggaaaatctggagagaaatgggacatacggcaacttttaagttgaaagcccttgtgcccagggcccctgtctctgtgccagtccatccctggaagagcaatggtgcaatgcaataactcagcgctgcccttcacatgatggtggctggtatgctcccctgggttctacctgggatgaccaaatggtacccttagcctccactgaacacccacttcacaaagacacattatcctgacaattaagatctaatgcaacggttctcccactatggacacagaccagcattgttaacatcacctgcaaatttcattagaaatgcaacttctctggcctttccccaggcccactgaactctgggggtggaggggcccaacaatgtatggttttaggagccctccaggtgattctgatccactaaaccttaagaacgactcttcaatagtcaaattaacccatcattacaatcattcattccaggtgtgtgagccacccctccccccccgcccccttccaccccctgcattttcaagataaatcatttgacgctatagtgaatttgaattactatcagcattgatgaacaattcaaggtttcttttcaaaatatctcatttttgagggtagagggctgggaaatcagaccttgcatcaggtgaaacactgaagtttaattaaaataatgcaaaaccagcaacagctgccctgctgtgaagcctatgtttgtacttaatgatttaggtgctgtttttcaggacgagagaagtacccatgataaatatgatgcaggtgcacccgggatgttacctttttttttaagtatctcctctcaaagcgttatgcagctaaaaccattcaatcagtggactatgcactatttgggatttgaagagacacctggaccatgtaagaattttgtattgggacggtcacctaagacagaaattcctttttaaaatatacatatttgggatagcaacgcagacagttcacttaccagtggatagtaatttaactattctaatgcttatttttcatgaaaatcagccactcttagacaaggcagatgtgttaaatcaatttaggaaggcaatttactatgatgaggttgttaaagagtcaaacggaacatcaggaaacttatgcaaatatttttgggaatttgttctgagtatgcaaatgctatataattagttatcatgcttttcatgcaaaattaaatttgctataataacgaatcacactcaagaataaggctagttaacatgaaaagaaccctcatttttatgactgaaagactgcaaattgagggtaaactgcaggtgaatctaattccagcctttaggattattattcattccggtcaaacgaaaccaactgcaacaagggatgggagggctctctgactctggacagcacatgtatggatgcaaaaatcacaaggagtagaagcaatggagtgttgtgctttttggactaaggctgtctcagctatcattagccagatactcttttaccctctaattattttggaaggactcagtgctatcatttaatatttatcagactagcaaagccaaacttctattttggaatatctctaaagtctaattactgctcagtcccttcctgccccagactgacaatttggagataatttggacttccagcatgttggctcttcctgcctcactctgtaaatgtccccacttgtcacggggctctctagacctcctctcgctgtcaaagtcctatgtctgctatatttgccaggctatgtaataattaggcccttggctgggtgcggtggctcacgcctgtaatcccagcactttgggaggccaaggtgggcagatcacgaggtcaggagatcgagaccatcctggctaacatggtgaaaccccgtctctactaaaaatacagaaaattagccaggcgtggtggtgggcacccgtagtcccagctactcgggaggctgaggcaggggaatggtgtgaacccggaaggcggagcttgcagtgagccgagatcacaccactgcactccagcgagactctgtctcaaataaacaacaaaacaaacaaacaaaaaaaaagaaaagaaaaaggccctttatgcctcctggccacttgtagaccactcccatttggccaggaatgagacatgttccatagcatgaaactttctgtgatgacgctggagaagtcctgagcaaaccaggtgagttggtcactctaccacaatcacacgtttccccatgactcccaggctgtttgcccattcctgtgggtgtcagttttcctaactatgcttcaaattcctcactggagtaggcttagccataacttctagtgctgcagactagccctaaccccaggagtcgtgtatgctcatctgctatccactaaagaagtggaggctccatccagtgagcctgatcactgacccatgtcttgccttatcccaggtggactgctcaggaataaaggggtttccagctgcctgaggactgacaaagggttccttctgtcacctccccagatcggagcctcaaagataccagtttgcatcacagccacccccatcccaccctcacccaatctgtgattagactcagtgcccttcagtgggactagcactttacctaggttaggctcagttatattcttgctttatacctactccacaccggatcattgtggaggtcccaggttttacctaaaaataccttgcaacctactattaaaagtgaagactgcacctgaacattcatgttgtctttacacataggatcacaagatactgttgatacagaatctagagttgtcaagtactttgtcatattaagcttacaatgacaaaactaggttttagtagcatgattttaggacaaaaaggaacccaaagccatacatttgaagactacatctatcccttagactgaaaagtcagacatggtagaaatgttttataaaagaagagaaaagcgggaaatgaatgccttgctgcccatagagacgtccagttttctgttgaggctggctgttaaaagtacctgactccattggtttcaataaatagctcaatcaccttgttcttgctaaagctcaagctcaataacccaatattccctagccacatacaatgcatttaacccttttcctcattatcccacttaagctaaaaaacaagacaaaacacaaacaggatagccagatgaactcttaattccaaaacaatatcaattgaattcactccatttgctagtactgccttctcaaccatgccttgtcttagctcaatattaattaggtaaaacttaatagtcatgcaacctggcccacatcaaaaattatatacctataaaaatgtgcatttttctagtttttatacatttcatacttcgtctcataagtcattctgtaaagtgagtgtcattccctcatttgtcacttttgtaaagcccatcttataaaggtttatttagcagaaaggctaatagattttattaataggcatagtctttccaacctgtaaaaacaccaatacttaagtcaaatatttttgtacccactatgcaaatagtactttgctaaaaacatcaccgttagcctaggagaatgagacaaagcatagatgcaagaaagttctatgcagtaagtgatacagacattttacagcaaaaaggtatcatctgtgattgagatccagaggcaggtagaaatgaaagcttagagagtgagcttgtggaaagataattgataaactacattttacatgatactttattttcaacactccattacaaagtttgcttaattatcttttacaacataccagtaaaacagtgtgtctgtctctgtattactgatgagaaacctgggctcatagagttcaagtaacaatatctgagtgggtagttgaaaacaaaatgttacactaaatcattaaaagtaaaagttgaaaaattatctttctagtaattttcaccacccatccaggatattcttctaacaattgcatttgagaatctatcctgggggatgagaccctaggacacatagaagctatgtggaccttgagtactttgggtctatttccttatttataaaatgaagagatggggccagatcagtggttagcaaacctcagccagcactagtaccacctggagagcttgctaaaacagactgcagggtcccacccccaagaatttctgattcagcacatctggggtgagacctgaaaatttgcatttctaacaaattatcaggtgaggtggatgttgatgctgcttgtccagggaccactttgagaactactagactggtctttagggcctctaggattttgagtatggaaagacagacaatattcttaacttctagaccagctgcaagtaagagttccctcatttatccttccacctattcattcaacaaatggacacttgttggtttgtgaacaagtgtgttttcaaatagttccaagtttgcctaaaagtagggaaaaatctcaattatttaattgatatcatttatggatatttggcaattttctttaactctatttcgtgatcatgtaaaatcaggaaaaaatcaattaaatcaggaaatgcatgcaaaaattattaacagtgtctgacatagagatctcagcaaacattagttctatggatcagggaaacaatttacatatcatattgcacttttgcctctcatatttttattccagctgctagcatctatcctatttcagcatctcagggttttcctcctcatcctttgttggagaagctgatgaagttagcaaggcttgggtcacggtaatactgagggagggataggctgggttaaagaggagagaatgattatatgcgaactatatgactggttcctaacaaaagttaatggattaaatacaaaatccctgcccttcagtgtgttccagctctcattagtgccaactgcatctcaaggcacacctttctcctgtgccacctatgtccttggcatacagttggagcaggagatgggggcgctactggcagccaaagaaatggacagaaccagtgtgattgtctggggaatctgacagagaggtaaattgaacttaatcactgtcccagccaaatcacatttgtaaaggctgaggctctgtggacacctgttataaataaagcaattcctaatgtttttctacaagacctgagcctttggttgatctcagtttctcagtataagaaccatttttctcacccagggcctggcatcagcaatttggtgttatgtcccaagaaattccccaaaactcctgggatggcacaaagttgtcctagctatgtgagttagactctgagctccagacagaaatactcatttccaggttcagcttctaaaaatacctgccttcacgtatgtcctttggctccgggaggtttccaaactacaaccaaagtctgagatgaaaacttaaagaaggctagactgcatgaaatttacctcacctatcccggcacaagccagaactggatgaggcgtaaaccaggcctgctgtgcaaacagatgcattctacctctggggatggctcaagggaatcataaacaccccacattgagagggcaggaggcctgagtggcatttaggtttctctgaggcttattttgtgaaagcaaaactgactcactgagaaaacattttaaaaatatttacttggaattacataaaaaatattttaaatgatttttgttttttcagaggtaggaaagtctgttttatagctggctgctgagtcagacagaatagccggaaagactttgggaaacctcagcctctctttggcctctgcagttgtgaggccgggagatgtggttctgaaacccaggcaagttgctgaagcacacagaggaattcccagaatttcctctaaagttttcacttagatgtcacaaagaaggcctgatttcagcgaaataaaagtttgttgcagagtcacacatgagcaccagttgtaactaagaaaatatatatatacattctaaagcacatactgtattccaagtgcttttttttttcttttcttttttgagacggagcctggctctgtcgcccaggctggagtgcagtggcacgatctcggctcactgcaaccttcaccgcctgggttcaagtgattcttttgcctcagcctcccaagtatctgggattacaggcacccagataatttttgtatttgtagtagagacggagtttcaccatgttgaccaggctggtctcgaagtcctgacctcaggtgatccacatgccttgacctcctaaagtgctgggattgcaggcaagagccaccacgcccagcctgccaagtacttttaaaatgtattcatttgattattcactcgaattcttctgagcacctgttatgtgtagtgctaggagccgttggatataactgtgaaaaaaatggacgatgtctccttccatcactgccgtattcaatctacctgggagggaggaaggcactggaatgcagaaccatagctttaccatgttaagccactttcccaactgtacacagggaaagagccagagaaatttgaacaggattttgcgtctccaaagtgtgtactctggcctttggggaaggatggatccaaacataaaggaagaagaaaactagatgactccagcttatgaagatagcatttatgtattcccctaagtgcctacataaacctgagaataaggtactcttctaacagaaattggcattcctttttagtacagggactttgtgatgtttcctgagggatttccatgtactgcaactcattttaattatttcaaccctagccttccctaagctcttgcatctctagtttctacagccaaccatatactggttttaggggtgttgaattgctcagttattgttgggtgcaggcactggacatttgttattttggagtacatcaagcccccttccttgtggggatcactcccccgcagctctgtgcactctatctgctcccagggtagagtttgtgacctgaatgaaagctagttaacacaccacatttgcctggagatgtcaactggttcaatgatgggcactggacctaatcagaaccaatgagactaacatgagaatggcatctctgctagccttggcctcccaacttcagcatttgagtactcactgacacctggacccatcatacattgtgtttggatatgacccccctcttaaaaatgcttgcaatgtttatttttgccggatgtcatcaaaaagaagttgttgatggtgtgtgctggagttggtaaagctgaaactacccaaatggctgtcactagagggccaataatgatgctgtctttcagcacttcttgttaatacgtaactagaatcatgcagctctcttctttaatttgttctggacagtgggccactttagggatgaactgctcagcatttctggcagaggaacagcaaccccttaggatatccttgattgaaaaactataaggccgggcacagtggctcaggcctgtaatcccagcactttgggaggccgaggcaggcggatcacgagctcaggagattgaggccatcctggccaacacggtgaaaccctgtctctactgaaaatacaaaaattagctgggcatggtggcacatgcttgtaatcccagctacttgggaggctgaggcaggagaatcacatgaaccagggagttggaggttgcagtgagccgagttcacaccactactgcactccagcctggtgacagagcaagactcagtctcaacaaaaaaaaaaaaaaaaaaaaaagagaaaaagaaagacaacaaagctggtcacagagctggtaaactggggacagccacagcaagagtcctgtaacagcagagaacagtcctccattccctcggagacattttccagctctttatttgaaatgctttgcagaaacctggaattctggacattatggttattaatataaagactcctatcattccatagctcccatctccactgacctctaccccatctctaatgacctgttacagctttgacgtcactctcagagcaggatttaatgatgactcatctttgatacctcttcctgcgtaaattcaacagcatcctggctgctcacagtagagtgcatttaccagaaacagcagcatttcctgggtgcttgctggaaatgcagcatctcagattccacttcagaccaactgaatcagaatctgttcaagaatcggcttctaacatactcgcaactgctgctgctgctgctgccgccagcctgggaaccacattctgagtagcaggaatgtagacctcagtgtttcctaaccgtactgatcataagttctgttggggagcttcttcaaaatacctgtttctgggcacaacttcaaaccctttgaatcagaatcttcagaaaagggactttggtatttacagccagcccaggtggttcttctggatgggcaaacagaggaaacactgggaatctaatttagagttctaggccgagctctcagctgcctgctcttctcctgcctgaatttgttgcttaacagatggaagcacaatacagcttccactagggctgtttctttttcccttttgttcctccaaagacttgctaccaaatgctgtgtcttcagcatctggaattgtttttttaccttctctctatgcagttaggtaagaaaggaccttggaaggattcaaatcccaattctaggcaaagatatgttaatagtcacatcccagtggcaatgctgtttaatgttagtgttttgaagacaaaatgcagattcctggccctggttgttctgcaggttgtagccttaataaactggttggtctgagtacataagttttcttgaggactgacaaaatgcaagaacagtgttagtaatggaagaaaggaataaaaatgataaccctgtccatctaggatgtaggaaaacagtatttgttaaggttttctacatctttgaaaaactggtaaataatatagttgcctaaaattcttaggatctttgttaattgcttcaatatttttccttccttagccttggattttttataagacagtagcgacattaatacctgcagggctcctcatgtgaagactaaaagtgaatgcatagaccagtgcttctcagtgggggatgacttcatatcccaggagacactgttgtctgtcatacctgggagagaggggctggtactggctgttagtgggtaggagccagggatgctgctaagcatcctacaatgcccaggatagcccccaccgcagagattattgagccccaagtagtgcccaggttgatctagaccaaatactctccacatcttcagagcttaatgatcatcaccctgttgtctctctaccaacgttgggccccaagttacccgattggtagaaccaagatttgaaaaaatgttcctctgcctccagagctgtattcttttcatcccaacgtgctgactcccactggtagcagactatggtaattttttcgtgttgatttataggagtgctgcaaattgcaaatcctgttctcagtcccccaaattcgctgcgtatctgctctcattatgtcattttcagatggagaatagagggttgaggcttggagcaacagaggaagcagaatatagagagagttgacatagactgggatttttatctattttgttttaaacagagtaactgagctcttataagaatcaagagatttaaaacttaatacattttaggggggaaagccgaagactcaactacagaggcagaaggagaagtaggctggaagtaactaacaatttctgacttgtggtgccaccaggtagagctcctggagtctccactgcctgggcagtccttgacatcctttgagagccaaagtgttaaatatgtaagagcactggataatgaacacgtaattggagcatgggaaaaatcagacactgtgaactcgattatgatatgttggtaacaaggagtgaaagcacctaacctattcagtgagattactgatgaaaaatatatataatgaaaaaaatatataaatattattcaaagggtagactagctgcagtgcctcatgtttaatttaaaatacacttgcatttcaacctcagatgagcagttctgaaatgtcatgaaatgctgggaactttcatggaaagaaaaacttgcggcaatcataatattagaatttgtttgccctagggtgtccataatcttagaacaaaaaatactctttatgtggaaataccttgtagttactaggagccttttattataaagaaaaagaaaggcaataaaaaggaattcattctaaggaggtgtttagagtttcctttaactgtttcctttacccacatagcttgccgttaatacttctctattaagctttcagaaagaggaattgcattttccacctcgctgaagaggcatgagagtggtacacttgggctatactgagatggaggcttcgctgacagcagccatccagatctgggtctgctttcctttttcaccttattagctattcccacctcatagtccacaggcctgtggagggggcaggggacaaccaggggacagccacgtggacagggagcaagggaggaggggctggggaaagcacctaaaagaagagggagtaccaagcatgccttaaatatctcacaggtttccagttggcctagcaaaaaaagagatgatatagagatgtacacaggggagcgccaggtagaatctacctaccaaggacaccactggtcttcataaagaatagccaagtgttatggaagagaaaaggagaataaatctgacaaaagtggggggtattgaaagatgggcaaggtgtttggaaagaaacagaaagggaggatgggcttagcaaatgagcagactatataagcccactggaattgtcaaaattaaggttacacacaagggagaacatctgtatcatgacacattgaaataataagtatattaatttacttatcacatccaatgctaagacagattatgtaccttttgtaactcctgaattctccagaatttaaaaaatgctaaagaagacacacactgtaccccaaaggtgagaaaaaggagtggttgcccaagacccctcttctgttcaacttcatgaattcacctgtggaatcttttaaaatagggattctgagagattcttctggtttgtgaggaatctgagttttttaaaggctctccagatatacccctgaacaaccttttaccggaggggccagcgtctaagacactatgaaagataaagagtataatactgagcattattttccagattttggagggaatgtggccaagaaagcaagacctttttttttttttttttttttttttttttctgagacagggtctcactctgtcaccaaggctggagagcagtggtgcaatcatggctcaatgcagcctctacatcccaggctcaagtgatccttccagctcagcctcctgaatatgggtttacaggcatgcaccaccacacccagctactttattttttgtatttttttttttttttttttttgtagagatggggtttcaccatgtgtcacaggctggtctcaatcccctgggctcaagtgatctgcctgcctcagcctcccagagtgctgggtttacagacatgatacaccatgcctggcttacattgtttttgttttttttttttcttattaaatgtatcaataatttttttatttaaaaaaaggacacgttttgtgttgccttttaaaaatacatgttgtagcaagcatataatatctattaacaaaaagaaaaaatagtttgcaaaactcttaattataactttatttgatatgtaactttctgcatcatatggtattagtagcagctaaaaaatattgagggccaggcacagtggctcatgcctatcacccaaggctttgggaggttgaatcaggaggatcacttgaagccaggagttcaagatcagcctgggcaacatagcaagaccctgtctgtacaaaaaactaaaattaaaaaaattagccagttgtggtcgtgtgcacctgtactctcagcctacttgggaggctgaggaaggaggattgcttcagccccgggatttaagtttgcagtgagctatgattatgccactgtactctagtctgggctacagagggagaccctgtattaaaaaaaagaagaaagtattaagcatatactatgttctaagcacatattaactcatttaatacatacacagacatacatgcacacacactcccactgtaccatgtgctattattattcttatttcacagatcaaaaaatgagcaaatatgtgtgcaaaagtatgtgtgtgtgtatgtgagtgtatgtgtagttttaggtaaaagaataaaagatatcctaattgtcgttgactgatacagaattttttaggctataattagtattcttgtgctgtgctgattaagacttttatcagttcttgggctaaatataaatatttatactccttttttgttggcaggttttaatagttaaagatagattcgtggagagggtagaagatgaatagcaaacaattgatggagtcttctaaagtttaacattaatgattaaacaacatgatctgatgacttactcagcaactcaaagacaataaaacataataaatctgtcaattagcattttcatcttctctcccaacagagcttaatggcacctgcaaaatgcaattttcaacccagagctctttgacattttctgtttcctcccatgtccctctcccgttgttcccgttatgactgagagcagcaacgtgttctgctccatggtggcaaatgagtcacctgccattgaaaggaaagcaattattgtgtcctctctaaatctcagggatgacttgggtactacttttccacttaagggcataaacagccaacccaggaccggttttaagtggctgaaccttagcaacagcagctgggctacaggttgatgtcacctgaggtgcccattaaaggtgtggaaagctgccagacaagaatgacttccagtaactacgacttctccctggagggagcacaacgcactgccacacacaaagtgacaaataatgactgcaaagatagcatcttgcctttatcttcctggtccttcggtttgaggacagtgacccaggcatggaggttaggctgtttcttggatgggtttccagctggtgggagtagatgctatttacacaagtgtcaggaattacaattcttcctcttccaggcagctatgtttagctcacatgtgtgtcacacgtgtgtagaccccaacaccaccatctctgaactgtcaagtaaggagattctgggtgatgagaaaaagtgtgccctcagggagacttcagatagtaccttggagctttacatctaatgaggacatctcaattgtttttctaagcttcagagtcaagtgccttgacaaaatgggcccaatataacatttccccttgagtcatttttaaatgcacctttttcttcagtgagctaaagaaaactgccttataaacaccatcaatgtaccaaatgaaagattccattctaaataaatacggcaagcctccattaaccagaatccaacactccaatgcacccagttaaccagaattaggttcactacctcatttttagaatcaaaaaccaatacttaagagcatataataatttcagccaaaaaaaccccacaaaattttcaggtctttttatgcaaccaattatctcaggggtgcattttctatctacctgtttacacagaaaatgagtttttagaataatgattctgaggcaataatcatatagtcaatatatataattattggtatacttgtgcttaagacttgaaagttttagaaaaaatgtccactgtatttgaaaagaaaatttttaaggattctgagattaatgataaagtaaacaaatttatattcacccttacaccttgggcttctagtattccagaaaaaaaaataataataagtgtttcttttaccctgctatttgctctgcttctaggggaggtctggaagctttccttcacctcacagatgggtgacccaaggtgggaggtcaaatgacttgctcagagtgagacagcatgtcaatacccaatgcagggttagacaccagagctgtggactaagcccttcacgggcaaatccatcactgtagaggtatactgcttgaaaccatttttccaaaaggttctctctggagggaaaattctggtctcaagaaatgaaactttgattacccagcaatgggactccttgccagctcttttttgaaataattatgaatctaaaacgtgcccttgtttgctctgaattttcctttaatgtttactggcaggatgaatacaaagcctccacaaattaagtcttcccagaattagttcagaagtgcactttctattactctgactagcagctcctagagtttcataggagattggaagttaattcttttcagagttgctccaggcaaaaaagcaggggatgataatgtttaggtacttttctccctcttttttagataaatcccaggtcctgaagtctgaagaggtcattagtcagcagagggtatgatacatcggaagaggaaaggctacggagtcactgggggctgggtttgaagcctggcttggggcctttaatgcattagcaatgaatgttaatgctctctgctttcttccacgacgaggaaaagccatggccttgacgagctcaacaaatagagtgtggaagtgaagtcacacagaaagactcaacggtcctacctttctacagctactatccacattagccacactctgtcaccttgtcagccaccactgaattactagtagaattgagagtggtgacaatctagcatcttcctacttactttcaacattttccataatcatatataagtccttagagccaatcagactgcattgctgaacaccatgcaagagaaaacttctcaaatctcctttgccaacatttttatatcatattgattttgctcccctacacagtgagggactgcactgggtgttgtgtggaaatgaaagtgattaacacacaaggaaggtgcttgtttcaacagtacaaactggaatgctacagagaagattcggatggccctgtgcaaggatgacacccaagtttgtgaagcactccatatagaagggaaaaaaattaaagacacaagggaggactttgcaacctcctatgtgcatacgcagattgagtagaaggcgctgtgataagggctataggagggactcaatttgctatcagaagaaaaggcaagagaagaaggccgttagtgatccgttgagagatggtttatttcaatggttatgtgtgtggacactggagccatcttgcttggattcaaagcctggctctgtgacttaatggtcgtttgacctagaccaagtctctcagtcactttgtgtctcaggtttctcacctgtaaaatggggataataatgattcctgtttcatagggcttttcagaggatcacgtgaatgaatacatataaagctggcactgtcgtattagacatttcttttgaaagctgaattggaagtgctcacggtggtggtaaagtatctgtcatggagggcatgccatgcgacagatgctagctcgggcacttttatgttcatcatcttatttaattgaaacttcccagcaaatagatattatcacccagattttaaaagctattgatcacgagagttgaatatgttgtctgacatttcataggtggccattggcaaagtggagattcaagaccacgactgtccagctcccaagttcatgctccttctgtccctcagcactacctttgaccatttctccgtatatgcatataaaaagaatttccttttattgagtatatgtagattgggcttggttatcaagctgttctccagtgataactacccccttgaaggaggctgctgcccgttttaacggtggaatcgcagtaatgaagcatgtggagcagcagatgccttgccagaaaataattagcaaaattcctgaattagggtgcccctcacactgctgcagtgcagaaaacagtgaactgattgatgttagatttttttatcttggtaagaaggatcaggtttgctcctttacagcatgtggctgagctgggtctctactgtgaatcaaaaagaatagaaagccaaactcaggtccatttacttgaggtcattcactacctcctataataatgacacacatttgctgagtactaattgtgtgatattcattgtgctaagtgttttgcataaaatgtcttaagtttcacacggcccagtggtgcaagcttgttgtcattcccattgtttaagtgcccaaatctagacacggagcagtaaaataacctgcccaacccttcctggtatccatggaatgtctcagtggtattgggatacaaatgaaggcaatctactttctgagccataatcactgcgttatagtctcttacccctctcactcttaatcaaagcaaaaaaattggcttcaaacaagcaaattgctacacttgacaacagaaatataagccaaatctgaattattagattgctagtaattcttatttgactattaattgggtgctttagctgggctgggtgtaccttttgctttcctttagttggataattgcaagcgaaaattttggatattaccattcatgtacagagagaggtagaagtcagcaattacactaatccccttaatcctttatgtactttacctgcactgtaaaattccttgattttaaatccgccacttgttctataaaaaatgtatagactaaagaaccacaaaaaagttaaataaaaatttttgcctgatgatatattgattgtacatacatatctttacttttgcatattctatgttgccattaaaagatccattaaaagctgagttcaaataattattcactgctcacattactatgataatcaattgcctgttatgaaaattattgccatctttaagaattgctttgctaagtgaagtaattagaactgatattttattttctagttcagttccaaaaattgattttatatgctaatcagagtgtgaaaattgggacataaattttataaacaaaatgaatggctagtcaggcttcctatttgacactttatatagtatttgttgtttctcaaggcatcttgctcttgagaacacactgctgattactgtatctgtcagaactaggtaggataagtttttcattttacagagtctcaagtatctgaagttccaagaattaagaggtgtgggccttcaatcaggacagagggtggaaaatcacaccttctgtccaccgaaatagccattatttcttgcagccccaacagaaaagcagaggaaagacaggtaccatttaccaactgtcttgagtgtgcctggtgttaaactcctgacatatatgttttttctgttccttatggttatctggctaggtaattactattattattactcttacatataaggaagcaaacagactaggaatttaatttgtgatcgcacaccaagtaagcggctaagttgggaatcaatcccagtctgcaggttcacaaggccatgcttttcctttcctttaacaggccaagtgcaaacagctgaagtgaatacacttcagcacaaggctcgagcttcatgatgattttgccctttggcacaaatgtcttggtaaatgtttcaaaagaaagttaatgccttcacttggtttttaggtgatcatgaattgtagaggaagatgcaggaaaccacaggttgaagttgcatttagaagcaaaaacaaacaatattttcatatatattactggaattatgaggtgaaatgaaaggaagaaccaaatttggtaaaataaaacaagatggtagtctcaattccagctccgctaataagaaaatgggaaattttgaatacattccctatctgagtctgaaacagctcatttgtaaaatgaagggttatgctctttaggttaagagtttctcttctggctacacgggtggctgataaagttgatttcatctccaaaagtgacagggagcaggcttctgtttggcagaggtatatccctaccgggtctcactgccacaggaacagaaggggcactcgttaaatactgtcaccctgttttgccctcatgatcctaggtgtctcttagagagacataagtgacatttttataataaataccaaacaacaaacattgtcagatcctttaggggcttggtcatagatcaacagacttcctgtggccatagctagaactcaggcctcttttcaatttgttttctgatcccccactcttcattttatcatcataaagaacccaaattattaatatgccagtaggacaattttaatttttcacatagtacatggactcacactcaacatacctgggtttaaatccagctgctgctattgtgtagctgaacttcttgaacttcctctaaacttttctggccttggagtcctcgttagcttgagatttctcatgtcctttatgctccagattcaggacaacttgagatgcaggcttaaagaagaagtaagtaccaagcttgtgtgctgcattaatgctctgctaaatgtctgtgctatagggatgagttctaatcagactgacatagaaagaatttccctcattattatggggtaaagttcatacattacccccagtactttagaatgggcttatatttggagataggatctttaaagaggtaattatgttcaaatagggtggttagggtgggccctaatccaatatgactggtatccttgtagaagaaaagattaggacattaccagagagagacaagtggatgcacagaaagatgactgtgtgaacacacagcaagaaggtggccatctgaagctaaggagaggggttgcagaggaagccaatcctgcctacatgttgatctcaaccttctatctttcagaattgtaagaaaatgaatttctattctttaagccactcagtctgtggtattttattatggcagccctagcaaacaaatatgctcattataccaataatcaacttccttggatagaatggaccattcttatgatgaatttcatgctgtagcacgggatgcatatgtttaaacaattttgcccctaaagttaataaacactatataatatgggctatactcagatatctaaacattttattccttcaagtacaaacatttgaatcaaacattcaaaaactctagattttaatattagcaaataatagattcttggaatatttaaagagcatgattgaaggataagctgaattatatgggtctattgcattttttttttgttgaaatcaaatatttgaatttcataatttggttaagaaaaaatatagcaagtaccatcacagacatttggtttttaatgctgtgaagcagtggagtgaaattctatctatagagtaatagcaacatgctattctctaaggctcccaacaaatgttcaaagatgtagagttcctatataaacataccaattctaaatgtacacgaatgattctgtcattgcattctaattcttagtaacagaatgtagtaagtaagcattcagagcctaaggtctttactcacatactaggaacctgaatcatgcacccccatcttatagtgcagctttcattctgaaagattaaatcctattgcaccatcattaatcaattcttctcatagcattccagcaaaaataatacaatgagtatcaggttcttttttggtacataagaagacaggcatagctgatttgctaaggcaggaggcctgttatatggtgttatcaagactaaaactaccaagtgttttctgttttagtccgaaaagatttattttctctttccaagagaatgtgctatgacatatatgctttctttaaaatacaaggccatggccaggcatggtggctgacgcctgtaatcctagcactttgggaggtcgaggcaggcagatcacttgaggtcagaagtttgagaccagcctgggcaacatggtgaaaccctatctctccaaaaaaaacaaaaacaaaaacaaaaattatctgggcgtggtggtggtcacctgtaatcccagatactcgggaggctgaggcaggagaattgcttgaacctgggaggttgaggctgcagtgagccaagatcttgccactgcactgcagcctatgtgacagagtgagactccatctcaaaaaacataaaaataaaaataaaatacaaggtcactttcccatttctatgatcctgccttataatcagttatgtgcagggaaaaatcaaagaaatttcaacagaattaatataatctaaattattgagaatttatcaattttccttgtttctcctttcttatgtctcttagcaatagagagaaatgagaagttgtgtaccttttaaaaaataaatgtgtcagaagaaagaatctcctagaaataatgagaagtttatggaactttttctcttttgatctttaaaaagaacacaaggccaagtcactggggaaaaaaaaaaattctatgaaacaggtcccctgggctgtgaatccatggccccaggctatttgtaataaagcatataaagtgtataggttgctctggtctttgaaggtctttcaaagatgaaataattccatgacttttgacatttgagaatctttatgggtgtgaaagggacctaattgaacaagtgggctaagctgccaggaacagagatggagtagccatattttaaccaagcattgtaatatggtcaatggcagccattaatttatttctgccaagacagatggccttctccttgataccaatggggaaaaaataattaagaaaatctagagccagaatggaaaagatagctgtcttttgacaaggtgattcttcagtttgcaattaacaactgataaaatgctatgcatgttaactttggggaagaatagctagtcatttgaaatactaatctcactttcttttcaaactaccttttactggtatctgccctttctgtcccatcctgtaagtaggccatacattttatggaaaacaatttaaaagaacatcagtagatatcagctataattctagaaacctttgtgcggtctttggttttacatatatggtttcagaagcaaatccaatgggcattgttaagagtcacatggtttagcttccgggtgttagaaagcaaacttccactcttgtgccctacagacactctcttcactggagttctcaaaatatatgatccctggccagcaaattattatgtttttaaaattatactagctgccatacatatcaaggatggcttttcatggggcaaaacggaatcatttaagaattacatcagatcacagcagtagcaagttattcacaactaccttgagctgactagcaatttttttgtagcttggaggtaaatgactttttgttgaaattgaggataataaattctagctctcattttagtaatgaaaagcagctcttcgtctcctcatcttcaagaatgtgcagagaactaatctcccctcaaaggtcctttcctctggccagactaagttttaccaaaagaacacatggtatttcaaacattggaagacttagccttcttttcttcctcctctctttccattccacaaatatttattaagacttcattttgccttaagttggatcctctgtaattgccataatattctattattttgacttacaacagtggctctggataccccctgacaatgcataagaaagaggagacgagtaagatacacaatctgtctgtaaagatcttataaacaagttgacaagccaagaatgaggtaatgaatgccctataacaataatccttgatgcacctaacttgggtggcattaaataataaaggtaataagagttcagagatggcaaaaatccctagtacaagagtaagcagtgatttctttttgaatgaagagatgaatataaatcttaaaagtacatttggaaaacaagacattgtatcactgaagcattctgtttcttatgcttattgcacctgtgttttcttcctcatctcagcagccagctcacatcctcagaagttatattgtttccacacttctcatgcaacactgcaaaaatggttttacttaggtactattctagtcacctgcttcatacaagccactctagctgttcatacatcttttcaatcagattataatatttacctatgacattttttaaccattgtcaattccattaattctatttacctgtgaatgaaatcactaagaccattagatcaaatggattccttgttatctcctacaaccacattcttttaccccatggaaaaaaaaacacttattaaagtatatatacagctataaatatgtcagaatatagcaacataaaaatgaccaactgggtcagacacagcacctatctttgacttgtcattctggaagtgagcagatttttttttttttttgtacccacacacctgaagatcatgactaattcccctcattaacaagaactccttcaggcaatgtttctaagggggataaggtggagtgggctctcttgcttagaggaatataggatgctccactgggaagagaaatacataattcaaagaagaccttcaggtaattttgatattttattcactccatcttcaggtccacaccacagaaaattattactctactgtacatatttcttcttgatatcaagctcagtgagtaccaaaatatgttctcttatcaatctgttatctgagaatgtatctatataatttaaggttatccatatttcataatactggtgttcaaatgtcctcccaaatttgccagctgttaagtaaagtagcacagcacccatgacacttaaccatgctagattatccatctttgtacccgtatctctccacccacattgtcaactcctatctttcctgtctttacatttccagcacctgggacagagcctggactttaaagttatatagaaccacattaaattgccattttttgccacttaactgtggttgcatagtagcaatttcataaggttcaacctaataattgtaagccatgactaatgaatagaattttaaaaaggatctaaacattcttttttttttgagacggagtctcactctgttacccaggctggagtgcagcggtgcgatctcgacttactgcaagctcagcctcccgggttcacgccattctcctgcttcagcctccagagtagctgggactacaggtgcccgccaccatgcccagctaatttttttgtatttttagtagagatggggtttcaccatgttagccaggatggtctcgatctcctgacctcgtgatccgcccgcctcggcctcccaaagtgggatctaaacattctttagggcttcagggaaaggaaatgggggaggggagggaactaagatttactgagattttgatgcagtaggtctgggatgggacccaggaagcagcattttaactagtattgcagatgatcttatgcagatgacccacggaccatgttgtgacaaatgatgcctttagggacacaaagggataggataagcttctggtcagttagaaggcagcaggagacaaggctactcccaactcctccttttcatgcaaatcatcttcatcccatccagagtaggctgtgtgagccagagtcagagaggcctgggcagtttgcatggctgtccttagcaggtcttatactagtatgctttttttccagaggtattttgttctttggaaagtccctagcatctttgtgcctaccaattaacaataccccctccagccaccatctgcactgtgtatatgcaaggtggagtcattcagctcttgcattcccaagtaatcctcttttaggaaaagggttctctaatgtgctcagagacaaaagcacccagaggtcactgtgttctttgttcaagtggctgcaatgtctgaaaacacaagggacttcttgacagatttcacagtgttgtgattaattagtgcccacacttgacaggctaggaggacaccagaatgatccctgcaggatggtgcaacatctctccatgtcacagcagtgagggacaggtgaatgatgatttctacaactagatgggaggtagtgtagagtgggctgcaggctcgtcagatctcaacttgcttgatcccaccttctaaggtatactaaaggtgaaggcttattcattgaaaatcagagacacaaatcctccaaggcaatgcatcacagattgtgtggtacactgatggacatgctgtgttaatgactgcatttgttacagtttgcacagtgcatcctgctaggcagtgctcataagggacagcacattaaacttatcatgttatgtcactgaacatatcatgcaatgtgatgtagtatcagcatactattcattgcatatgtttcccagggtttccagattaatagctatcttgaagaatataaaaaaaattcataggtttaatatacacatatacatgaaggtaagaaacatgttagtagcaaaaaatgacaaatagattacctacaaaaagaaacacatgtatctgcacatgtttaaaaaaaaaaagaataaaacctgtgctcagagcagaggattatcacagaggccagtagtataaggcaaatataaaagggcaaaaattaaaaaaaaattctactcttcaaaaaattttattttttatgtctaaaactgagatgggactatcaaaatctgaatttcatccatccatgcatccatccatccattcaaccatccatttaccacccaatacatattgattgaatgcaaactatgtccagatactgccatagacaggatgtaatcatatgtaaaggacatcccaagttccctgtactcacggaggttaaattctactgtgggagtcagacccaaacatacaagtttaaatctgaattcacgtcgccataagcagtggtataaatgttgaacaagcttgggagtcggaaggatgtgatttgtagcttttgccatagtgtaagtgcacccatcctggacaatttcagtctaacaatgtgatgtcaccggatgaggagttggaaagagatgtgtacagttaactctctggagcagtatgagccagccccagctcacccttgaatgtgatgtgaagaagcaaagttgggtaaggggccagagactgcggggaatggtggatcttttaggcaggtgtcagtcattctttgattagtgacatttgaacagagacctgaataaagagaaaagaagtaataaaaatatggccagtcacagcggctcatgcctgtaatcccagcactttgggaggccaaggtgggtggaatgcttgaggtcaggcattcgagaccagcctgaccaacatggtgaaacccctgtctctactaaaaatacaaaaattagctaggcagtagtagcgtgcctgtaattccagctacccagaaggctgaggcgggagaattttttgaacctgggaggcagaagttgtagtgagctgagattgcaccactgcactccagcctgggcgacaaagtgaaactttgtctcaaaaaaaaaaaaaaaagggtaataaaaacgcgaggcagggagttgaagatagtgggggagaagagtgagcacaaaggcagcaccgagcacagaggaagcactgcactgcagcaaaggtactctctgcaaaagggaaaacaggatgaccagtcaggagtggtttgtattcatctaggcaagaagtgcaaatcgctggacgcagagtggtagaagtagaagtgatgtgaaatgcttagatttgggatacatttgtgaggtagacttacttgaagtcaccaatggattggatgtgaagagggtaactgaggagtcaaaggcaatctcgagaaagactcttagttagcttttgctgataatatataccaccattagatgcaatggggaagaccaaggcaaaagtttgtgtagaggaaaaatcaaaagctctgtttgggtcattttaggttagaattattgacagacatgtggagatgtcaagcaggtagcgggatatgcaaaagtctaaaggtcagaggaagtcagggatgaagatatatgaagatatgaatttggaagtcatccaaatatcgatttcagtgactatgccctcagtgcgtcatttgagaaccaatgccttagagaataatgacagagattcagcctttaaggggcccctggggaggaggcaaccttttatagaaagaggtgtgaatcattgccccaaaatatctcctgttaagctctccctatttctgaaggtacagcctttaaaagataacccattttcaccacccgggaaatgaggagcacctctgcccagccgccccattgtctgggaagtgaggagcgcctttgcccagctgctgtgcaaccctccaagtgtgaagtgacagccttgtgtgtgatctttctgccctccccaagtttgcgtttttgacattaaagtttacttttaaattaaaaaaaaaagatactccattttcatcatagtcctgttaaaatccatgttaatacttactaacaaactaatagagatttcccacctgtcaacttgactagagaactgggtatttgatgttcagaatatggagcaatggttcttaaccctcggtacacattataatcaccaagtagagttgaaatatgctgacacctgaggcccatcccaatgattctagtttaattgttgtgcagtggtgaaaagtatggatttcttttaaggtgtaaactggacaagggacaggaaaggtggtgatggaaccaaagagctgaaggtctcaataatgttgaggatacttgccaaatcctctagtaagagaggagttgtgatctgcttgtggggtgatttcattgtgactttgtaggtggttcaagatgtaatatgggagtggagatggagtaacgcaaaagatcactggggataaaggaagtgcagttactgaaggccagggtgttgggaaattcctaggaggtttggggtatgaggtatgatagcaggcacagagatggaagatgactgagccaaagaaccaggagtcaaagtcttcaatgactgaggagactagaagaacaattatttgaggacagcaagaagcagcagcaggaagtgtttattcaggactgaacctgaaagtttcatatccaatcaatgagagacttctggtaggtttccctatcaattatattctaaatctgacaatttctcatcacttccaccactccaccccactctaagcaacgtttgcctcttacctaaccatggagaaggaataaaatgacccaaatatggtagtagaaagcagggacaatacaaccctcaaatccaagccatgaatttgcaggaatccaaagaagtgagcaaaaacacatctatttgaaagggctgcagggatgcaaaatcctcagaatggggtctatatgcagggaaggctattaagtggtatattccaagaagaggagagattgatgatgacagactgtgaatttgaaaggattttcagaggatgagaggggatgagaaattgggccacatacgagtttgctgagacgtgtgagattaagagatttgggtactaatggatttccagcgctgcttaaatttctggtgttagctaagggaaaacatgttagaaaagatgtgattagtctcatagcctcttagagaacagtcctagggtgatggtctgaaatattctaattagccatatggcagcttccagggctgcgggcccctcacagagcatgtgttcgcaaagtggcccacgcaaggagcactgggtgatatggtcatcggactgggccatggccctcacgaaatacaaggatgagaacttgtgaataaatgtgtgcaaccaagcttcatccatggatggcgatgcaacaggagggccacttgccagtagagtgggaatcaccctggtatgcattactgagtaacacatccagttaatgacactcagcaacagcttgctcagcagaagacttgagtcattttaacaaatagaaggctgggtgaatttctgtgagctctgacaagtacaaactgttttcttagactcgttgaggactgagtgttgtagttgcctcatcactgtggtgggccctgccctgaaaatgaacatgcttactgcaccaaaggttgacagccacctgtgaaatataaaacaaccttactccctgatttgtgaaattatttatgttaaaagttctacaaagctatgtacatagagataaggctggaaggaaatactcctaaacgtagtaatgttacggataatgtatttttttctctttattctttttggtgcttttctcaactttctactataaggtcataaaactttcaaaattgtgtggggggagttaattataaagtataaatattcagccgggcacggtggctcacacctgtaatcccagcactttgggaggccaaggcgggcagatcacctgaggttggaagttcgagatcagcctgacccacatggagaaaccccatctctactaaaagtacaaaattagccaggcatggtggcacattcctttaatcccagctactcaggaggctgaggcaggaaaattgcttgaacccaggaggcggaggctgtggtgagccaagattatgccattgcattctagcctgggcaacaggagtgaaactccatctcaaaaaaataaaataaattaaaataattaatataatataatataatataataaagtataaatattctacaatggcattgaaaaggaaatctgggctgtcctaagccatccatgttgtctggctgctgtcctctccctccctgtccccctttcattctggcctcccctctgacctgtatgtgtattgggcccctctgggagaattcaccaattcttagcaagtgcctttccctgaaaattgctttctgacctacaaggctgggcccacagcatgcacatgtcatggcatagctctgccttctgaccaaatcagctaaaccagaagatagagtccttctttggtaattttaatttatcacagagattataattgggtttaaaatatgttcttgaaccaaagtgacaaaccttgagctctgtggcagctaccttctgcgatggggcaggagacacagaaaactggcttgcagaagggacaggatgaaatttagcaggcagagagaaaagggatgtggcacagggatagcattctacctatgaggatccctgtttttagacttctcagagatctgccattaccgcaatatgcttacaccacttgctgagtgtctgccgctcaagttagctcctctcactttaaactagaaagttcctgtctctcatcccttctctccctccttccattgctgaattaaaaatttaaaaattctttaatgaagtaaaaactcattcaagtttcaaacaagtgatcttcagaatataaccacttaataagcagggagcaattcaatacgtctgtgtgtgtagttttatttggggagtagagtttagaaatcattccaatattatacatcactatgcatttgttttactcatgtatctactgtgacaaaaacacaaaaactgcatttttggggtgggagtagtttttggaaactatgaagaataaagttacagccctactatagccaacatcaccatgttttcacatccccaaaggccctactacccacactgtggcccccattagcccacacgtcatactacaatttatatgctattgatcatgagaaatgcaggcccaaaaactaccttgaagcaaaaaaaataaaaataaaaaatctttttctcttgactccccccttctccatgctataaaatatattgcagacaacattttcctgctgatggttaataagtgaaggacaattcaatatccagtaaaggtgatttattttatcaagactgtgacctgctgcccagctgggaaggatttacaagaaataagaagacacatgacaaagaaaagctgaagtttagaaaattcccaaagacataaagcaaataaggaaaataagtaaataccaaaatatttcttcttagaggtcttccaatactggtgtgttctctcttatgctgagtaatgtaaaatatgtccttccaaatataactctcaagcactttttttcccaaaagcagcttactttgagcacacaaccctctctatcttacactccttaacaatctaaaaatgctgtgtcaaatcttttcactgttttttctctgcccacaaaaagaggatattttgatcatttttaggcagtaaattcaaggcctatattcccccattctgtagcatttggcttaggggaatcactatcttgtttccctagaagacagaacataaggtgagtgaatttgccttttccagccactaccctggctgccctaggaagaagagagtttccagttaacgggaggaaaactgcacattagaaaaggctgccacagtgggcctgacttctgctccgcacagcagcacacacctggttcatactcagcctctccttctcccacttgcctgactgcctgtgttcctggatcaagtggcaagtttgcagtcttccttgaattcccccagcactgtcttcctcgacggcacttgacaaagcggagaaatgaatattctgcttcctaatgagaatacacagttttaaaacatcttctccttccctagcactgtgagttggtgccattagcttgtcatgcttgttttttgtttgttcatttatcatggaaactcatttcttccactttgaaaccattaggttcacatgtttggcattttacagatcctcttggcagaacctcttgggaagcacaaagaaataagtccagagtagcccattagttttatgtcttaaatatctcttcaaacagttcacttccttccaatgcctccatactattgtaccctcaactctagcctggtctatagaactatcctcttctctgaattctgtgtttctggctggcctatctcttatctactttcagcaaccagggtaaacttaattatatttttttaaattttaaaataattttaggctcacaagaagttgtcaaatcatggcagagatttccgtgtacctttcacatagctttccccatgataatattctacataaccacatgcataacattcaggaaatggatattagtccaatcctatcaactaaactcagagtgatcctataaaaatgcaaacctggctgggagtggtggttcatgcaaacctggctgggagtgatggttcatgcctatggttccagaactttgggagcctgaggtgagaggatcacctgagcccaggagtttgagataagtgtgggcaacatagtgagatcccatctctacaaaaaagcttaaaagttagctgggtgtggtgacacacaactgtaatcctagttactcaggaagctgaggtgggaggatcacttggacccaggattttgaggttaaagtaagctatgatggtaccatcacattccagcctgatcaacaaagaaagaccctgtctctaaaaaagaaatgaaaatatataaataaatagatatgaaacctgaccataacacccctcccctactttgctaaaatgtattatagcttcccatcactcttagaataaggaccaaaatccttaatctggtccacaaatagtctgaccagcactttggtttggccaagacagttctgtttcccacccgctgtcccaatgaattatcccattttacatgtcagcaccctcaaaattgtggtagtttagataataaattatggtcatcccacagtgagctctggatggtctggtcctgcctacacagacctgtggcttttgttttacacctgtccccttctcggtctgagcccctgtgacacagacccccttttagtcctcaggatgggaggaggatgcataaaagccacaagacctttgcacatgttgttgtctccgcttggagtgaatactatttcttcccccttcacaccctctccctctctctccttcccccttcacctgtcagctcctacttgtcttagctcagagaaatcttccacagactagatcacatctctctattaaatgccctcaaacaccctgagccacatctttgaattgcttattacagttgtaatttgacatctgtgtctatacatgaagagtgagctaaaagaaggtaaggcggagtatttgtgtttgtagaacatcacatccccggagccagcatgaagctggtggacaattactttatagttatcgactgaatggatgacagcttagttgatgggttcataaacaacaaaagcaaattggttaatagcttcaggaaaaaggaaaaaaaaaataaaaaccactcacagggttttctctgcagactggtacccctatggcccatttaatgatttaaaaaccaagctttggaatgagacgggcccaagtgtgaaacttggtacttgtaaactgaggacatttatgccagtaatataacttctttgagccttaatttttttcatctgtaaatagtagtggtaggagtaatggtaatagtgttaataataaagtcatctactctataaaagtcttatgagggttgaatgagaaaatgtaccgtgcttaacacacacatcattaggtaagtgttagctcttattactatttggctaaaggtgtttcaaagacatcatttcctctgtgtctaagatgatttccttgtttcctaaaagacacacaaggaggaggtaatgctcttcacctggcatggctctctcctcacctgtgcccccaccccaggacttccccatcctcctgtgctatcctccttgcagcaatccaggccaaacctgggcacctgccagaccactctctctcatgccacacattggatctcaggaaagcatgtctgctttctcctcaaaatatattcagtatcccaccactccccaccaccccataatcaccacctccaactgccagcttattgcaacagcttccaagtgggcctctcttctctagcctttgtccttcagaatatcctcaagagggcagccaaaatgatgctgttaaaatgtaagtcacatcatgccattcccttcctcaagcccttccaaggttttccattttctatgaaaaaaaatgcaactggcctctggaggggtgacaggacctgcaacctgcctcctatcttggatcccccatagctcgtcacctctctccttcaggtattccctcaatggagaccctgtcaccatcacccatttaaaacctaaataaccaacaaccttcacactctgtatccccctccctgttttatttctccataactttcattaccttctatacattttcgttatattcttgatagcccaactccctgactagaatggaagccccatgagggcagggatttttgtctgttctgtccttgctgttcctctagcatctgacactgtgcctgacatgcataagttgctcaataaatacatcttgaatgaatacacaaaagaataaattaatgcacaaatgcaggaggcatcattgctctcagggcaagagctgtcctccacatacaatttgggatacgttatgaggcatagagaagaggtctgaaggcctttctagagtgtgttgggtagaggcaggggaagaggagaaagaattagctggggtgggctatctcttagcctcctgaaggctaaacagacttgaccctgacattagacttgctgagtggctgagtgtagtggaggcatggggatgggtggactgagggctgagcaggtacaagagagcatgtgttcacattcagagaatgctctgcccaggtgggcctgccagacagagatttatgtggactgccaaaactcagggaaacatctgctggagaagactctggccagaaatcccactggcctgagggctaacatgaggcacttttagtactagccaagctcatttcccattgtcaatttgaatgaaatttccagaacatgtactggctcaggatacattgtccagatgttggcaaaataaaagccaaaaaggaatatttaaagtcggctgcttctcttgtgactccacagctcttttgccaaacatgcaagcttgtcttgttagaagctgaagcctgagccaaggtcttgggtggacaggacttgaaggaaactttgggccatattcaaacaatcttggactgagtagtggtcactaaattctccattagaatacagctattcacaaactcaagggaagtgaactgcgaagcaaaaactcagagcattagtattgggactttgtaaaatcagcctgcaaatctgaggaaccaaccatgctagtgtcaccaaaaggcatgaaggacatgtgggaggaagtaatgggattatcacctactatctgagacagaaggcatttttggagtctttaagactagaaggtaccttagagaccctctgctcccagttttccatatctatctctaccctggacttctgagctcagtcctctataaaagttggccagagacggtaacatcagggcatttgctgaatattgaagtcacatcaacctgacttctcctcaatttgatatagacaggagacagggaaatgctgggtagaagagggtggttcccagcaaaagccccaccttcaagcatggagacccatggccctaagtgggaacaggcatttgtttttgtacccaaaaagttgccttttggcctgagacacacccctatcctgtcacataaactgcaaaccccaggctccagaagcagatgaggtggtgagaaaagcagaagaacagtggaatgagacagcaaagaaagagagaagaggaacatctcaacaatgagaggctcagctggggatagtcagaaaggagttcagccactggacagtcaaactcctggggaagatcatcttccgactccatccccacttccagctccccatccatcccactaagagctacctccaccactcagtaaaacccctatccatccttcaagacctgcttcttccaggatgctggacaagagctcaggatacacaaagctgtcacactggccctctatccctgcaaaaaggcaaagggtccattgaggtggttaacactcaagccatctgtgaatggcaggctaaaagagcacactgtaacacacagctacttgggctcctgcacctgtctgcatgtttcccctcccctcaggggtttgggcagtgaggtgacagaacaggaaagccacagccctgtcacacatctcccatttcaaattcttctcccctatatgcattatataatacttaactcaatcttcttctttagagacaaacttcctttcctatctctggtagattagttctcttttttttttttcctttttctttcccttttctctctttcctttttttttttgagacagggtctctctatgtcacccaggctggacttgaactcctgggctctagcaaaccttccacctcagcctcccagtagatggggcaacaggcatgcaccaccatgcctggctcagttctctttttgattcttgcctacagggttccctgttgttatcattacatatcatgttgggttaaggaacaaaatccccatcaggcttggcctgggggattcttagcagttggtctgacacatcacccaatagataagaaggttctaaaggagggaattaaattgtctaacatcacccaacttattaacgatagaagcaatttcacagctcaaaccctctgattcttaacagaatacctctaccaaaattatgaggataggtaaaatatatttacttctattttttctagtttgtgcacaggactataaataacttctaatacattaagacattaaagttatacaggaagcatcccaaaatcttagaaaataatgcttggtcaatagagcgccaaatgcacataagacacacaaaaagacattctaaagaggatgctaaaattaccagaatcattaactagatatattctgagtttctatataatgtcatcatcttagctgaaaaataaaacaattccaggtggttaatatggtgtggaataaaatatttacactttttaacatttgtatttaaaatactcatttgaggccttcacatagaatcaaaaatagaaatttaatggttcattgacctttatatttataacttctaaaattctggataagagaatacagatattttatccaaatgaaatcgtaatctttttgtagcttaagttttctctggcttggtttggtaacagcctgttactttacatgagtgattataagcctatcttaaactgtagccattgccctaaagaaaatgtttatggcctgactgggataattgtattctcctattaaatatcactccttcagggctagttactgttgagtataaatgtgccactttatatgcaaataaaatgtcctgagatttgaataaaaagttctgcatatacctactgacaaatcaacttattatgattcatatcagcaaacagaacttctcaagatataagatgctaatattacatacaacaagagacagttctttccttgaattttgttttcaaaatgttcagatacagctggaaatgtctttactcatagatatagcagattttgggtttgcattctgagtttcatttttagtcaaaagatcttacggtattgtgattacttattgccaaccttttttttttctttttgtatattttagtctgaccttgatttgtcttcagtccttttcccatatacccacatacctgggaaaaatcaactttttctcagatactctagcgcaaaggccaactcaaagttcagcttttccaagaagccttcttaaattcgacctaggaaagcatagtttcctcaaaccttgcgtgtggagtataatcacctcacatatttgcattttctttttatttttttaacctatcatctctgaatttgatctttgagcaaaagtaccctcaggaaaactatcattttgctgttcacatttgaaggagcagtgtttttgttttctgtttttttttgagacagggtctccatctgtcgcgcaggctggagtgcagcggcgtgatcatgtctcaccgaaacctcagccataaggcttcagagatcctcttgcttcagcctccggagtagctgggattacaggcatgcaccaccatgcctggctaacttgtggatttttgatagagatggggttttgccatgttgcccaggctagtcaagagctcctggactcaagcaatccaaccatctcagcctcccaaagtgctgggattacaggcatgagccacctcgcccaactagaagcagtgttcttatatctcaaatcccatctcagacctgtgccttgtgtttttaacaacctctcaggggtactgtgcaacaactcttcagaaaagcaaagcaaaacatattatgtgtattggggccctgtctgtgcagagatagtaatatgagataaacatggatgatttaagggagaaactatataaagcatttaatccccattttctccactttccctacagctctgctgtccttgcctggagctgtcagaggaaaatgggagaattcaatggcatgatgttgaaaactgaactctgattttctggccaatccatctacttccctagagttaaaggattcataggtgaatgggagctgcaggaccgtaggaaaggacatctttgggttatatcaccaaatcaacacaatattgcatgtttgggaagttcattgcttttgttgaaactttgagaaagcccaatacccaacaagaagaaagtcattcactcaggagttaaagctaaatacttacactttttgagaaatacctaaaattttatgattggggtctattgtacttcttaattagaatttagggctaacaagagatattataacatcaatacttgcattatatagaggaggcctttaaactactgtctagggaattcagagagccatgttcctttacaacattccttctcgtgcaattcaaagacaattgatagctagaaaatgtcaaggaaccaagattcttgaccaacttgaaaagcaagacttggataaatggcattatgagatatatttgcactaattgtttcaatttgactgaagtatgtcatctctgctagattgtaatttccacaagggtgaggctcatgtctgcatatcaccccttatttatactcagaagggtccctattacctagtgggccctcaaaaatatttgatggatcatggaataataaattaatgcatgcttgcccgaccctaaatattgttctatttcttgtagattcttccaaaattatagtcactcaatacttattcctattagttgggtcacacacatacacagacacacacacacacacacacacacacacacacacacacacatacacagaggctaatgtgaatatagggtctttccttatagcctttaaaatagaataaattcttatgtgcatttaataacttagattttctgcttgaaagcaaataaatggagtaaatcagtcccaaaaattagaataatttctgtaatacaaaattaaaccaatttaattaacattttaatgttaacaggacacagctaagatcacccttagaataatgaatctatgtaaagatcttcatggatagaaaaggtacaaatgggtttgcatgaagcttgtacctacctctgatatttgggacaaaagagatgggtcactagaaaggtttctgctttagaaatgacctccttatcaatctccttgtttttaatcttgccctataaattccattcttcaaaatgaagtcagagtatctgttattatctcaaatgtagcttccttgcttaaaacacttcagtacttcagtagtcctattgtcttagagcaaatttttggggtcatttcactggcataaaaggcctgacctaaactgtgttcctttctacagatagaatttcatttcatatcactcattgccttgagctatgtgctgtggtaataccaaagaactggtgattaccttgctgaatacgttgcattaattcaagcctctgtacttgtgctcacactatttccttttcctggggtgttgtcctcacctgtcttccccttgtgactccttctcccattaagacttatcaagtctcctctaggaggtatttaaaatggccttctgctatggtccaatataagtctgcatacattttattatttgctgcattacattgaaattaaccagttacgtatctgtttcttactctagactctaagtattcccattacacctctttatggttatctttatggttctagctcccattttgaaatcagttattatcccaataaaatcaataagtgttgaaccaggctgagtgcagtggctcacacccgtaatctcagtgggagtttgggaggccaaggcaagacaatcgcttgagggcaggagtttgagaacagcctggccaacatagtgagaccacatctctaacaacaataacaacaaaaagccagggtatggtggtacatgcctatagtcctagctactcagtgctgatatgggagatcacttgagctcaggacttcaaaactgcagtgagctataatcacgccctgtgccccagcctggacaacagagcaagaccctgtctcttgaaaaaatgtgttgaaccgcactgagtatataacattatcttgttcttttgcccatctccatcatttcaatgttctgttgtggcctgggagtttccagaaagtaacattctcttttcttatgtgaattgctgaactaaactactaatattcttcagaattatagagtagtaacactataaatggctgttaacaaaagccatatggctaacactgacctgttactaaataagagtatattgaggactcaggtgggaaaaatattcaagaattagttagcttcatgtgctaatatttataagaaataattacattgcaagaaacgtgttaaagcatctcagttatgtttagtagtaactaaacttgacactatttgcatatttggagtacttctactgttttttcaacttaagagctcaagcaagttttatacattcataaaaaattataaaatcatttctttatttcaattttcaaggccaacgtattgtgtagactttcttataattgttacaaactcagaaaaagaaagatttatgaaagaaacattgacattcctttaacaatggtagttttagcaggcaccttggtattatcagatattgcggctcccagtctccagtttccagataatgcagtgacttaatcagtcctctctgaagtgcaaagcaggcaatcttctttgtcctttgtgcatttctcacgtcttacaactgccccacttcaatattcctgtgtgtcacctaccccacatccgtcttaccctatatcactattctttgtaatttattctgggcttagttttgttactacactgaaatcttatgcataattatgtgaggttgctatggagattttgtgtgatttgtcatgaggaaaacctattgtgtttgagatgattctccatactaatgatcaagaatccatttttttgcccatattttctctgggattataaccaactgcatatatttgaatatctataagcaaaagttattctataaataacataagcagaaaaaagttattgaattcaccattaaagtgaagcactttagtgcaaccagttcaatttctcatgatttagaaagaacttctaatgtaactctttttgaataccagctgaactcttgcctgaatccttttagaagagaccctgaagaagttattctataatcacatctcttaaaattctgtcactaatactatatatttggctatacaataacttgaaaatgtaattttggagaatctgtgaaactattgtgcaaaattaagagaagatatagccaccttattcgaaaatgtttattcataattcttcaattatacagactttttggaggtggaaactgagggcgaaattgattatttggcattagtcaaaggcaattcagactaaagactgtgattgaacaacagaaggtaaatatcacaccatataacaaagtcatgattttatacctctcttgtctgaccgccccaccaccagcctaggatgaggaaaagcatgaaatatcatgagacaatgcacatgaatctctcctttagcccccaggtcagcaaagctaatttcaggatcatgattgatttttagagagaaacattcccaattcaagtaggtagaagtttcccaagcaggcagaagagaattgtgatgaattcggcagcttgtcatcaggaaagtggcatccagaggataaatttagaagttaagaagtgaaatctcaaatcaaaggcagactaattatagaaatgttttctaggcaactatttgtctgaaaacacaactaaattaccaatcatttctggaaagagtgtgtggttttcactcatgataatttgttgccatgggtacccagtgtagaaatctaacaggaacagagatagcaagtaaggagaaggagagagaggggctcagtgagatgctctggaagaggaagatcatagtcagtgtttgcgtgacaaaggactccaattcagtcgactatctggtaagtctggacagcaaaggagtcctttcattgtcttcatgggagccaatgaagtaccctcctcccagaagccgagaatagtctatactggacatgcaagtcagtgtctgaaaagtgtcagagcaggtgatagatcttaagggattattctctatactacaattgattcaaagggagaggagcttctggaaacaatgaatgatcatttagggaggaaaataggagaacacttttgtaagaatataaaaggaaaataatacctgccttaaaaggctggtgagtagaagatcatggctaatcaaattagagtggagaaggaatttagcttcagcaactggaaccaatacatggtttgaaagtcttcccattaaaaaaaaaaaaaagtactagcatatagggaagactcacatgataggtgcaagaaatcaatgggcagacccaagcaggagacaaggacctatgctggtgactggagaatcttactgaggtctttagaggaagtcatgggctcctaccacagggttaaccaaaggttgtggcttttctaagagaatgcatcagagatgagaggaggagcttcaccagcccacaaccaatgtaccctacttctaattcagagaaacttgtagtgagatctccagtggctttggaattctgcatagaaagctagagaatgtgagcgcctaagtagccatgtccagttgaagaacaggtaaaagggaaaggagggcaatttggagaggaagaagatgtcaaagtattaggttgtcttgatcaatattccttaagcagagctgcaaagatagatcctcagggatttcctcaagacccaaagtcctattttcatggtttcacaaagtctcaataaatatctttaaactcttaatctcatttcagtggcattaaaataaatactaagcatattctaaatgtattagtgaacaacttttgactgaatactgccatgtggtccagtgttctttgcacttttatttatgatgctcttgttaaaagtgaagaaaacggacgtgagcttaatggacaaatggaatattcctgccacaagaaaaggccaaaatgatataatcccatgttaaactaacagtttgtagcttgatgggttgaacattggaaagacaattgggttgtcatccattacaagagtctacaggacagccaaactcagaagaacctgctcctagtggaaaagaccattaacaaatatgcaaattgcaaataagtctagcaaatgtcttagcaaaatagcaccatctgttatattaaatccagttcatatatttgatttctattggttttatagttttgaatttataaatttattttgattctgcacttaagaaagaactataagcataaagagtgtatggtaagaagaaaaataatcaaggaattgagagaagcataaatctgtttaaaaaatgaaaaaaaaaacagtgtaaaaaagtctagagtatgctgtggcttacaaatactgatgacatctatagggagtgttaggttaaggctgtgtttcgagccatatgagaacaaggatgggattgtcttattgcttgaagccgatgatgtaatgctaatagaagccagagagaaagcagaaccattcaacttctatattgcttccacctttgctatcaagacaaacgatcaccgtgttgaaaagaagaggaaaacatgaagcccaagacaagtgaggagatcccaagggagatcagcaaactgctttgcataaatccaagtctcagcaataaatgacaccctggggtaatgaaaggacttcagctgagactgtggaagtttgctggcaaactctggggaatcatgatgagtcagaggggccccatattaagaacagaaaaatgtgtttgtttgtttttagaacatgtcaggagtttttaatttttaaaatcaaaagaaaaagctgcatttagaagttacaagtcagtttttagtctggttatcatgttccctcaaaaatatttctagaatgcaatgttttaaaagagagtgtatgaccatctagaaaagaaatcaatggtcactaggagttacaggggcttcctaagataaactcccattcatatctttttggataaaggtaacaagactgagaggcaaagtgaatctggattgcagccagatatgtaatcatgtatttctttgttgttgttgttgttgttgttgagacagaatcttgctctgtcgcccaggctggagtgcagtggcgtgatctcagctcactgcaagctctgtctcccgggttcacaccattctcctgcctcagcctcccgagtagctgggactataggtgcccgccaccatgccaggctagttttttcgttttttgtttttttttttcggtagagatggggtttcaccgtgtcagccaggatggtctcgatctcctgaccctgtgatccgcccgcctcggcctcccaagatgctgggattacaggcgtgagccaccgtgcccagccataatcacgtatttcttgataaccaagaagcaggctatagaagtggggactagatgatcattttgtgaggtaaaattgaggaggtacaaggtggttgttctctgcctaacaactgtgctgaaatagtatatcatgaaaagcctgggcttcaagtcagaaatctgagtaactctttaccactgactagttcggtggtcccacaaatctaacccactgcccatttttgtaaataaatgttggaatacagccacacacaatttttttttttacctattgtctgtggctgcatttgtcattcagtggcaaagttaagtaagtagttgcaaaagagatcatgtggcacacaaagctaagatatttactatcagcctatttacaaaaagagtttgtcaattccctgactagttacataaacaactaggatgtttcataactttacttatactcattttcatcatcgacattaatctacattaacagaaattgattactatagcatagtgcttcaaaggcatctaatgaaataatgtatgggaaagctccttatggattgtagtgtgttgtacagagataaggcatgtcttatgatcactctggctactgaaagattaatagcaatattttcatgttaaagacatgccaatctccggtacaaagaagactctcaaaaatactagatggacttttggatgaatggatagatgggtggatggatgaatgaatgaatgacagtagtaattatacctcgcttatcactggctatgtaacagggacacatactgttttacatgtattaccttgtttaactgttgtaacagacttgtaacattatttacattttgcttctgagtaaaagagatttaaacaatggcaacatcatcagaagcaataacaaatatttatacaggacttatgacatttagccactgtgataactacttaccaaatattatttcatttaatccctcaattacctcatgaagtaggtgttggtatcatcatcatcatcatcatcatcgtcatcatctaatcatcattattattccatctttattgatgagaaaatagaggttcaggaaaactaacagacttcccaaaatcaggcatctggtaagtggcagagctggaattcaaaaccttgtctgcttgactctgagcttttaaccatcagacactgagacaatggatttgcattgacatgactcaattttctaaagataaatgtaatgtcttattgaaataattaaatattcttgactctgaagtgctctgaccttacaacaaaccatgaaaactagtttttaaaggactttttatgctgaactagttttagacttcaagaaaatttgcaaacatagtacagaattctctttatatctcccatccagcttcccataatattaatatattaaataaaaatgacacaatggtgagaaccatttagttgtcatttctccttagtttccttcattcgctaacagttccttagtccttccctgggtttcatgttctcgacactttggaagaatattgattagttactttgtacagtgactctcaatttgggattctctgattttctgtttttcagaatttgactgaggctgtgcagttttggcaagaatatcacagaaatgatgctgtgtgctcagtagatcacagtggagctcgtgaggtcattgtgtcttttttttttctttttttttgagacagagtctcaatactgtcacccaggctggagtgctgtagcgccatcttggctcactgctgcctctgcctcccaggctcaagcaatgcacctcagcctcctgagtagctgggactgcaggtacatgccaccatgctcggctaatttttaaactttttgtagagatggggtgtcactatattgcccagactgctcttgaactcttagactcaagcaatccttctgcctctgcctcccaaagtgctgggattacaggtgtgagccaccatgcctggcctttataatttgttttaacagactgaagtctcaataaactgacaggtaccctagctagaaacacacacacacacacaaacacatacacaaaacctcatgagagttttgactgtgttaagaaattcctgagaaccacaagcaaaagtaacatcaattctgcctttttctccaatgacatggttactgaaataagcactggttagcagaggctgagggcatctggagtttacttcctatttcttattgtttccctactagctggcgaagcacattgtctgatagaaatgaacttttggtgtatgtgtatctctgagccccatatgacaaagccagcttgaatcatgctccaaatactcattcatttccttgtatatgccaggctagactctggttgcctgtcctacctatgagccaggatcattggatgataagcactaggaaggtttttctagaattctgccattatacttagcctacacacacacacacacacacgtatatatacataaaacatattgattctatattaagattgaaagacataagtcccatgaaaataagggttgttaattttctcacatcttgctctgctcagctatagtcaatttaaaattgcagttgaatacaaagagagtttgctgtgaatacattgaaggccattgctttattcaggtgggcataattacagagaccataaggagactcccttttatttattgatctgacttctataagtttcctggatttcaacattttttcttgtttagagatatactgtctgaaaactattcaatttgaaatgtgtccactgtacaattcagtccttggaaaaaaagcctttagtaattaaagcagccatggtgtacctgctggcactaaaatatccctgtaagatgttagccatcaatatttctatagaaaatgccttattcaacaatatgctcttattatttcagttacagacacttttgtaaaagcacacatttaaaatgcacattaaaagaataggggaaaaattgatggtttgtcttaaaaaggaaaaacctgcagaattgggaaaaatagttttgtgagcacattttttgatagttgtattttttttaattttggacaaccattttgagtaacaatgactattctgagagcctatctctgtaaatctcttatcaatagtaagtaaagaagataaagtcagatgttgattagatcatatttttaaatattggtgatttaaatcttaaataaatatttgggattttgttgttgttgttaagacagagtcttgctctgttgcccaggctgcagtgcagtggtgcaatcttggctcactgtaacctctgcatcctgggttcaagggcttcttctgcctcaacctcccgagtagctgggattacaggcacgtgccaccatgcccagctaaattttgtatttttagtagagatggggcttcaccatattgccaggctggtcttgaactcttgacctcaagtgatccaccagcctcagccccccaaagtgctgggattacaggcgtgagttactgcacctggccttaaaaaaatatttgaatcaaatattggcaactaaataaatatgtttgggtaaaacctattccaatgcttaaaacattataatgtgccagaaaaattatacacagttcataagagaatatttgttaaatagttatttttgatttaatgtgactcaaaatcagaacttaaagagactttaaaagtcatatggggagtaaattggtagaagtgtctggaggataatctgaagttgcaaaaattttaaagtatatgtgtgacacttctgcttgcccaatttatcataaggaaatagtaaaacaaagttacaataatgcccatgaaattacgttcaccacagttttacttatcacgtaaagacactgaaaatgacaccaatggcccaaacagcgattggctgataaactttaagacaagtagtctcaagtcccacaccttcaaccttgaaataaacctggacttccacagattctttttaaatgctaaatgtgagctcttgttcatctgaccagaaaagaaaaccagaacaaaacaacagcagaaacatcaacaacaaaacccttcccagccgaggagcggtggctttccctgcctgaccagcagcctgggttacagacctgacctccttggtatcatggaacctaagaaattattggctattttctgcagctgttttcacaaagccacagcggaggtgaccttggggtggggtgaggcaggacccagcagacgggagctctgggcttcccctccagtgagagtgacttgaatttcatctcagccacaactggttttctaggtaagattttatttgaatatgctttctaaagccaaaaaagaaaatataagtttaaaaaccactactgtaccacccaacaattagttgttgttattgttgttgttgttttttcaaattagctcaaaccaggaaaacaaagtgctgattttagttacaaggattatagatcacataagtctggaacaggactgccatctcttattcaaacccctttgtaccagatgaattccaaatactttgtatttgttagatagttaatatagaacctatatattatgaaacacccctagcaaacatggaggcagcaactcacactcaaatacattaatagttctgaagtgagtcatataaaaattcacactagatgaattaaataaaaatttaagttacctcatatcaattcatatcagactttttaccaactgagttgggccaaatccttaagaaaattaaagaaacaaacaaacaaaaaaattggctttcagagctttttggatgttaggattgtggctcaggggctgtgcacctgtgtgatgcagacaaagctggagttcatgaggagctgcaggtggagaccccagcccagccagatgccccccagaactgaagtcagacacgtggatgctcacttgggaaggcaaagagtaaaattcaaagctccatacagaaggtagaaagagctcatcagagaaaacaaattagaggtcacatgcccttttcagcagtcaatatatatttctattctttaaaacacattttccaagaaaaggactatgtatactttaatattcatacaatgccataataatctggtaaagtgaaaatatgtccaccttatatgggtaagtgggaaatgttgccaaaaactatttttttctattagatagatcccttacccaagtgtgcacatgaattttaaaaagatgctatgtaaatggataaataaccaaaatgttaacagtgcttaatttcagggagtgtaaatttgctgatttttatttttattttatttttccttttctaagtgtttctgtattttttgaataatgagaaagtatgatttttaaaaaagaaaaacagaactctttactcttggtgaaaaatacaattattagcggttcacatgtaatttagtccctcagggaccaagtgattcacctaaagtcacattgttaatttggagaaaaactatgcttggactcaaggcctttgactccaagccttgcatcctctccatttctccaggctgcattttgaaatgaagcatgaaggatggcccctgccttcaaagtgctaatgattaagttgaggagataagaaatataactaggaagcaattaacaaacattacaagatgctatctatttaagtaactgctgcaaatccttttggaagtgggaggggtcatctaaatctcaaataagagaatacagtataacattgcatgacacgtattgcaaattcctatgaattcagaggagtagaagataaaacttagtagtcccagagaaggctctactggtaaaagacagatacgctttgaaaaggttaaggtcaggaaggatatttgtttccacaaggacatatccagacaacaagaccactgattgatggtagaaatagttctctgcatatgctagagagtaggagaacaggactggacaggtggagtaggcacagtttacagaaggctttgaaactgaaaaataagaggatgatttagaaatgatgtggaaagaaataggagccatggacagctttcatcgagggaatcacgggtgggacaaaggcacttaaactgcatgaatgttccagaagtggcatgtagggtggataggcaggtgaggatgatgtcgtggaagtcaggtgcagaactatcgaagcaatgtctgatgttgggcagcagaaattcacaaggaatcaggatcagacatggaagcagaaggctgagtcacaaagatgccaaggtttggaatggatgtctctgaaaacagtgatgacctgacagagatagatgatttaagatggggttcactatttcagaaggcagagcaaagagtaaagaaaacatgaagtgctcttgttcgttaaagttataactgtttagccatgtaggtttgagcactaaggccaaggggctaggttcaaactttcaatttgcaatgtggcttgattctgttctgatgcatcagccatgctcctcttatttcatgcaactatagcaaacacagggggattaaaaatagggaagacagacaagtcaataccaattataggaaaatgatttcataaacaagcaaaattcatccaaatatgatcaagtaagaacatgattttatatggcttaaatagcatctaaatgttttctttcgatttatttgtgcgagaaaaaagagaggttataaatatagaaaatggatgaaaatacaagtagttacatcttccctgtgtctgcttaggcattctatattttgcttgaagtgttttttaagaaatgatttatcttcattccatctgccctgtcagagacaccttggttgggtcagaatgactggtttagctgggaccccattgcctctgaacctttaaacagacagcgctttgaatttcatttcagagatcaggtgacatccaaatccacttaatgtgtaactggtatggtttttgatgtcactggagaccctgatgaaattacaatcctattagtcatgacgggggaagacaggagaccttaggtggctaatgttccattcataacaagaaagagccatttagcatttgtaaagggcattgatttctgatagttccctaaagaacaaggctcaagtgaagaaatatgaccagaaagagcttgggaaagaaatgatagaaaaggcaagattgcatttatccaaacagctttactctgtgtactttttacaacttcacttgaatccaaagaattgagtcttcatgtaaaagtggatatgaggaaggacaggaaggacatgctcagctacacagagattctgttactgagaaatctggggaattataccgtgcccttgattgataccaatgaggtgcctctaaatataaagggtaagtagaggttatgtggaaaaagggttttaatctgggtgataaattgccagattccattatgcttaatgagtctcatcagtgcatagctagactcaagaaaataagacccctttcaaagcctagtataagcaaattagaagaattaataataaaaatcctattaatgtgtatgcaatttcaagcagttaatgaagtcaatttaaaaagtttggctaacgtattttttttttttttgcattttttaaaataaaaatacctgatcatcaaaatagatttgttcttcaggattttttttctttttttcccccaaatatatcctatgtaagacttaaaggattagatttcctttggtttactcttctccagggagggccctacttagaagttatgggatatgacaaagggagtgttgcaggtcttcaaatgtataaaatgcttattgacctgaaagttacaaatgagattcattcaagcaaatttgccaagcttcataatatccctcctaagcaaatggcgactacctgaagaaaaaggttctcagtcacctgcctggtaaaacataaatctttgcttctcaacataaggtctcaggtaggaaataagaagcagggtctacaaacatctatgtgtggctcaaaacagcagtagttgttgtctctgaccagctaagaccttcagtcccaaataacagagaatctgctggatttgcaccaacaaatttttgtgcaataaaccatcagtcatgggttaaaaatcagactctcacttcttgccaattggattcttttaagccatcatttagaaaagaatctccatactcaagcatataatcaaagcatgtgggagatgagaaaaaaggtagcccctgttttgtagttaaatccctaggcaagaagcacaatcagacatctgtgcgtatttagatttccatgaaaaggaatgccatgtgctccttaatgccatgtgaaataacataactcatggttttcggatggcacccaggggcatggagagtgtaatgatgtccgcttcagaagttaggaacacacttgtgtgcaatgttacctagataatagtcacagtgtctggcacagagtaagcaccctataaatatttcttcaactctgaatggaagagtgagttctttcatacacaatctgctatgtaaagtttgtacatcctctgttttgttacaaaaataatatatgttctcactagcttgtggtttaacctctgaatcaatgaagaatgggagccactccctcctcaatttttttccttcctgggctgctaatgtgctgcccctacctggttctacctccatacctcagtgcttccttactgggcttcctcttcaaattacttgtcgccatcccaaccctgtttattttcttttacattttctaatcaaggattcattgagttgtatgacttcaacaaatgcctttatgcaaccgtgccctgaaatatttacaagcttatcattatactagattctgtaagggataatatagtttagtaagaagtgcactcatatacttgaagataaatgacaattttatggccaaatgattgaaaagatgcagaactatcattagaaaagaaaaagagccctgttgtttctggcaaaggatgtgagatttgagtggtccttgaaggatggatgagagtcatacatggagagctcgagaaggagaggctatcaggaggtcaactgttatgggcaaagacggtggtgatggaaaactatgtggctggtttggggtcaatgaggagactgctgggtctgccttgaaggtttcattatagaataatgggcagtgttgtggaaagacaggtggacccactctggaagccctcaaatgcttgattaaggaatggattttatcccatgggaaaaatagaactatgtgggattttaagcctgtaagggacttaataaaatgattcctactgactagaaggttctttctcaacatctcctcactgcaagtccattccaaatcccatgtttctttttcctttgtccactggcttaattatttctgtcagtgttaacagcatttttcttggactcaaaggctgttatccttgggaatatctttgaggtttgtctccaacttcaaaactatttgagggttcactgaccaaaagcaccttggtaatgctttaaataaatacatattcctagaccctgttcgagaccaactgtatagtggtagattttaggacccagatttctacctcttacagaatgagtaaatctttgctaatggttacttttcctttcaaatatctgtcaaccttcccatttcttttcaaacctactgcagtcactgtaactcagaacttccttatccttgactagttactatgacaggcaccttctgggttacatccttcactctaatatcagcatcttctttacagaactcatttggactccaggagaatagcaacataatcgtaattcagatcagtggtactcagatgtttcagtggaggtgattctaatgcaaacttttcttcaggagggaaataaaatatttaggtatacatttggcaaaaatatatgtatctttttttggatgggggatgacagagtctcattctgttgcccaggctggggtgcaatggcatgatctcagctcactacaacttctgcctaccgggttcaagcaagccttgtgcctcagccccccgagtagctggaactacaggtgtggccaccatgcctggctaatttttgtatttttattagagacagggtttcaccatgttggtcaggctggtcttgaactccaggcctcaagtgatccacccacctcggcctcccaaagtgctgggattataggagtgagccaccacgcctggccaatatatatatgtactatctacagggaaaactacaactctgatgaaaaaaatcaaagagctaaataaacagagagatattccatgtttatggatagaaagactgagtattgtcaaaatatcagttctttcaaacctgattcacagattcaatgcaatcccaatcacaatcccagcaagttattttgtgcataatgacaaactaactctaaaggttatatggagaagccaaagaccctgaatagtgaaaaatatcgaaggagatgaataaaagttgaagaactgagaccgtctgacttcaaaatgcactacatggagactcaaatcaggaccttgtggtactggcgaaagaatagacaaatcgattaatgggacagaatagaaagcacagaaacagcacagaaacagacccatataaatatagttaacttgtctttgacaaagaagcaaaggaaatacaacggagaaaagatagtctttccagtaaatggtgctggaacaaatggacgttcacatgccaaaaagtgaatctagacacagacctcacaacatttacaaaaactaattcaaactgaatcacagatttaaatgtaaaacacagaatggtaaaaccctatatgtaggatagtaatggtgcaatcacatgcctgggtatttacccaaaggaattgaaaacttatgtccataccaaaacctccacacagatgtttacagcagctttattcataattgccaaaacttggaagcaaacaaaatgtttctccataggtgaacggataaactgtggtacatcccagacaatggaatattattcagcactacaaataaatgggctatcaagccatgaaaggacatagaggaaccttaaatgcatagtactacatgaaataagccaatctgaaaagtactgtatgattctgactttatgacactctagaaaaggaaaagctatagagaagatgaaaattcagtgttttccaggggataaggggaagggactgggcacagaggatttttagagcagtgaaactactgtatattgtagtactgaatatatgtcattatacatttgtccaactcatagaatgtacactaagaatggaccctaatgtaactgtgaccttgggcgaccatgatgtgtcaatgttggttcaactgaaacaaatgcaccactctagtgggagatgtcggtgatggggtgaagtgcgtgtgtagggcagtgggtgggggatgttggtgatggggagaagtgcatgtctagggcagtgggtgggggatattggtgatggggagaagtgcgtgtgtagggcagggggcatgtgggacatctctgtaccttctgctcaattttgctgtgaacttaaaactgctctcaaaaatgtctactaaaaacaaacagaaaacaagcaaaaaccctacttttctctgtgctgttggtcttcagagaaaggagcggcatcttcaaagtatagtaaaagcctcacaactggagaagtaatcagcatcaggaaagcactcactaaactttctgcccaaggccaaattaactgtcttttctgcgctccgaaatactcagaagactcttgaaattccactgagtatagaacccaaagccaactggatttcaaacaattccaagttcacaaactcagtcagtctgtccctgcgcttttcttacaatggggaagcactgccaagccctgcagaagatggtgggaagcagtgcttatctggtaacggaacacctccttaaaatgaactctttccaggttgaaaattcccctgttccaacttctactatcatttgaagtgatgaacacaaaaagaaacacacttctccccacaatcttgtcctgtctttggcattttagagcttatccaccatagtttcttatgttccaagaaaattacattcttttggtattcttctagggtgttagtaatgtcttgaggaaacaatgtgggttagagatgatcagaacactgtgacatgagccgtatgaaataaacctggactatatttaaatgtctgaaaaaccggataataacccaaactggataacaagccaatatttttttaaacttttattttaagttcatgggtacatgtgaaggatgtataggtttgttaaataggtaaatgtgtgtcatgagggtttgctgtacaggttatttcatcacacaggtattaagcatagtatccattagttatttttcctgatcctctctctcctcccaccctctgccctctggtaggcaccagtgtgcattgttctcatccccatgtccacatgttctcatcctttagctcccacttataagtgagaacatgaggtatgtggctttttgttcctgagttagtttgctaaggataatggtctccagctccatccatgtccctacaaaggaaattatctcattgcattttaatggctgcatagtattccacggtatatatgtaccacattttctttatccagtctatcactgatgaacattgatgaagccaacatttttaagaataggtgtataaatgaatacagaaagtcaaaaatgggaaatgggtccaatgtctgaaagataagcacatggaggaaagagagggcttcagagtgggcccaataaattcatgtcaaggaagtcagctcctgcaggaccaaatgcctggctaggtgtacaggaaacaaaagtgtggtggcatcaccaagagggtctgggcaacaaaatcaggcacaggtacaataaatattcagtagacatctattgaaagaaagaatgaatttatgaagatttaggtatcagaaaggaagaactgattccaatacatgatggctgtcatctcaaattgagaatattcaaacctaacaaaattaatacacttatgaagaccatgttatcagaaattggaaataaattccagtaaatgttgactaacaccagaaactcagtatgttcaaacccaactaaaaccatgtcagtgtggcatcaccattcagcccctcacacaaacaaggaatctgggaatcatcctcgactcctccttctcccccgtttgcccgagtcctcatgccaccaagtttttttgcttctacattctacatactcttgaaatattgccccttgtttccatcctcatagccactgtgattcaactgtctttatcaactttcactgagaccgtggcagtgacttcttcgtcactgtgcccagcttgggtctcatccctactaccaccactacccaaactgtgggctgggtaatctttctaaaacacagactctattacagcatacctttgcttaaacccttctggtgaccttcccctgtctacaaaataaaatggagagcatttgggccctatgtgcctttccaatctcatctcttgtcatttcccatcttgatcacactgggactagaaatatgaaaggcagaataacacaattgttaggagctgagccacagcagtgctagacattgccagtggtacctgtgtgacataaaggggacactgtcgctggtatatcccattcctataggaaacttggattcctttttagatgagtacatataaccttacagctctgtagagaggcccaaaagaaattgtaagtagtgtattcatttgtgggtaggaaaaaatgtctgaggtatcagaagtaatgtttttggagttccctgcataaaaggtattaggggaaactaacatacaaaaaaagaaaattcttacagatgagtgtcttgtctggtttttctgagtcatcacatttttttcctatacactggactctctcattcatttgtagccatccaccagacacccatatacagctattatttcttattttaggttaatattgccaagaagttacataatcaaaacagaaaatctgccaaaaatcccaaactgtataactattcatttcaaagccaaatataaattatttgagattagccaaagtttcaaattattatgtgtatcagtggattctgaaaagcatacaggctggaataagcatagtaaaaatgacagagcaagcttcttgaattcttggtgaatgctgcagcaaataattttgccaacaaccacacttcctaaacctcattaagcaagtaggaaagaataaactattccattaccattcctcaaactggagaaaaaaatctaggaggaaaagccaggggaaagcacccaacaaaagcatttcacctcaaaagctctaaggtagagcaatttgaagttagaaaaatgggtttaagtagctactttggttgatttctgcctagttaggcttccagtgaccccctaatttgcctggaaataatgcagagaccacctaccgtgtgcaaagcagtgtgacatttagaacaaaggtggcagaatctcaatgttcaaaagaacacataccacatgaggtaggggactcagaagaaggaagtaagaactgggctcacttccatttacttaccaggctagggatggagccatctgagggctaagccccaaactggccttggattcatgagaccaggaaaacccctgatccacacagggagcagtctaattggctgggggcagggctgctctcataacccaccccaaacagtggcagtcacaagcgaggacaaacttggaaggaggcagggcttcccaggtgtgttatatgaaccaccggctttttggaagattagacaatccccataaaaagataccttaatagctatatgctgatgtctgtatatattagaagaatataaaaaataaaactaacctattaacctcgtgatttctatgctaagttttaaaaagttgacaaagaaaaatggtaagtaaatgatagtacagatcttactaggatatggacacatcattaagattatatccaaatgagtgaagtttagaaaagcctggactagaccaaagagataagataaagcaagtccatggaatgaaaaaaaacttctaaggctaactctgaaaaaaacgtatatatgatactctcacaaatttttttcctgccttttagataaattacagacactaaacatctgaattatagtgtagactatcaaattttgtcaggacaaccagtttggaaaacctgcatcccacttctcagcttctatctgccaagttttgcatccaattgccccttccactgcatgcaaacctcaggtggggtgtgggagtgaagagtaacaggtgtaattaacctgcccacacttccttcccaagtctagctgttgcagcagtctgggagcatcccacagccagggaaagggtattgaagggaaagcagtatctgccacctaggaaattaattgaaaagaaggaaaccttcctccgttctgtctcaccccaattcagaacatgttaattgcagagaggctaagttcattaagtgctgcttaactgttgtctgaagattatcacatattaaatgtaaaacctaacagtcttcactcttctgataaaagtttgtaagagtatttttccagaagcccaatctggaatgattgtggagcggtgacttgttaaggagcttaccctgccaatgtgtatgtgggcactttgtttctaattatttcaataaacgagctttataagaaatcctagtaataaagtaacttatgccacagaagaataaatcctggtgctctcaatatccagataacataaccatgctattaagcactgcctcgtcaataatggtagtctttgtataatgatagaactctatttacataatacaccaacagtgcctaatgcaaaacagggtttacatataacattagttgaatttacagcatgaattcacattccacctttgcattggtcagaaaacattatttcacacttcactgctctaacaaataaattaataaagctcacctcatctccagtaaatcccgacgtgcatacctcgtgattcaaaataataataacctccagtcttgtccttgcatgtcctttgaatcattctcggagagacaatcattttctggactaccccaccctgcatctgaactccagatgtgttcaaactggattctggccaaagctagagaagtctcagggatagtgacgatctcatcattttatgtcaagtgaagggaggaaagttaccaggattttcttgttttccttaaaaattcacaaaataccaagtctcatctttctagggtaagaattcagtaaaacactccatgcctgtatctttacttgaattgtcagctccatgtggacaggaaccatggccttctcatttattcacttttctgtcccttagttcctggtacagacaggtgctcaatgcctgacacatagtaggttttcagtaaacacttgtggaatcaatgaaaaaccttactaatattgcatctcagattggagaaaatgatccaaggtaatgtcagcgcacttcaaagtgcagtaaaatgcagctgtcatttatgtatcagagactttatacccatccctgtgtaagatattctgtgagaagtaaataataaaaattgggatttatagtcagatgaagggaaacagcccagtgcaaccgaaataccagcaagtgaatagatgtatgtacataattggaaagatgttcatactattacaatatataactgtcaaaaagcaaattgcagaaatatgagagagggaaaaaaattatttttggcccctttgaatctcatcctgtggaacctaaaagcaaatttctccttttagaaagaaataaaaagatatttatttattccttctatgatatttatttgtatatttatgtgcagacagacagatgaataagatttatcctagtataagaaaaagtctaaaagggcacacaccaacccattcaaactgtttataacagtgctattaaatctaaaaggtagagtttgggagaagattttttttcactttctatttaatgcatttctgcattgtctacatttttttacagtgagcaattttttttagtaaaacaaaacaattagaatttttttaatgttataaataactaactacatttgtggtatatattgagtgttttaggagctcaataaaactttaattgtctggaatataattaaccaaagacctcaatcaaccagtatttttcctctacattctactcttagaaaaaaagaagcaaatcagataaaaataaattcatatcaagaatttatggagcagttgtatttttccaaggtaagtagctttagggtcttgtctaacttccaaacattcagctctaatgtatccatctccatgttgtctgtacaatgatgagtgttgttcagacctttgctattctatctgtgctgccaggcaagcaccttgtcaggatctcaggcccaatcagacttactgaaccagaatacctggaagtaaagtccaggaacctgggttttaacaagatccctaggtaatatgtttgcacattaacttggagaagcaccagtttagaagactaacccctgagttcctgcatgatcctcaacctataaaggaagacttattttcatcagattgtccatttaaaaatagaaaagtagacattttacatatactgcaggaagtgctaaacaatgttacccactgaacaaaattaactagacatatattgaaccccctcttatcccacaaaattgttggaaatgacattagagcacaacacagtaaaagatagatagtcaaaaatttcagctccagaacaagtctgggaaagtagaatcctgcaattacttgttttaaccatcagatagtgcttacacattggcagggaaaacagaaggccatatctcaggacgaggatgacaaggcatggcacttaggctgctgccagtccccattccataccaatgacagacatcgtcagtcatggtgctttctcatcccacccaagatgctgcaccagaatccttctcaatggatatcacaggtactcatgtctcatgaatcaaagttagcacttaagaagaaacatttctaacgtccctatttgaaaactgctggacatgataaataacctgattaagagatgataaatgaaacatgagtgatttaagtcctcatcgggtgggcaaaccaaatatgagagattcaaaatagccaagaactgctccctctatccagaaatgtatttatttaccattcctcaaactgtttgtttagtgtaggcaaagattagaaattagaataaatgaacattagagccaggagaactcttatagactatctagttcaactgcttctcttacacaggaggaaatactgatctaaagaaatcacagtggccaaatcccatagctaattctggcagaacccaagtgggaatcaatgcttatctaaccaggatttctcccattgcaccaaatggcccctaaagccatagcagccactggcaccataaactggatacaaatacacatgtggattcagaaacagagaatcacatcacccctagctctggggataaaccaaactcatgtagtggcggaccatgctccttggtaagaggctatagccagccaccagggagctctgcgctgaagtttgggtaagcccacaaaggggaaagctcctccagaggccctgcacagttacttctgagagacttgtgttcttagatctccccaaggtattccaatttaacacatgcaaaatcaaactcatgatttgcacgacacatccatgccagaacaacaaacctactcctcctcgtctgatagttgtctttgagtaaaaccactcttcacacagttatgcagggctgaaagctaagagtcatccttgtctcccgcctcttcctcaatctcaaattcaacgaacatcatcatcaattatattcttagatgtcttggggatcatcctcttctctatacctaccccattactatggtagtgttaaatactctcacctgttggcttagtcttctgcaatagcttgttaactgatctcacacgtgtattatgcccctccctcgaatctgttcaccacacagtacctagagtgactttttgcaaatcagaatggtatgccactcaccttcacttaaaccattcaataccttctcattggttttaacatgacactcaagtccctacaggatctgaccgctgtctacgtctcctgcctcaccccttaactctctgcacaccacactggtcccctctcacttcccctgctcctcataattcctttgactgcagggcctttatacatgctacctcctctttctggagccatctgcatccttcacatcccagttccagatgtaaggcctccaagaagccttttcaggttccactgaatatgttacttctcacaggtaagcatttactctctcatgaataagcatttgttttcttaggagactttcatctgttaataattagacattcattggggcattatatgatcaatgtctgtctccttactcaccaccccattctctgtagtctggagagttcaggacagcaggagagatgctagaatctttgtcctctttagttcatcattttgtcctcagtgtcttaccaaaggcaacacacagtagacatctaataaacactgaattgaatgaatgaaaaaatgaacaaataaaagccttgtatttaagcataagccactgattatgcttaaattattattcacagcttccaggcacatgtaaaagtgatgcattctaggattgctttttttaaaaaaaatttttttattatactttaagttctagggtacatgtgcacagtgtgcaggtttgttacatatgtatacatatgccatattggtgtgctgtacccattaacttatcatttacattaggtatatctcctaatgctatccctccccactcccttcaccccacaacaggccctggtgtgtgatgttccccttcctgtatccaagtgttctcattgttcaattcccacctatgagtgacaacatgcggtgtttggttttttgttcttgcgatcgtatgctgagaatgatggtttccagcttcatccatgtccctacaaaggacatgaactcatcctttttatgactgcatagtattccatggtgtatatgtgccacattttcttaatccagtctatcattgttggacatttgggttggttccaagtctttgctattgtgagtagtgctgcaataaacatacgtgtgcatgtgtctttctagcagcatgatttatattcctttggttatatacccagtaatgggatggctgggtcaaatggtatttctagttctagaaccctgaggaattgccacactgtcttccacaatggttgaactagtttacagtcccaccaacagtgtaaaagtgttcctatttctccacatcctctccagcacctgttatttcctgactttttaatgcttgtcattctaactggtgtgagatggtatctcattgtggttttgatttgcatttctctgatggccagtgatgacaagcattttttcatgtgtctgttggctgcataaatgtcttcttttgagaagtgtctgttcatatccttcgcccactttttgatggggttgtttttttcttgtaaatttgagttctttgtagattctggatattagccctttgtcagatgaatagattgcaaaaattttccccattctgtaggttgcctgttcactctgatggtagtttcttttgctgtgcagaagctctttagtttaattagatcccatttgtcaattttgacttttgttgccattgcttttggtgttttagacatgaagtccttgcccatgcctatgtcctgaatggtattgcctaagttttcttctagggtttttatggtttcaggtctaacatgtaagtctttaatccatctttaattaatttttgtataaagtgtaaggaagggatccagtttcagctttctacatatggctagccagttttcccagcaccatttattaaatagggaatcctttccccatttcttgtttttgtcaggttcgtcaaagatcagatagctatagatgtgtggtattatttctgaggtctctgttctgttccattggtctatatctctgttttggtaccagtgccatgctgtttggttactgtagccttgtagtatagtttgaagtcaggtagcgtgatgcctccagctttgttcttctggcttaggactgacttggcaatgcgggctcttttttggttccatgtgaattttaaagtagttttttccaattctgtgaagaaaggcattggtagcttgatggggatggcattgaatctataaattaccttgggcaatatggccattttcacaatattgattcttcctacccatgagcatggaatgttcttccatttgtttgtgtcctcttttatttcattgagcaatggtttctccttgaagaggtccttcacatcccttgtaagttggattcctaggtattttattctctttgaagcaattgtgaatgggaattcactcatgatttggctgtttgtctgttattggtgtataataatgcttgtgatttttgtacattgattttgtatgctgagactttgctgaagttgcctatcagcttaaggagattttgggctaagtcgatggggttttccagatatacaatcacgtcatctgcaaacagggacaatttgacttcctgttttcctaattgaataggctttatttctttctcctgcctgattgccctggccagaacttccaacactatgttgaataggagtggtgagagagggcatccctgtcttgtgccagttttcaaagggaatccttccagtttttgcccattcagtatgatattgcctgtgggtctgtcataaatagctcttattattttgagatacatcccatcaacacctaatttattgagagtttttagcatgaagggttgttgaattttgtcaaaggccttttctgcatctactgagataatcatgtggtttttgtctttggttctgtttatatgttggattatgttttttgatttgcatatgttgaaccagccttgcatcccagggatgaagcccacttgatcatggtggataagctgtcggatgtgctgctggattcggtttgccagtattttattgaggatttttgcattgatgttcatcagggatattggtctaaaattctctttttttgttgtgtctctgccaggcctgggtatcaggatgatgctggcctcataaaatgagttagggaggattccctctttttctattgattggaatagtttcagaaggaatggtaccagcccctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcgaggaatttatccatttcttctagattttctagtttatttgcatagaggtgtttatagtattctctgatggtagtttgtatttctgtgggattggtggtgatatcccctttatcatttttattgcatctatttgattcttctctcttttcttctttattagtcttgttagcggtcaatcaattttgttgatcttttcaaaaaaccagctcctggattcattgatttttttgaagggttctttgtgtctctatttccttcagttctgctctgatcttagttatttcttgccttctgctagcttttgaatgtgtttgctcttgcttctctagttattttaattgcaatgttagggtgacaattttagatctttccggctttctcttgtgggcatttagtgctataaatttccctctacacactgctttaaatgtgtcccagagattctggtatgttgtgtcttcattctggttggtttcaaagaacatttttatttctgccttcatttcattacgtacccagtaattattcaggagcaggttgttcagtttccatgtagttgagcagttttgattgagtttcttaatcctgagttctagtttgattgcactgtggtctgagagacagtttgttataatttctcttcttttccatttgctgaggagtgctttacttccaactatgtggacaattttggaataggtgtggtgtggtgctgagaagaatgtacattctgttgatttggggtggagagttccgtagatgtctgttaggtctgcttggtgcagagctgagttcaattcttggatatccttattaactttctgtctcattgatctgtctaatgttgacagtgcggtgttaaagtctcccattattatcgtgtgggagtctaagtctctttgtaggtctctaaggacttctttatgaatctgggtgctcctgtattgggtgcatatgtatttaggatagttagctcttcttgttgaattgatccctttaccattatgtaatggccttgtttgtctcttttgatctttgttggtttagtctgttttatcagagactaggattgcaacccctgccttttttttgttttccttttgcttggtagatcatcctccatccctttattttgagcctgtatgtgtctctgcacatgagatgggtttcctgaaggcagcacactgatgggtcttgactcttatccaatttgccagtctgtgtcttttaattggagcatttagcccatttacatttaaggttaatatagttatgtgtgaatttgatcctgtcattatgatgttagctggttattttgctcgttagttgatgcggtttcctcctaaacttgatggtctttacaatttggcatgtttttgcagtggctggtactggttgttcctttccatgtttagtgcttccttcaggagctcttgtagggcaggcctggtggtgacaaaatctctcagcagttgcttgtctgtaaaggattttatttctccttcacttatgaagcttagtttggctggatatgaaattctgggttgaaaattcttttctttaagaatgttgaatattggcccccactctcttctggctcatagagtttctgccgagagatcagctgttagtctgatgggcttccctttgtgggtaacccgacctttctgtctggctgcccttaacattttttccttcctttcaactttgatgaatctgacaattatgtgtcttggagttgctcttctcgaggagtatctttgtagcattctctgtatttcctgaatttgaatgttggcctgccttgctaagttggggaagttcgggataatatcctgaagagtgttttccagcttggtttcattctccctgtcactttcaggtataccagtcagacgtagatttggtcttttcaaatggtcccatatttcttggaggctttgttcatttctttttattcttttttctcgaaatttctcttcttgcttcatttcattcatttgatcttcagtcactgatatcctttcttccagttgatcaaatcggctactgaagattgtgcattcatcacatagttcttgtgccatggttttcagctccatcagctcctttaaggacttctctgcattggttattctagttagccattcatccaatcttttttcaaggtttttaacttctttgcgatgggttcgatcttcctcctttagctcagaaaagtttgatcatctgaagccttcttctctcaactcatcaacgtaattctccatccagctttgttccattgctggtgaggagctgtgttcctttggaggaagagaggtgctctgatttttagaattttcagattttctgttatttttttccccatttttgtggttttatctacctttggtctttgatgatggtgacgtacagatggggctttggtgtggatgtcctttctgtttgttagttttccttttaacagtcaggaccctcagctgcaggtctgttggggtttgctggaagtccactccagactgtttgcctgggtatcagtagcggaggatgcagaacagcaaatattgctgaacagcaaatgttgctgtctgatcattcctctggaggtttcgtctcagaggggtacccggccgtgtgaggtgtcagtctacccctactgggggatgcctcccagataggctactcgggggtcagggacccacttgaggcagtctgtccgttctcagatctcaacctccatgctgggagaaccactactctcttcaaagctgtcagacagggacatttaagtctgcaggatttgtgctgccttttgttcagctatgccctgcccccacaggtggagtctacagaggcaggcaggcctccttgaactgtggtgggatccacccagtccaagcttcccggccactttgtttacctactcaagtctcagcaatggtgggcgcccctcccccagcctcgctgccaccttgcagtttgatctcagactgctgtgctagcaatgagcaaggctgcgtgggcgtgggaccctccgagccaggtgtgggatataatctcctggtgtgctgtttgctaagaccattggaaacacgcagtattagggtgggagtgacctgattttccatgtgcaatctgtcacagctttgcctggctatgaaagggaattccctgaccctttgcgcttcccaggtgaggtgatgcctcgccctgctttggctcactcttggtgcactgcacccactgtcctgcacccactgtccgacaagccccagtgagatgaacccggtacctcagttggaaatgcagaaatcacccgtcttctgcgtcactcatgctgggagctgtacactggagctgctcctgttcggccatcttggaactgccccccacattctaggatttctgagggaaagttgcttgttggctatttcagtcattcaaaaagtccacctgcatacacttgcaaaatggcgtcttcttgaaagatgtatatatcctcagatgcaggccaagccactcctctgtgttcagacatcctgctgtgatctcttgtgtcttgttatctcagactgattatccctcccaaatgtcacacctcataatttgaggcagagatgccaactacataggtacctgagttagtcccaggtaagggataatgagtagcctgagaactgttagcaacagaacaaaccagggaaaagttcctaacgttttggtatgtattagagactcgacatggaagagcagaaaacaaagtgttctcttgctctatatcatagtcttgaagcaatttctgacatccaaagctgataattaactgtactaaacgatacacctatttctaacttgggccacagccaagtggatcacagtgttttcatggtagttaaaataattacgaagtataatcttggcttgtgcacacattcgtgtgggtgcaggcccgtgagctcaccctctctcttcccctccctctcctttgccagaagactccaatgttgagcaatgaactcaattcttttcacacagttacttggctttttcagagtggccgtctagtggcttgctccttcagtcatagaatcctgaaactgaaatgaaccttcagaatacattgtgccaagagcagagcttccaggccacctaagtaatatcttgattagaacagccatctctttggagaagtgaagcatcccgattgactcctcagtactgaagcagcctccaaccccagttccaaaatatacccacaactaaggatggcaggtaacattcatgtgataacactcacctatgcaaacaaacaggaaaataaattaccctgtgtcccatgggccattcctggcacaccagctgtgaccccaaccctccaggcccactgtggtccatgcctgtgtatatgtcgcaggacaagtccatgcttggtacccttcaggccctaagacaagaaagactccttccagtgtcttctattttacaaccggaaactattttagcctctgggagtcttctgggtaccagccagtgatgactagctccttgactctcctgttgaatgtggctattatgtgcataccagggaggacataaagcttcccacacacgacccgataccctggaggaacacaggcctatttccacactagttcctccttttaatccagctcctcagatctaatgctttcctaggctaagatctttgcctggtttcttacagaaaatgctctttctaatcttaattttcctctttttctaaaactataacacttttcagttttctcttggctccttcctcatctccccagccaggactgccatctcaccaacttttcatcagcctctaatttcccctagagtagtggttcttaaccctcactgcaaattaaaatcactttgggaattaaaaatagacgcctatgtagaagtgtgtgtgtgcctgtgtacaccgttacctgtgtctaggctccatcccagaaaaactaaggcagatctctgggagtgggacttggtcacggataatttataaaggatcttcagtgattccagtgtgtattcaggggcaagaaccactgccttagaacttgtttacttaactataccttttagttttcattcacacatgcagagtgtatttattggtaatatactcatttttatgtattaagaatttcgtatgcaccaagcattgtgttgggcactggaatgcctcaccatgtagatggagccttctttgatgttgatgttctgaacatttctatcctcagccctcctattctttccacctacactttcctgagagctctctgccacgtcattgtgccaactaccatctactttctgaggaaccctgaggctcaatcttgggagcttgtttggaggttctagcagggaagcatggccactcagatatcctgaatgaaagaacagtcctcctgtattggggaagactgtccccttcaatccacagtgcagcttcaggagggttgcacatggagcggtgagggaggaaggagacacctgcctaggcagccagatcagccgaatcaaccctggcagtcaatgggggacagatatcacagccagatcaccctcacatcccgaagtctaagtcttgagtccagacagctaccctgttacttagactatagactatctgactacatgtaagacatgctggctttagtgacccatggacaaatcagacccatatgtcaaaatggaatgttttaacttcccactgagtcttccttctctatcttcttggtggccccacagtccatctggtcacccaagtttgaaatctgggaaatcttgctccccagccctcttccccgcactcatcctctaaatctaatgttgtgtccaaaacattgtgtccctaatccaggccctcaccatttctctgtaaggtggctgatggatctcctgcctctagtgttgctagctatagtctaatcttcaccagaattaccagggtaaactgtctcaagggaaaatggaatcatgtcacagttttccattactcacaagtgaaatttaaggtccttacctggcacacaatgccatccaagatctggcccctcccaattctccagcccccgctagaatgaattgggagaccaagattgctatcacagcaacacagcaggggttacaacgtccctttgccagttaggctttcttatgcccacccccatggtttttatcatgctgtcttctctgtctgtaaaactcaccaactcaccccatcccacatacacacactgattagttgtattgccattagtctcagttacatctcaaattacatctacagttatgggctgcatatggacacttggatcaatgacagaccacatattcaatggtagtcccataagattataaaaccatacatgtactgtatgtttttatgtttaaatatgttttgatacataaatacttaccattgtgttgcagttgcctacagaatgtagaacataacatgctgtaaattaaggtttatagcctgggagaaataggctacaccatatagcctaggtgtataggaagctatatcatccaggctatgtaagtacactctgtgatgtctgcataatgacaaaatagccctaatgatgcatttctcagaatacattctcattattaagtgacatatgactgtagtatacgactttaaaaacagtataattatgtgtctttgtttctgtattccccatagatggtgaactccttaaaggcagtgactataactgtattgttacagtttttgttgtttttgtctttatatatttcacaacctagaacaatggctacaacatctcaagtactcagatgcttatggaataaataaatggagacataggttcctccccttaataagcttaaaattgaataaatttatttttgtttctatatccatttatccaagtccatagtttccttttccccaaactcttatatatactcagaaaggcccattacagtcaaatacaaacaaggcaatttaattcagcattgggagtatctagctaactgtaatattccaagaatgtagagggatcatgtgtattactgaatcataatactgatgtacgatgatttataaggcaacagcgtcgaaaactgacccctagcttcctataatttgattgcctttcagaaaaagttctcagcagagaactgagtctagagtcctctcagtacagaagccaggatacgcaacccatcaaataagactggtttgctgaatcaagagccactgaccgatttgacagctccatattcaaactaaacagctctttttggaaactagacttttggatgttataccagagatgtgactgagtagaacagagctttccaggggctgaataatccattatgcttattttatcagagattcaagttgaaaccattgggccattgagtaataaactcagtttgaccttgtcaaaatcctacacctagcagtattttgagaacttgtttgttctgccacttcgttccaagttgtttgaactttagttgagcccatgaaagctttacagttatcaagtgtgcttatatatgcacattatttcacattgatccacacctgcctggtagccatcactagaggccctggaaatattcagagaatcactgaagtgtgagcaacagttaataaaaaattcttgcagttttaattacaaacaaaaagcaagcatgtttcaactctataaaattcaactggaatatccagggaactattgctgtttataaccaccataaattatattcatctttcatactgagttagtgcagcttacagattgatatataaagcaacaagttctaatatttatgaaagtgtgagttctaccacctgtttcaggagttctaacctaacctccagaacaaataaaaatgaataaacaactatcttcgcccttcctgccatgggagtccttttgttctctaagtcatgtttctatctatgaagcaaaatgaaggactactaacaaccttggtgccatatgtattaggaaggaaaattgctgtgctttgtccaaaggcaattagtgttaggaaggaatcaagaagcaagccaatattggagctgctctttcttctgagctgtgactgctagaaaccatgacaaaaaataatgtgagagattctcatcagggatcttgggccccatttgcatattctttcattcaccacttactttgtaaccagccctatactggcattcaacacacaaagacaaattagacagactcctgccttctttacagagaagcttcctgcacaatgggtggttcacataagcaataaaatgatttggtaaatgtgagaatggagacatgcattattcattcactctttcaacacatatgctagcttgactttttaaagtcagatgctgtattaggtgctagcgaactaaaaatagtccttgcccttgaagtgtttgtgggatgtgtctatatggtaaatacccaattacaaagtaatgagattgggagtatggtaggccaaatgcatggaagcatctagcgagtcccctgtctcagatgtggaagtgaaggaaatctctcagagaagatggactatccaagacaagagctaagaatggaggcacatcagtcattgaaagaggcaggtgtggggttggaagctactgcaggctacaagacctagaaccagcaagaacgtggtgcactgtaaggttttctggattaaagtctaggttgtagtgttcatcctaagaagtttcttatagcaaagctttagatattataaccctttagtataagctttggaaattatccaaatcttgcaaatgaatgaatgaatcaatacatagtgacgtttctttacagtaaccccaggaaccattttgttggatgaacttcaaaaaacacagaacaccaaattcgaacacatgaaaggaaaggaaaccaaatttatcaaataagtcaccaggaaagaagacaaaagtaaaatgtccttggccttaaagacagttgcaggaagatataatcaaaactttaaatcatgcatgaaaatgcaaaacccatggtcttgcaggcctcagtggatggaaatatttaaaaagcagatttgttcacctggtctcaaaataataaaattgtgcattttcaccattcttcttaacatattaagtgaggtaaagaaaatgtttagcagaatgcctgccagtagtaaatatcccctaaatgttagctattatcatcatttatgagacaccagttaataatttatgtaacacattagtttttctaggaaaagcatttcttatttaagaaacaaacagttcagactaaaacatgaaagttttctaaaaggttagtgaggggacctgggcttgggtatgtgagaagcagcctcccagcttctgtgctcagggcacactccacctgagagagatggattggcaggaaggcttatgtaattaactcaatgtcatccagaaagtcctattcacggaaacacccttcaatgatatgagggcaactcttctcagaaataatggccagtgctgaagatttccttgaaaacaaagtatccaaggcttatttgggtcagaacaggtaagaccagacatacctttcccattcaatggtactggttaccactcggccttaacatggttaacgtgcaggagagacctccttctagtcatgatttaagttgtgtatttaaatattttgagtgaattcttggaattatcagaacattatacagtagtttctagaaaaagtatcctatgttcatctaaataccttttattttcctcaagccccaactgtcacatacatagcaaagatacattatcctgctgtgtttttttagagacagggtttctctccgttgcccaggctggagtgcaatggtgtgatcatagcttactgcagccttgaactcctgggctcaagcgattctcctgcctcagcctcctgagtagttgaggctataggtgtcccaccacactcggctattttttaaattttttttgtagagatgggttccctctatgttgcccaggcttgtcttgaactcctggcttcaagcaattctcttgccttgacctcctaaagcactgggattacaggtgtgagccactgcaccaggcctattcctctactcaacgtaccattttagcaagtttctttctctcaccatctccttcacattttctttctctttcaactttaccatccattgcctttgagaataacacagagaaactcaatcaccaacacatgtaaaatccaatggatatggatagcaaagttggcaagctgaggaatgccataaaaattctgcttggagtttaatcaaggtaaagttcaatgaacgttgtccattcaaatgaaaggtacaaacaaaattgggaagcataaagtaaatttgaaaaagcataaagcaatattggtaagcataagcataaatctcaatgaacaaagtggttgcaagggctttttaaatttgcagggactccatttacctggcctcagctctcccagccaagctgaactcagctcgttttcaccaaacaagaatgacttatcctacactcactaattctttcccttctcaaaacctgtagtggcccctaaatgcttctcatatcacattaaaacacccaacatagaattcaagggtatttatccttggcttttgaagatactagttaagacatatagtgtattagtttgctagggctgctgtaacaaagcatcccttggcttgtagaagtatcattctgatatctgcctttatctttacatggtgttctccctgtgtgtccaagttcccccctttttataaggacatcagtcatattggatgaggacccacactaatgacacctcatttcaacttggttacctctataaagaccctatctccaaacaacatcatattctgaggtttaggggttaggattttaacacataaatttttggaggccacaattcaacccataacatacagtactatattgtcattattattatttggtggcatctgtggaactgtaagtataatgggaaggacacatgcttgtcgtcagacagacttcaattgaaattcagctctgccatttactctgagcttcctgactgcgtgagatagagataaaatccctataatgcagaatggtgtgaagactaaatggggaagcaacttctgtaaatatgtaaggacagacctttgcacattacacccaactggaatgacccatatcaggtttgaactttcttctaataaaccaaagcataacacaacataatcaaacttgtttgcctattccaaaaaggaaaacctgtaagataattcataaaaatctctcaaatctctctgtttaagactctgaacactctctcttcccataacgaaatgcgtttcttgttcattcatttatggctgttcacccaactctatagaaaccaatctaaatcaatctttcttatggcctcttttcatgtttgaattcatctggccatttgatcgcaagctcttggaatggaagaacaatgtattcaatgatataattaagtatttgaaatattttgatataatatgtgaaaatattttctgaagacagccttcatgttaagcaccttctctatgtaattcattgataattagggaactttgaagcatatctttgtttcccagactgttctttctcattgacctggtgtccactgtctactaccatatgcttgttgcctctgttatctttattctcaaaacctccttgcagaaaagacacagatgtgttttgcggattaagcaataaagtgctctggggctgctgggtactattaagcaggttgtagagtgcacagggtgtccccaaaacacaggagattttcatatttatcataattctttagcagatggttgtaggtctgttttaatataagtctgaatgttacaacaattttctactctgtataaggagtgttttatctaatttgcatagggcactgcatgggctggccttggccttgcagctgataaatctgatatgtaattccccccaagagattctcaggcaaggagatctaagccagaggaagggaactctgtgcattttctgacttcagcaatgtgagagattggtttggggagaatcttttgacaagtcctgtattaaggagtggcctcccctctcagtgttggagaaaactgtagtcaagcaggctctggggtgggtagtgaatctgccagcattgcacgctactcacaagagagatggaggagcaaagccatggaaaacgtactgccctggtgctactagataagatcagagacctgatcctcagggaattgacaacagtgtcttcttcactcatatcacagctgaatcatctagaagatcaactcaaactcatcaaaaggaaaccctcaataggagaaacaagagatatgtaatattttgcagacatctgtcacactgctatgtgataaatagcttggagtacctaatgcatgcagggcttaaaacctagatgatgggctgataggtacagcaaaccaccatggcacatgtatccctattaaacaaacctgcacgttctgctcatgtctcttaaaacttaaagtaacataaaaataaaccttagagtggtgcattttaatacttcaaaaggagagtttgttttttaatcatctaaatcatgtcaatacaaaatattaatagcaatctgaccaatgatgatggccaatgacatcagtatgaaccatatttttaaaaatgtaattagcataagaattagaggaaaatatgtctgtttttaacaaatgcatattctggttggagagcataaaaaatagcaaacaataaaacttcctaggtggcaaaattatgtgatatatcaacattgacatctttgcagaaagacttaaggggtgattgggagcatagccaagcagatggagactgtgtgaaagcagaaccaagtgggaaggcagctcaagctcaacaactcctgaagcatgggagggcacagcacccttcactgagaggcccgacagggtttaaacacttgacttaaacttagccaatcacaggcaccaggaaacagccagggtgagaatgctaggggaagtttataaagtggagctgggctgggaattggcatcacagataatggtggaaagcaatggagatgaaaaaagaaacacaaaatatttaagaaaggaggaaccttgtagaaataaagaaacagacacctatcacagagaccgaggccgctgctcggcagatgcatttccttttagagcacgccctggagccttgagacaacatgctctcgctcttcattttaggcagccctgatgaggttctgcttcttacaatcacagctatgtaacaaaagctataggaataccaggaagaggaagaggcaggccaagggaacagcgaagggcctgggacaggaagaggggtggaattttttgtggaaaagcgggggaatcaagctatggaggactatggcaggtagagtaggtccagggtcttcattgcacagattaagaatgactcattgaccctaagattaaaaaaaaaaaacaaaacataaaacagctgtcattataaagttggaggaaggccgggaggcagttgaaggcagggagaaaagagttctaagattctgtacatatagataggcaagaattcaaattgccaaagccaacttgagcattttgtggggggcattttatatgaggttttaaattttgttttcttctaatgtttagactgaagagaaattcccttcaataagaacaactttaacagattattaaaagggacagtgtgaaaccttcaataatatttagaaatatgtgtaggagagctaatttgattcattcatcacattttcaagtaactggtgcgggctccataacacagtacagactacataacacagtacaggcttttgtgtattaaaattaatgaaaaagtagggggtacttatgggtctcagtagttctcccaatttaaatacacttaaataactgtgaaaactggtcagtttacacataaaatcatgccaatttcaaacagaaaagttccattgatattgaccacatttttggctcctattaaattgctacataaatatataaagcaggtctgtaatactatatgtctgcaaaaagatatttttggcaaataaaactcattttattttctaatttcaatcttccttacccagtattcttaaatatataaaaattatgtttggttctaaatatccaaatacccccactcccacacacttttttccacattgcttttatccatccttttacagatttatgcataaaatagtttcagttaatgaggatcacaatttttaatctcccaaaatccagcttcccattgtcacccagagcaacatctgaagtttaaatgtaaaggatcagtgattatcatgagctgaatggtacccgctgcccccctaaaaaaaaagatatgcccatgactttacccctggagcctgagaatgggaccttatttggaagaaaggtcattgaggatgtaattgtgttaaggatctccagatgagatcatcctggattactggtgggccccaaatccaaagataagtgtcctttttagaggcagcaagagaacagatctggagagaagaggagaagtgagaaggagaagatgaccatgtggggatggaggcagcgactggagttagacagcctcaagtcaaggaatgtatgagccaccagaaggaagctgaaattggcaaggaaggattcttccctagatccttcagagggagcccagcctcattgcaggcagctggcctccagtgcagtgagaaaaatttctgtggtcttaaactaccaagtttgtggtaatttgttagagcagctctgggaaactaatacaatgattaaatggtatcgatttatttttaaatttgcatttcattaagtttgtggcccatataaaaatgctgattttttttcttgtgatattgtgatttaataagaaatatttatttgttctgtatccctgctccctggcacagagcttctgaagcttctgaacccttggaatttcctgagtgatacgaatgagggcagcagcttttgttattcacaataaacccctttctaactatacctgagttactctgatgaggtgactctttgtgggaccctagatagtttccggatgggacctggttgctagaggaaccaaccatgaaattagagggttgggaggtgaaaggggctagagattcaactgatcatcaatgaacaacgatttaatcaatcacgtctatgtaacagaacgtccacaaaaaatcctaaacgaaaacagggtttggaaagcttctgggatagtgaacgcattgaggttctggcaggttggtgctccggagagagcatagaaactccattcccctgctcctcacatcttgcctagaatcttttccatttggctgtttcaaacttgtatcatttatagtaaactaataatagtaagttaacacttttccctgagttctgtgagctgttctagcacattatccaaactgaggagcaggtcatgggcactctcagtttgtagcctgtcagtcctatgtgtgggaggcccagaacttgtggttggcacttgaaatgggggcagtctagtgagagtttgatgctaactcaaggtagttactgtcagaattgagtggaatcattggacatccacttggtgtctagagagttggagaactggtcatgggtgtgtgaaaaacccacacatttggtgtcaggagtgttctgtaggtagaaaccaatcatcatagttggtatcagaggtattatggagtaaaagtagcacaggttccttaacttaatttctaccataattaaaaaaaggatattgggttatctcaccctggtttcccagtcagggctccaacctgggctctcataataacttcctcctttcctttttgacttttgttagcttccattgcccatggagtcaagtttattaagctccctagaatggcaatgaagtcctcacttactttccaaacttatctttttctaaaccttctcttggacctactgtactactctaatctgcttgtggctgccaagcttgcctgtcatgatctctcgagattcagctcaagggatgagaccataaaatctcttctgcccttccagggggatgtcaccctgtcagcgtcatcaaggaagctttaaaattttgtgtcttcctaaattaataatctctgagtggttttagttaggatttaatccagagggttggattattggtggaaaagagggaaactgaaagtgcttaaaatgcctcagtgctaaagaagaaggactcggtgtatagttttagtgaagacaagcactgtgcactcacgcctactgatggtaccaaacacagatccagaaaaaccctaaaataggaccctgaggcctggtcttccagggatgaggaggagaagacaaagaggatggataacaagtggagaaagacaggatttggtaactgataaagaaaacttactttcctttagattgtagggaggggagagttacagataagagatagaggtcacaggtaataatttagtaacaaagtaaactgtaaggcaaagctctttggtagctgatagggtttggatgttctgttccctccaaacctcatgttgaaatgtgacctccaatgttggaggtgggcctagtgggaggtgttcgtgggcctggatccctcatcaatggcttggtgctgtcctcacgataatgagtgagttctcattctgagttcatatgggatccggttgtttaaaagagcctggcacttcctccttctctctcttgctttctctctcaccaagtgacatgcctgctcccccttcactttccatcttgattgtcaacctcctgaggccctcaccagaagcagatgccagcaccatgcttcctgtacagcccgcagaactgtaagccaaaataaacctcttttatttataaaatacccagcttcaggtattctttcacagcgatgcaaatggactaatacagtgacaatgcatcctgacttacttacctggccacatttttctgttaagaatttctagtgacttttgaggaacagaaacatttttttaaattgtggaagtaattagccagagttaacttttatgtcccaatgaagaaagattcccaagctccaggtggcacaccacttatctttgaatagctttgagaaaaagaaatcatgccacaaaaacaatgtgattcattgattgtacttcagacagcaaagaaagttctagggtatgatttagaaagtgagcctgcaaaaactctttttcaagacaaataatgtaaaactaggttcactaggattgaggcattcattttacaaagaagtaattatgagtaattaaaatgtcatgcaccaatgatgattagtgacaattggcattgccacagtattaaaaaatacagaaattaattgaattaaatttactttagccagcacctcataagagtaaagtaaatggcctgtggcagatatgcatggccacagggtgtagcaagtaatttcttataggttttactaaatgtatttagtctagtcaatgatgttttattgagttttgaaaattttggatgtctagtgtttaacacaagactcatggttcaagatgactatatttcatatccatgtgaaacgtactagattttcaggaaagtccatgtattgtaattctaagaactcaaggctggcaccagctttaacggcggatggtgcaaactgctttagttactgtggcccttcctgtcaccacctttgcaaagtgctgccatggagaatgtccccactttgggcacgtttcctgtgatgctccaagtcccatctcattccaccagtcccaaattcccttctgagtaaaaggtagtatagagggttagcatcatttaagtctatccttatgccatgaaacacattttactgatgtgtttaatcagtggggttcccataagctggtctgcagtcaggtggatgtgtgtgtgtgtgtgtgtgtgtgtgtgtaggtgagttttcaccagtcatacctgagccccttgactgccatgtgatgagccttggcccttgcccctcagctgggcagcccaggctctgtggctcctggtcttgcctacacacctgggtagcccacaccctactttctccaggcctacaaaccccagctatagtgtctcagcttccctacctcctcttagaatattctgaattgaatgaattaagagactggcttccaattttgctaacatacttacctgaaactacattttgatcatgactgggtagaaaatgaacatttgggctccctgtcctgttgaactgttgaaatacaggcctaaattgagcaacattaatcaagatcacaattatatgcaaaacaatattatgaaataaaactttgttatagtagtcccccttatctgcaggggatatattccaaaaccactagtggatgcctgaaacttcagacagtaccgagccctatatacattactgttttttcctatacatagatacatatatagctatgataaagcttaatttatgaagtaggcatagtaaaagattaacgataactaataattaaatagaacaattataacaatctatgcactataataaaagttatatgaatgtggtctctcatttatttctgaggtttttcatttaatatttttgaacctcagttgaccataggtaactgaaacagtgaaaagtgaaactaggtaagcgaggactactgttttctttaattgtaaaagcagaaaaatgatatctttttatacttgtgttatatcagggaaaatttgtccattgtctttcttgcaaataactatgctttcctcttgacttttgggatattcaggtcttttctttcactaagtgatgttactagcagatggccctgctgtcttccgctctttagccatcatttttacccctagattacagaatgaacttccaacttttcctccgtctatcagttctcgaccagcattaaatgaatagttagatgtgtgatgagattagtgtttcactcccttgcctctcttccaatctcaggcttcccactaaacttagaactagacctaaactctctagtgtagccaataaggccaaatacaacctggcccctcctatagggttacatctcattattcacagtagttatgtttcataatgtcattgccaacattgaattagcaaatcctgaaccattgctccttggaaaaatactgagttacgtttctctgagcctagggtcacaacatttttgtcaactgatcaatacataaccttgttttgtgtgtgtttctgtttaaagacactttatttagcatagaaagttcatttattaactttggactcctggtcaacagcactataacttatacttgaacaaagcttatctaatacacatactttctacataaggcacatcacagccttcgtgcacttatgaacaccagacagcacttcggcactactcttcggggccattttaaacagtgacatcaaccaaaagcacaaaaatgtgaaaaatgcagtactaagcagacctcaaaaaggacacttgtgtatagtaagcaagtgaaaccagaaggcggggcattgtcttgttcaatctcaactggggacatgtgcatggggagacttcaaattttttgccagtctaagtctgcaagtgatagtgaaagcactgtgatgattgattttggggttataagtgaatttcagtgagtagcaaattcataaataaagagtaaagtttttctgactttatcttctacaaatatcctttgtgtttgctacactccagctatactggcctctatgcttctagtccatgtccagctcacttctgcctcagaggctttgcacttgctgttccccttgcctgggttataccctgcacaaaccccaatctaatccccagcatctatgacagagccagatgccgtaggcactcaatacatagttggtgaatgaatggcaattgttttcttaagatgtcatttcttgacaaaatagaaaacacaggcaactcttcgacagtactcaaaattcaggggaataatttacaggtctgtataatccccgaattgaagatccattgcttgtaaaaagcactctctacaaagctgcagcccatcatcttttcccatcatgttgggattttatttagtcacacagcctaacatgtcatcaataagtcaacagcagtgtctcacattggaagcatccctggaacagttagaagaagagaggctttaggcagttttacctgagtattgatacagattgctatcctcttaactacccgaataaagacactttcctttcatttaactaagttgatttgtactaacagaaagaatcattttgatgagttttggggagtgcttttggagaaagataaatgtaagaaaagttatgcagaagtaggctgcagggggctgctctggagaactggaattcagcctgagtctctgaactgcagtaggtgagaagagacgtgaaatataacacaggagaatagagagggcaaagggaagggcttcagaaaaagaatcctccccctttttacagttttgcccaaggctggacctgcctcattcattcttgatgtggcatcaatttgttaaaaacaaaccaacaaaaaacttccaggaaggaaggaagggagggagggagggagggagggagggaaaataacaactgaaaaacagttaggaaaaagagtttaataatttatcagataaataaaagatcaaagttgggaatctgtctggggtaggaatgcaggtatagctttctgctgagtaaattcagttctctcacagactcagccagacactgtctatactgtcccattcccagaaaacactgactttggccacagtttagctccccttacagcaaagcagcaaagtctatattcaagccccaccttgcccttccttccaggggacctgcattattcctatcaaacccaaactgttctctctgtggctggggacagccttcactggttagcacagtttttaatatgaatccaaccttctcacttctcttttgagctttcttgtgtctcagctctagcatggagagcacttacagaatatccccctaaatgggaacatctggtttgccaaagaggtgacctcatacatgagcctcttgaaagcccatgagcctgagtcttgtaatggggaatgtttatccgccaggtatgaaagatgaaatgagggctccaggaatttcgtcttaacttgcaagggaggaggatcttttgttcaggtgctgaacagtgaagattttcaagttttcttaggaacacaaaagtgtttgctgtcaggagaactatgttgttttccttgagggcttctctgtacacaatggaagcagagaaaccaaactaatcctggtccctcctgttggcttctttcaaaattttgagttgtttccagtccaaaccagactggcccaggcttccgtttaaaaataatccacttaccacagcattcaaagcaatttggcaagcctaggaagaagtgtgacaggaggacgggtgggttggttgcgggaggcaaggcaaggaatccatttttgtgtaccctctccacgtggtgcaggcgctgtgccggccacttaacacgctgagcccagggcctattgagaagagtccagtgctgtgaatgagcatccctcaggctcccaagctggctggtttgaaatctgtgtctcccttgactatcatgagcaaagataccaagtaagtgccatctctgacagggcaaagctgagaaaacattacaacaaaaacacgatcattccttaaacttcaaatcatagaaaaaaatgaagagaaattctggtgttcagctatcagtaaacaaacatcttgtaaatatttacgagtgggcttgatattataagttgttgtttaggaaggaggtcgataaaggggaccaaggttagccagcagtagaacagataggaaagtctcacgatcctaggtgccctttgacttagggtgcctacactaaaaggaacacaaagacaggccatatgcccatcttttccccatcctagactttgtgatctggtccacagccctcatttcacaactgaaaaatcagagggtcctgagaacttcagtggtttccctggaatagtgcagtccattggggagccaggacctgggtctggtcttctaatgtatttttctttctccttcccactgctgatttgggggcaaaccatctgattgaaggcatgatgatgatgaggagaggcacagaagccttgagctctcctctgtcctcaaggcgtgtggcacagcttgtgctaaaatggaacagtggacctaatactactgcttgtataatggatttttgcatggcataacttttgcattcactttgtgtgcagcatatatgttttttcaactctctccgaatgttgttccatagtatacttatatggtccctgagaccgaaataattgctcctctccaagactataaaatcctcaaggccaagacctaccccctctacattgctgactcacccccatcccaaaaatgtaaagcaatccgcaaatatttagttaatgcttgaagaactgactgcagttggcatcatgctggtgacttggggacacagaaaggccctgttatttaatttagagggtgaaagatgatattatttgttcacaattctcctttccctcctactcctgctggtgggaaaagtctataccacctcccagctatgctgactgtagggtttgccatgggactgtcactgaacacagaaacatgagcagaagtaatggtgtgccagccactggcagagcctttctgctgcccctcttgtggccctgcctccaccttgagaacctcgtgcccctgaacagtagtggggctgccactggagtctgggcactgggacaagaagatcagagaagcagaccccagcccatcctgaagcctggagtcaagcccagccacacacagcagggacccagtggagccacagctgacacacaggactatgaatgaggaataaatgttgaatactgtaagccacttaattttttcctgggttgttaccacagtaaaagctaatatatggaatctctcttaaaagcacatttgccatagagctgaagtgctgtgaaccaatttggtcacacaaaatatttagattctttttggcagatactgaagcagtttgaccttgctactgagttataatgaaagcaatcctcagaccagatttccctacacatatgtgaacatttattaaataaatatgtgttaatgcaggcataaaaatggaccttactacctgctgtcccagctcaggaaagtcccagctctctgtccctttagtgtctcacccaccatctttactgaaaggtttcctagaagcagacgctaaacatctcagaggcaggattgtaccctttttgtaggcattgggcaattaaaactctttgtagcaatgcctggacaacagacttataggaatcaagattcaggtgacatccctaaaggagtaagccacgggtcttgctggattcttaagccctgttcaggaaaccatggtgaatatctctagcatgtagacagcagagatacaagttgagaccagttacagaccttgtcatggagaagtttacagagttgagcaggggcttttggagccaaggttagggttcgtcatgggctttagttgtctgagaacaccctaaaaatcaagggatgtgtgtgcatgtgtatgcaatgttgtaggaaaaggtctacattgttcatcagatttctaaaggagcccatgacttaaaaagggcaaagaaatgctttcccatgggatctgtaagagatgactctataacaaatgcatttactcagactttgctatgaaggatcaaactattgactatataagaatagacttctagccaaatgaccaaaaaaggttcttacacataataactatggtagttaagaggttattttaaaaatgtcctaacagaactaatgactaataaaaatggtactagacatgttccaatgaaggaaactccatgctgcaccattataaaagtcaatcatagactcagcaaagcaaaggctcaaggttgctttgatatgcaacaatgcccacagggtaatagtagcaactcccaagtctcattttaatcacgatttgcctctccgtgccaagtatgaagtagaatgggaagaatttacagccatgatttaaccatctactacacattgctggttccgttacttagaatagacatcacacgtaagataataaacatacaggtagcagggacatttccccctcaaactgtccaagactgttcaacaaagagcatagctgatgtcaatgaaattcatggcccaagaagtcatgtgttattcatcacgcggttttcatagcccctgctacatccctacacatcccagtttaagaagcacaggcttcacttctctgaggtttagtttcctccatatactaaatgggaataatcatacttacatcaaagggttcttaggaaaattaattgtcatgtattggttcaatcctataacatagctatgctgcctagtacctagcaggtactcaacaaatattaaaacctacctccattcccacttgctatgcagctctgtgcttctcagagtggtctccagagctgcagcatcgcagggagcttcttagaaatgcaaattctcaggcccaccctagacttacagcttcagaaattcagggggtgaagtccaatgaagtatgttttaataagtcttctgcgtgattctgatacatcctaaatttaaaaccactgatgtagataaatcattcttaaccatggctgtacattaaaatcatgttagatgcttttaaaaactactgatacttaaactctctaaccaccccaagactacaacagaatctctatggggtgagggactgggagcattggtcattatcaacagttccccagggatttaaataattgaatttaaagggccaagggaagtccacttctctcctcttggcagtctgcactggatgcttgaaatccaatcaatattgagtctcttctgaactcagacctgccacaccagtaactagctgtggggccttggaaaagtttcctatacttctgttagccttgttttgtcacttataaaatgaggatcataatgatccatcttgcatcttcttattttccaatgggaacgctgaattccaaagtttttgttccttgcccatgtcacatatagcagtagtagcagaccagggcccagcctttgccatgtcctcttctgcagagagtcatgtgtatgggtgtgggacagagaaacatctggagccctggtgtgggcgttggtaaactttataatatttttggcataagtatcggaagggagggcttccagctaatgactggagaatgtgccactaagaaaggtgagtgaaggacttgcaggactcagtggaagctgtgtgggatgaggagaaggatctgcagcaggacaaggaatcaccgatgagcgtacacaaggataaatacaccattcattttccactggggctggtggaggggcaggcagctttggttaggatacgtggagactttgagatttcagagtaaaattgggaacagggcttggaaaagctagcagcagcatgaaactgaacggaaaacagggagggtgcggatatctttgtgtactctgctctgattgggagggagaaaggggagacccagggatgatttagccatttctcttgcttgggaagggtggcataagcccaacaattcacaagcccaacagtgtggaaatgcagaaaggaagtatttagctctagcaaaattcgactttgggtttattgaatctattatctttatttttcttctccttcccatgatccctccccatgatgtacacacacttaagaatcaccatgtctgctaggtgagaatgattactgtcatctgagaagaggcttcaaactaagcttcactgttcctccctctaactcctgttcatctgcatatcagggataaaatgaaggggaggaggcagctagctctgccctgcagccccctgatggtcacagtagtcactgctttggagtgaatgcctacgtactccccggattttatatgttgaaattctagcccccatggtgatgttattgggaggtggggcctttgggaggtgattagctcgcgaggatagagccctcatgaatgggtttagtgtccttatagaaagggaccgcagagagccctctctttttctgccatgcggggataatgaaagcagccatctgcaacctcgaagaggtccttaccagaacctgaccgtgctggccctgatcttggacttccagactccaaaactgtgagaaataagtttgcatttttataagctacccagtgtatggtactttattacagcagcccagaataagacagtcaccatgtgcagtgtgggtgcgaggctctgccccacattttctttcctgattctgaatttcttattctgaccttggccttcagactcacaaggctcaggtctctcattaatgtgctgagatgactcttcccaccttctgccattcactattgaccaggaatgacctctactgtggtgactttgaaggcaacaagacaaaatcaattaactggacaaaagtgaagaccttaactttttcctgtaattattataaaccagaaggaactctagaagtatgatttttatcccaagcattctaaaactttattggcaacttttaaatcagtatcacagaggctttaaagccatttacactagaaaactggcttttatgtcaaatatttatttaaaaaacctctgtagttgtaatcctcaaactatgactcactttatctaaagaaacatttgagatttcaaaattctggcacaaacaaataaatatcttgggtacctaccaccttgaagtgtactacaatggtttaccttctgcagggagggaggaaggagagggagctgagaaaaaatttgaagaaagcaaatatgagagtcctgtgagcccagaaggcatatcatgggccaaagcctgcaggtctggcctgcctggagcaaacatgcagagcccaccaagttcaagtagaagctgagctcagcatgtgggtggggaggcacagtgggaagagacagtgcaagtgtcagagcacaggcccaagccaggcacacagctataggcacatggggactagtatgcaaactggaagactggaaaaggatccaggaaggaagtattaggagaggtcaatcttctagcaacattgtaaatggcttctttagcttcagctgttaggacccagaggcatgggctggtcccctaaatctagccagattgtaatgcacacagattgcaaacagaagtagtgagctaggctaatgctagccctcaaatgtgttgtgattggcctgtacagagtttaaaaggaatgaactgataagatcagtgtatcatatcagtgtcaatgtcctagtggtgatatactatagttatatgtgatgttatcattaggggaaggagggaagggtgcctggcatctttctgtattatttctcacaactgcatgcaaatctacaatgatctcaaaaccaggtaaaaaaaaaaaatttaatgagctaaactttataaatcagaagatgtcacattttttaaaaaacctcattttccagcttctcttgagaagttggaagatccggcaacaccaggcccaccctgtgttcccacaataacatgttctcccgtaacaatcagaagaagcagagaagcatctgatgccttcagacaggcattacaatcttcattttgcccccttctccatccagcctgcttcactatttatgttatttgtctggtcccaatggacattagatttttctgtttttctatatagagggacggagttaaagacttggccgtccaagaggtcatctgagttcacacaatttgtctggagttgaacactacatcatgaataagaacacaaggacatctcactatcctggtgcccttggggccttgcacataataggtatcattatagtattctcctacagtagaagaaccacttaggatgggttccaagaaaaatcaatgacatactaaatgtcacgccacagcaatttctgtcataactcaggagccacataaaatacagtgagttcttaaagtcataaatactctgaaattatttatgaaacaggtattaggtaaggtccaatataccaaaattggaaatacctagacacaaggtttaactggaactctccatatatgtgtgctctatgattccaagacaaggtgccattccaaatggagtctgtcttttcgttttctgaggttaaaacattttccacattagaaacctgtcccctttggtttccacatggtaaattactctagtggaatcatttaccctaaaggcaatgcagtgttcccattatcactaagcagcaaagggcaaaatagccaatgggacggagacagggaggataaattcaggtcattcttgttgcaccaaaaaaaagcaactcacattactcaaaaaaaagcattatattgactcacagatttagatacatctctgtagttatgaaatgatactttttacaacctttagtctgctcaatatatggtccaacctccttacaccacctctcactatgcacattcttacacatcatactcaggagttggcatttttcctggttaggccattctaatagtggtgctttctctgaattttactatgaaaattagattttcctcccaaggagtctatgaagggtggaatattatagcacacaaactaataatacggagaaagcatggtatttttacgtattccttaacacatgagttaacttatcaggagagttaaattacatttaaaattcaggggcagatgtaggtcctggctaatggtcccttcagtggcctgagataaggattcactgacagggttctctcaatcccgccctagtgttgaactttgacctgcaatatgctcactctatgcttagctgttttacaaattggtaaatacacaggccaagcggctgctgtccattatgtctcagattgattcagtttggttactcaggttagctcaaccccattgcccccgctgatgctgcctcagttcacactggccgaaatggacttattcatgttgccatttgtaccatgtcatggccaaagaaattatatcctggaaattccttgcaaaatgcctgcagtctgagatttggctgttgccagtggccactaatctgaccacagtcatgcatctggaaaattaaattattaatgtgagatacttactctactgtattgaaagtaatggctgtgacatccaagccaaatcatttcatatgaaacacggaactggtttgctctgtgtggggcatcagctggactctgctataaggcatctggtgacgccatgagtcctctccaagttttctgctgcaagcctgtgatagccagctggcagagcagctgcaggcccaggtcactttgggagccagctgaccatactcccttagataatacatgtataggtcaaaggaggctctggctctcactttgaacaagtgtgtttggtcaccaggggttccactgaccactgggctgcagaacgtgcaaataatttgcagcttccttaattaagctaaactccaatccccaacatagagcttgacctcaaagtgctatttttatttcttattcaaatgcactgttgcaaccacacatcccctatctgtatcaaagtctctctttgtgaggcttttgaaaacaactattttctctttccattttttgaaatgatacatttattttgaatagctgtagagttacagatatatggacagagatcaaatgcggttttgattcccagagatgagtttatctgagcaaaagtaaaacacattgtgagtggtagatcataaacaacttgtttggattttggtgaaataagtgtgttagaccagtagtcacatggaataaaatatttctgatgttcatttagtgatgtttctctttgttactgagatatgtcaagtttctgtttggctctgataaacgtcaggtctctcctacctcttcatagtttggcagcttattatacattaaacaaatatctagaaaacacctcctctatgccaggcgctctgtggagctctgggtgtaatcagcactaagatagatgaagacctttccttcagagaataaaactagtggaaattccactctagtcatcctttcctagcaaaaacatgtgtcccgttttccagattccaagagatgggaaatttcccacatgggcttaatagagataccctttggatttgttttttagaaatcatttatcaatgtatagggatgaaaatgacatttttctggaacaactttttcacattcagaaaactaccttcatgatttctgagaacctgacagccataaaagagaaaaaatgctgtttctctgtgctctttgtaaaaaggatcacagcaaatggaaacttcaggcttcttggaaaggctctagttctgaaagattagggtttacactctactgttaaactagactttcagagatgagggctaatgctcaacttggcattggaaataatctgctttggcattatgcaaaaaaaaaaaaaagttaggttcacattgtactgaaatagccaccacctgtggaatttttagaggctgtttttgtttttatcatgtcaaagcatttctactcagctcagactcaccattccgagcttaggatgagaggcagctcatgcccctggaccaaatgagtttatcctggagaaaactctagttccaaagcaacatgcaacttcctcgaggtttggaaaaagaggcttccaagtgtagcatctttttattttataaaactcctttccctgccaaacatttggtcttgcacgcatctgagggtggggcaatgcttagaatgagagtgagaaacacaagatttagtaaaagcgttgccagatactctgcttttgaaatgttgcttaaaataaaaaaacacttttctccttactctttgatatgaataatgaaaatatctttcttttttgccctggaaagtatgttaaaaaaaaaaaaaaaaggcagtgttttgtttgtttctttcttttaaggaccacaggcaactcttccatttgactcatttggctatttttgattattggcccccgacacgtggaacattgttcagatcagtcctagagggcccagaatggccagctctctcagtatctcatttttggcaattcaaagcgcaatttcccattaaccccgattgcctccttcacacccctggaagacatgcacttctctcctactaggtgagcccacagcactcctaaagactgcgcagcctggaatcgaccccaggcccactttcccaggtttattttgcgagcacagtgggtcagtctggcaagtgaccgtgaactgccagagcagtggcaggtgtccttcccagcagagagctgtcgaggtgcacaatgtgggaaatatgctaatccaaggggttgggatgggagccccaggctttgttacctctcagttgagaggcctcagtgagcttttgacaagatggagctattgtcctcctgggcctccaacaggatgattcagaggagaaccacagtgtagatcaaaggatggaacaacaggacctgggagcaaaggctaaatagccctggtattattttgcctggagaagagaaggctggaggtggggtgggtcaagtaggccataatggtgaaaaagctattatgtcgtgaatgtgaccagctgtccgacattttgagtgagaagaaaaggcgtaggagaaaatgaatgtaaactgcaatgtgagaaatttggttgacataaggaaaacatttcaaacagggagcgttgttagacgctaaagttagtgacagagggaatacgtttcttagatgaactttaaagctgtgatttttcagtcaagaggtttgaaggcaaacttgctcggatgtagggagtcaataggaaaaaatgttgagacccacttcacttaaatatgtgcaacatatgatttaagcctttgcaaactgctctttacaacggatattttctcagaggctagcatcagaagctgctacacaggacttctttgaccttgctttaatgatttacttagctgagacaggaattgtctttgtggctaagtgattgacaagtaccttgggtgatgggcattctgattccagttctgcagctaaacaactctgagacttccaacaagcacagaacctcaatttccttaactgtcaaacagagacaatagctctgttctacctcataggatggcttggaggaacaaattataaaaggaataaaaagcacactgtacccaagtatgtagtaattagactgttcagacctcagggctactcccaaatacaaaagtgcttggctctcttagcattgttttaaaaagttactccccaaccagactaggagtgagaaaagagaaggatcaggggacaaacggaggattcaagaacagagttcaagatggtatgggggctgttattttattcttgcctctcccaggtctacagcccaacatcaagcaaaactgggtggtatataccagtgcaaggcaaacacccagttctttgattaaactgtgacctctgcagtttgggtcatttcaattggaaacgtttctccatgaaatcttcaaataacagaactagaaaactccattgccgttagtgtttctaataggtcagtcttaaagaacttttgaaataaacaaataaataaacctcagtgtttcaacacagtgataaagtgatggaattttttacccttagtgtgggttcagaccgagggcatattgagtcacaatgaaagaaaaaaagccttctacagagaaaattcttttaaaaatgaaggcaaactcaaaagaccttttcagataaaggctgagaggttgtgtcccaagcagatttgcactacaagacatgtaaaggaggctgtttagagcacgcctgcttcttaaggttgtagtcagttggaactctgttcttctgtccctaatgcttctgtgctgctgcaatcagagacggaaccctcaactgtggcagtcatgccactctagaatgttcaaggtaaaaaggaccatgtgagcacattttaccaaattcctttattttccaaataagaaatagatggtccaagaaatagaaacaaagagtaatggaattagtagggagacaatattggaatttgtccccaaatcttgtggttgcccagtgatatgatttatcccactggaaaggccacagactgatctctaatggggtaaatatggttcacaggcatatttcatttggcccacaaagtggattttttaaaataattttaaatttgttatcttgaaaaactagaagacatggttaggtgagccatgtacctacatggaacataattataagtacatgagcctacagctggagttccaatgtttccttccctttttagatgaaaagtactcttttgtttgccacattcattaccactccctaacgtctccctgatgatgaagccataggtgatttagaacgtatctccatactcacacagatgctctcttaaccatccatttcactcatttgtatgattttcctgggctatttacacatttaattttgcaaacccttccctaccacatgctgcttctattttcctactcagcaaaatcattcacaattattcctgcaaagaacaaagaaacaaaaaaacataatgaccacatgcatatatgacatacctctgatcctgtagtgataatgtgtatagccctggagacatacacgcattcacaaagcagttcaagagactggtttattttactcacttttgcataagactctaaacattgctgaagacccacttttgtattccagtattctgaaggaaagtgatgaccatgttgacatttctgtccatttctgctgagtaaaagggggcctcccctcatactctctactgtgttttctaatatcttttagggaagatggggtaagagaatctattagttttaagacactattaaaaagatagacacatttgtccacccaaaaatgtgtacatgaattttatagtagcattatttataatagccaaaatgtagaaacctagatttccatcaatgataaaagaagtattctatacttgtacaatggggtattatttggcaattaaaaaatgaagcactgatgtatactacagcatggagaaatcctgaaaatattatggtaagtgaaagaaacgagttgcaagccactacatattgtacaatccatttatacgaaatgtccagaataggcaaattccaaacagccagattattgccagctaggctagggctgggacattgggaggacatgagaaataactgatactggttatgaggtttcttttttcagtgatgaaaacaacctaaactggattgtggtgatgggtgcacaactctgagaatagtacactttaatgggtggaaagtatgtatgtaaattatatctcaataaaaatgttacttcaaaaagataaaataggataaggcttttgaaatcaggaaaagggaaataatatttttgggtgagctgctacgggccaggtagagtctgatgtgtttttttatatattttattcaagcctcacagcaaaccgccaggaggttttattctgtccatttcacagatgaagaaataaaggctcacagagattaggctgccttacctcgtcacttgcgaagctgagttctgaaccagatttgactctcaaacagcctgcctcgccccactgctgctcagcagtcacgcagcgttttctccttctctaaagacaaggaactaatagagacttgcctccactggttcttattgcctcatgtgactatttaatgatgagcaggataccaactcttctttcctaaagagctaccctgagccatgccagctgactaaacagtctttctaaagtcaaatggggcctttttttctcaaggtgacatgagtgcttttctaaatgcagagctagactcgcctaaaacaattctctgtctgctgtctgttggcattttctcatttacccaatatcctccttgaactcacctctgcttgctccctcattccacattacagctaaaaacattgtctaatgcagttttccctccctaccccacccctgcctatataaagcagcatccaggtagcagtgaacatgtttacgcctcctaattcttttgttacacatgtctctaatcattaacatcgaatagtgcttacaaattaattcatatgtacaaattcctcacctgagcattcaaaatgcatgaatcagcatccagccccaatcactttaagaggttacattaaagcacagatcattagggagcatggataaggtgaggagaagggagagagattcaaatagaattcatgttccttgccttaaatgaggatcagtctgagctatatacaagtgggcagccagcagagagcgtctgggatacaagccatctccaagccacaggcacagcctgcgtttactcacatcacaatccattatcttcccagccaggatccaaatcttacctctactgaagcaagagccaaccagtgacctcagctgggtcatcaggaccactgtagccacttccagcctcagctctctgatctgacagcctcagtcagcccttactttcctctttctgaacagggccagtgtgcttcctcctgtctgtcaatatttaactacgctgtcaagtcacattacatcacctgcactaaatcccacccagtgatagctagagggtgtgcctgctctattcaattcaactcagctaacctttatctagtgccttccactcattcatttctttccacatgtactcagcacctactgcatttggcattggggatagagaactgaaagatccactccccagattctagtggaggaaacagacaaaataatgtggtatgtgctattgtgctagagcacagagtgcaggggacactcccattccaggctggctggggaggtatggagcaaacaaagccagagaattcccaaagatggcaacacttagagtgacatctctaatggaccaggctatatcaggaagacaaaaggatgatgcatacatggcctctgtcctcaaggagcttactcccagcacaggttgctctatgttcctacagatgaacaggattgcttacataaatgccacggcaaagtgcagaatattaaatcaaagagggcagccctttcttgttgttgttgtttttttgttttttggtaagttgtgtcctgaacaaagatgtctcaacagtgaaagctggctgtatcctatagatcccttggtgctacaaatcgagggggattcttccaagagccgagagagcagataaacccagtgaataaaggaagtgtctgtgacccattttcaggaccaagaaaagaagaattcaggtcacagagtaacatttttctctggtcaaaggaattaatctggtacaaacaggcttggccaaaggtaaacagggatctctcacatgccctcctaatctctctatgacttttctaaggcaacatttcctgacacttaatgaagtgttgatggctcttttaaataatagagatagatatgcagaaccacttggcatcactaaaactgcagcctttaacttcgtctgtgatcagaagcctcaaaagctattcactttgggattttttttaaggttgaatttaccaccaaagcatggctctcaaatgtacccatgcaatcccttttctaccaaaacttactgcagtttcatgcaccagagaacaaagacccccatttatgtgtgaacattcaaaggaccccaccaccgggaagcctaagaggctgccacggaaagtcccggtatatttgaattgcaaaacacagcctggggatctcaatacatctaatttgggacatgttccaagctcaggagcctctctgcatggaagcagctttattagtcactttctcagacaattttctagttccacatgcacacttccccaagtgtttccaagacgaacatttacagtctgttgcaatattttactacaaggtatttagggttttgacaaatactaactgacattgccaccattccagtgaaaactgatgacccatagctaatgcctgcttcttggttgtggctcaagaccgttttgagccagtcagtgattgtaagcagaatgacactccagacctctccttcacatcctggaagcacagtttgatttcagcccattaatacattcgcattgaatgttgaatcgtcatgaaactgaagtgaagtgaagctgcacctcagtcaagcctgttctttttttttaaaccaagacttattcagaaccctttttgcttactaacatataacacacttggcattaggaatattatatgttattaattggggaattgttactactaattgccaaatgcccagggacttctggatccaattagaatggatgtttgacatttatcttgcaatcccactagaaggacaaggtgctatgtgacctttagttggtttttaaaggcagttttagtaaattttagcccacatgaagtaaatttttcaaataatattatgcatgtcgtgactggtgagataactatcagctcatggaaaataactagcaaatacaactaacatttccagaagtaaaccataagaaacttcaactttcaaaagagaatatttaaaatgaattctatttatctcttgtgtactcagctttacaaaatacaagaaagggaaggtttttgtttgtttgcattttgttttcaataagaagtcttaaagagaagttctaaagcaagactaatttctccaaatccaattgaataatattcatccaagttagaaagcaactggtattgtgcactcatcatggcagaaaagtatagatagagaacttgaagccacagttaatttaatgtgaccctgggcaagtcaatcccataattagggtctaaacctgctctactgaaactaaagtgatggattgtttaaggtacacaccaaaactcataggtgtcagggagtactgtgccttttaaacccatagttatagggttaagaccctataacttgtccagggtcacaaaagagtccttctcaggctgctgttaatgctctcaattttctcaggcctcagaggtttcccaatcagtgtgactgtcagtgccaacaccagaaaagtccctggccgaccaagatggccacccaacttgctactactcagataatgtcggaacaccatcttggaagtgatttcatattatatgataaataattacgcatcttgtctgagccagcaagttctgattctttaaaattcagttgactttttgaaatagctatcatttgtagccaggcttaatagatgagttttcaaggtgagtaaaaattgtgatgtgaaaaataaaatgttttcattaagtatagagatttgactttttgtgtggggttcagaaactaaacccaaaacaaaaatgtaaaaacctagaaggattttacttgctactttgccttgctactcatggtgtggtctgtagggctagcaatgtagcctcattaggaacgtgttagaagtagacgaacctggttgccctaaatctcctgaatcagaatctgcatttctacaaaatccctagtggttctgaggcacgtgacagtttgaggagtcctgttttagaatttgtttaagcctaggggaagggcaaaccagcctccataaaaacacttgatacagtcataaataaaaaacagtcttgcaattcaaagcattttgacaaaaaaaatgaaaggcattgttgtaattgatgttttctgggccttgtgaattttaacttcagagctgagaaggccataaaatatagttaaactctaaatgaggccaatgattaaatggttttcctacaagggagccttgttggatgccagggcccacttcaaagagtggagcagtcagtctgcgggaattcccctctatgcacagttagtcaccaacctctgttccaaacatctccctggttaggggatcaaacccagggtgttgcctaggttttaatggtttacatctgaaacattatcgcacaggtgaagaatggggatagagggaatttctaacatacagattgagaggactattttgactgtgagatttgagaagtctaataaacacctatgtggagaagaaactggtatttgaacataggagtctgaggcagagccagtcagaaaacagtatgtacgtgaaacatccttggaaagtaatcaggggggtagtcagcttatggattatatcagaaaatgagggaataaaagattacaattatagggagagcatttcaggcctagataacactggaaacagatgccctgtggcaaaagggaaaaagagggcagagcaaaagaaagataaaaagaagtgacaagcaaaaattactagatgataaagtgaaatcaaaatgaatgacaataacatatagagaactgcaatagtatgaaggttaaaaagttttccttcctaaaacagaagatgcatattattgtgggaaatacaaaaagagtctgaaaccaaattctaaatatttcaaatggggagtcagaagaggactgagcacagagtttgtatttgcatgtaaatggatatttggtatgctaaacagaaaatgcacagtcttcttttatgcttatgggataaaaattcacagaaaataattatgcatgtggccacaaagaaaacactgaaaattccctgaagtgaacgaggaaaaggcaaaaaacacaaaaactctcaagtgcctttaaattaaaaaacagtcttctaaccaaaccaaggatagaaaatgcaggccaggcacggtggctcatgcctgtaatcccagcactttgggaggccaaggcgggaggatcacgaggtcaggagttcaagaccagcctggccaacatggtgaaaccccatctccactaaaaatacaaaaattagctggacgtggtggtgcgtgcctgtaatcccagctacttgggaggctgaggcaggagaatagcttgaacccaggaggcggaggttgtggtgaggcgaagtcacaccattacactccagcctgggcaacggagccaaacttcatctcaaaaaaaaaagttcaagttatttagacataaatacaacaatggagaacacctcatatcaaaactgtgatgcagtaaaatccagaggaaaatatatagccttaaatgcttttatttaaaaaaaaaagatagaaaataaatgcattacacattcagccttcttaaagtcttccaaaaaaaaaaaaaaaaagacatagaggggctatttccaaatttattttaagaagccagcatcatctaataccaaaatcagatacagacactataagaaaactgcaggctaatatctctgatgaacatggatgtaataatcctcaacaaagtattagccaaataattcaacaacacatcaaaaagattataccttgtgaccaagcaggatttatcccagggatgcaaaaatggttctaacgatcataccttattcaagtatggaaattcaaataaagtatgatctttagttaataagagtgtatcattaattgtgaccagtgtaccatactaatgtaagatgttaataataggagaaactagatgagaggtatatgggaactctgtactatctttccattttttttctgtaaatctcaagctgttctaaaaccacacaaaagtctattttaaatttttaaaataagtagataatttctgatggtgatatacagaacataaagtagtgtaatgcagtacaatgttctgggattgggagggtagccaggaaaggcggtcagcaaattttccctgcagcatttgagctgagagtttttcataatgcagtagggagagccatgcaaaaatctcagggaagatattctagcacaggcacaacatcaaaacacaaaagcaacaaagaatcaattaaactgaaagctggttatttgaaaagacaaataaaacaggtaactctctgtcattctgattaaggagcaaacataaaagcatacaacataaagactaagataacagacataaatgagtaggaagacaatttgaaaaatgataagactatgtgagtgacactgcatttgaaaatgggtattttttaagcaaaacattaatgactgaaattaatacaagaagtatgagacagaagtacacaaaagaaggtaaggtaataaaactgtcactaaaatgttatagttttaaaataggcaaatatagcatgacagtctgattttatttaaattttaagaaatagataattcccatataatttaatttgtcccagaaaagagcaaaatataaacattttcataattaactttactgagccagcagatccttagcacagataaagaaactctgataaaactagcacagaaaaagaaattctaatttcagttgtaaaattaaatagaaacattttaaatagaatgttagcaaattgtattcagccttgtaagaaaatcacaatgcaatgtgagaaaatcacatatgatatgaccgagcacagtttattttagtgatataaaaatatgttagcattaaaaaatctatcaattaaatttcttatattaatacatcaagatcactggaaataagatacatataaaaggttatcatgcttatttatactatatagtaacagaaaagaaaattaaaagcaaaatcctgaaattctgatgcatctaggaataaattttacccagatagttcaaagaagacctatatgaggaaaatgtttaaaacttgcatatgaattaacagtagaaataaatgtatatttggatacaggtattatcataaaagtgatgattgttcccaaagtaatacataagtgatataattctaataagaattacaacaggattatttttgaaagaacgggcactaggcaaaagtcactctacagttcatgtggaagaataactattcaagaatattcacaaacctttaaggaagctttgtcctacaagatattaaaacacactttgaaatactatcaccaaaacagtagctaattgctactagtgcagggaaaataaatcactggcacagaataagaagtctagaaccatgtccagaaacagtgccagaaacttaattatgataatattaataaaattttgataaaactaatatttcagatgagtaagaaaatcatgttaatcagtaagttacattattcggtaaattatatgagggtatttgctttgtaggtggaagaacatttcattagaaccctattttacacaatgtgcaaaacccattcttgagggatttaagttagaagtgcaaaacaaaaccctgaaaagcaagagcattgtgaaacaatatattaaattacttttataaactcggagtaaaagagataagatattcaactcagaagccataaagggaaaaatagacataatttacataactcatcacgtgtttacacaaagatactatgaaccaagctaaaacacccaaaatatttccaatttgcactagaaacagactccggtagaaaaatgggcaaagaatacaaacacacaatttataaaagactgcaactggacaatacgtatttgaaaatataggctactatagtcagtcaactacaaattgaacaatattttacctattagattgaccaaaattataaatactaatagtatctaaatgttattaaaagtgttgggaactaggcagttgaatacactgttggagaaagaatgaagttcctataatttttttagaaattaatttggcaatattaatttaaaatgtacatatgattggaccagcagtcacttttaggaatctctcctgtgaaaataaatgcaagaccacataggatttatgccctctgcgggacggttataacagcacaacactggaaagattctgaataaccaccagtgggtggacagttgcagaaattatgccatgtggaatattatacaggagttacaaagggtaaggccattctaaatacagtgcctcagaagaaggttcatgataagatgttatgttaaaaaagcaagtaaaaacaacagtattagatgattttgctttgctttgttttaatttggagctacttttttttaatttccatttttattttggattcatgcagtacatgtgcaggtttgtcacaagggtatattgtgtggtgctgaggtttgagattctaatgatcctatcaccccaatagtgaatatagtaaccaataaaaagttttacagtccttccccctcttcatccctccatttttagtccttgcctccctccctccttcaaggtctactgttcccagctgtatgtctgtgtgccccccagatttagcttcaacttataaatgaaaatatgcactatttgttttctttttctgtgttagttcacttaggataatggactccagttgcatccatgttgctacaagggacataattttattttttatggctgcatagtattccacggtgtttatgtaccacattttatttacccaatccaccgttgatgggcacctaggttgattccatgtcttagctactgtgaatagtgctatgatgaacacatggcaatacagtgcatgtatctttttggtagaacgatttcttttcctttaggtatatacccaataatgggattgctgggtcaaatggcaattgtatttttagttctttcagaactctccaaactgctttccacaggggctgaactaatttgcattcccactaacagtgtataagtgttccctttttctccacaacctcaccaatatctgttattttttaactttttaataatagctattttgactgatgtgagatggtatctcattgtggttttgatttccatctctctgactagtgatgttgagtattgtttcatatgtttgtcggctgcttctatgtcttgttttgagaaataactgttcatgtcctttgctcttcttgattttttaatttttgtgggtacatagtaggtatatacaattatctttgcccactttttaataaatttgttttttcttgttgactcatttaagtttcttgtagattctgaatattagtcctttcttggatgcatagtttgcaaatattttctcccaatgtgtagtttgtctgtttactctgttgagagtttcttttgctgtacagaagctctttagtttaattaagtctcatttgtctcctttggttttgttgcttttgtttttggagtcttcatcataaattctttgcctaagccaatgacgtgaagagtatttcctaggttttcttctggcatttttataatttgcggtcatacgtttcagtctttaatccatcttgagttaatttttacatatgatgagaggtaggggtccagtttcattcttctgcatatacttagccagtttttccagcaccatttattgaatagggagtcctttccccattgcttattattgttgactgttgaagatgagttagtcatgagtgtagagctttatttcagtgttctctattctgttccattggtctatatgtctatttttgtaccagcaccaactgtgtatgtgcatggttgttgatacatgaataaaaaatctcccaaatgggtataatctgagagttatcactgggtccttaaggtggattaaatagtgggggtgggggtggagagggagaaggaaggaggagtgagggaagcctattcttcctttctacaggtctgaaattgttaaattgatatcatcaggaagccaaaattttgaccttataaatcatatactaggagaaagggggaaaaagaaagagaaagaaaaagaaagacagagagagagacagagagttttctagctacacaatgttttcatttttcatggaaataaagcttcatttcatttctagggtcatttttccaaagttcaaggaaatataacatgaattcaggtttccagttccagaccatgtgctgatgagacagataggaaactagcactgcatttaaaaatacttcagaatattgaataataattcccctgaaagcaaatacccacagaatgctgctttcctgccaggttggtcagtcatactctccatgttttatatatttaaactggccatttcaagttgtcttcagatgtgtaacctacttcctgtacagaattaattactgtatgttgatacaacattttaatcaccacccactctggacttttagaggtagaagaggagagaggtgtagacaaccgtttccaaggtatacagcttggaggccctgaaggctttttctttgatgtgaactttctgtttcactgactcattcttggagaaaacattccgaagttgtcgaagagggcagctgggatctctgcagctgtaagcatgaatatgtagctttacgatgcttgcacagatactgaggcacaaagaaccaggataatctgcttgaggagtggcctttttgatggcagaacaaggtttttgtttatttgtaggaggcatattttatttgtagcaatcatacctatacttcagaagcaaatccttcttcataataccatcatcaaagatgggcaaagcaatgatgctgataaagaagtaaggaaaaacacaacttcttttatcactaaaataagaaacaaacaataagttttacttggattgaggaaaggaatcaaatccatttacatgagtataaaggttcaagaactgaagggtggttactgatttataactttgtaaaattgcccatggaagagagggtcccatttagaagaaataaatttgtttctctctgaaatagacacattcaccaaacacatggatccgataaataccaaatcatggaattgatcattatatcattccttaacctttgcttcaacagccacaaatcaggtcaataatcacctagcctagtgttgtcctttgtcacagcaagagcacattaaactttgaagaggaaacatcatagagtttacaatagaactgcaggactcatactaccaaattatctgtatcatgcaaccaacttagcatcattatagtttcatgagataaaataaaaattgctcattcattattaataatctgtttccagcacacagaattaaaaaacaaatacctgagaaaagcagaaatgctgataccctaaacatttatttaagtcaaaaagactcagttgagtttaaaatattgcatttcccgtctcctggtagcacggatcactgaagtgctttgagaaccccttccttcctccatgccacccaaatgctcccagtgcctgttgttgctattaagccagagataaactcaacatcagggttatctatcctgagcactgatggactcggctccaaatacaagcctgtcaagtagcttgtttacagcaagtcttttaaataatgaaactgttccctctaaatacctggccgtcagggtagcatgctcatttcactactctaatactcctgcaagactatgagctccatgggctccacaggaaatgataatgattttgctcatcaatatagtcttagaacccgacacagtgcctggcatatagaagacaatcataactattcatggtgaatggattatatgttaagaatttctccactttatgcatctgcacaatatcctatgaaatggggatattattgttcttttatttctacatttctggggattcaagttgcttcttttgtagtattttaaacactgctgtgatgaatatctttatttttgtgatctctccatatgttagattcccaaaaggagaattaatgggtcaaagaatcagaacatttttatagctcttgacatataatgcaaaatgacttctggaaaggatggaaaacagcatagcaccagcaaaacacagaaaacagttttgaccactttcccaggcataccagctattagctttttaaaagagatgataactaaagggaacaatgaaatattacctaaatatctgttataaatttgtatgactttaatgtggtaaattggacattttctctgtttatttaactagttagattttctgttttgcatatcaaccaaggaatgatttgatgtggcttctgctgtgtgaatgggaaacctttcatagatacttggagaaactttgacactacaacttctctgccaatttgataccttttactttgaatattcctcaagagaatgacaggaactttgaaaactggagtttaggtgatacttccactgttccagggatctctttattctatgtatgaattccaagagaccaggagcctcttagatagattacttacatgtgtgttgataaatatcttcagaggttttcacatgggaagaattagtgagttattttgcagagttgggccagttttacaggccaataaataatgagctaaataaatcacagtcagggaccagcctacacagagaaattgtatacctacaaaagttttagcagtaatgaaattgaaagctgtcaccaaatcctgttatctgtctggatagaaaagtgctcaacaaaaacactgatagcgtaggagatagagaattgaattaaggccaaagaaacctttcagtgaatggcagattgaagacaataactgagtaatagaataaaactttctcaggaacccaagtcttaataaattgctctgtaagtactttgggactacagatctatctaacttctttaagttcccagggctcaaggacgtttggttttgggaggaggcacctttaggatgtacaggaaacctgggcaactcataatagggcccaaggtggaatccagttcgtgtagtccagttaagtttggtattattgtgtaaatacttatacatgatttccagaacaaagcattctctcattgttccagacactcattgcttaaatacttggaatcaaaaaaaaattctaagaatgcttataaaaatattctagaataagtatttaaaaattctcaaggataatccaagatatgtttagtgagcccagtgtttacctcttccttcctttctattttgccaggtgatgcttgatagcaacataaaggttacttatctttaaaaacgctccttttcaagaaggattagtatagagagagctaaatgttaactacaggtaaacaaataactgcattctataaataatttcaaggaaagttttcttttcatgtctccctggagatcgtacttgagtcagggagaaaaagtaaagcagtaaagtcaagaacataggctgaagccagagggcctggtcaaatcccagttctatctttactcgttatataatttgggatgaaccattaaactctatattcctcagtttcctcatctgcagaatggggtttatagtgacaatatctatctcatagtgttgttgtaaaaatgaagtgagttaaatatgtgaaaacactttacaatagtgccaggcacatggcaaagtgtattttccattctgatattatgaacatcttaagagtagtttataaaactgtactgcccagtacccaacatcattccagcacatagtaggtgattagtgaacaattgctgaatgaatggttgactataaaggattttccaccaatattttttttaaaggaccacatttctttgtatcttcaaagcatgacttaattcaatacaggactgacaggtaactttcagaaacaattccagggttcagagtatgcacacctgtacgtatcagcagaatgaataatgagagagcaatgaacaatattagataaaagctaggagaactatagaagacaagtaagagtcttaacccaaatccaaaagactttgaattaatgcaagtattatttccttggcaaagccctggcctgcccttctaatcttcactgataaggccatgactattacaccatctgggataggtcaagattaagtgaagattctgatctcatcactaactactcttatattcaagtgggggttggagagtgggtgggaatgtttcagggagagatcttctaatgacagattcactcatgtaatgctcaggaggtgatttaggcctacttaatctccaggacatctgaaacaacacaatttctggaacaacttcttatcctggaaaatcccagacgagtttaattatttttttaatccctgtgtttagtagtcatatcactcaccactgaaatgcagttcttgttgctggagtaaaagagagcaatgtttttaataggtaccaaagataataggatgactaggcacacagctcacgtcactgaaaacggagacagactggctctaccaggttggaacgaagccagtctctccagggctcactgtactctaggtatggcatcatcagctcccctaccggacagtgatgaggtgagagagtaggcaagagaaagagggagagagtgagtgattaaatgaacaaatacagcaaagttagagaaggtgctggcctacaaaggttttagttaaaaaaagcagggaattttgcattaatgaaatccactgaataatcggtttaatttgagatatccacatgtggctagtggctggcatattggacagggaaggctgggtgagttcacttgatatctctgttctttttctatctccttcatggtgttctcttctctcacctgccacttccatgtcggggttcctttttggttccctgcttttgtgactctgctcactttccatggctgaccttgagtcacctcacattctacgcgatcaaaactgaatttttcgtcttcctttataaaatagttactcttcatgaatttgttagttcagtttgaggcattatcattcacccagaccctcaagcagggaactatccttgacagctcatgcccctccatcccatacatgcaattaattttcaattcttgctatatttaccatccccccactccccaaatctatccatgtagcccaactacaagtatcttctccaaactgtcatcctctcttgcctgcattccacctaacattcttctagtgcaaggattctcagttctggctgcctgttagaatcaggtaacggggagtttaaaatatggccagaacctggatccacctccagagatgcggttttattcgggatggaatagagaccaggcatcaccattttttaaagctctccagatgactttttcagagtcagactgggactcacacatctagctcatcttcctggctctagtttttttgcacctatggccacaccataaagaagcaccacagggctctttacagaacattcacttgtccactctgcctaaaccctttcaatgacggaccacaatctagaaaatgaaatccaaattctttgacattccctggcctttctagtcatgtactgacattctcggcctcacagctagttccccacctgcaggtgccttttcctacctgtgcttgtgacctcttctttgctcagatccccactcttcacctggggaacctctactcatcctgagagactcggcttcggcgtcgcccttctaggaaatctgttctcacttgcttatgagaacagattctctgtacattgaacatcctgtgcataattatatgtatgatacatcacgtgtatgttaacatgggtgcctacacctggatgccccgttgcctatgagcccgttttctcagagcatgtatggtttatacctgctgtctcctttaattattaatggtgctcccttgagtctcaagggtatctgtgctaccatagatgataaattgcagattaccctccttgtaagattgttgaggtcagtaacattgtcgtatttttcattgggatctcagtgcctaacacttcttctaaaacttggtgttaatttatgtgctcaaaaaaattaatgaaggtgctgggcacggtgactcactcccgtaatcccagcactttgggacgtcgaggcgggcggatcacgagatcagaagatcaagagcatcctggctaacatggtgaaaccccgtctctactagaaatacaaaaaattagccaggcgtggtggcaggcgcctgtaatcccaactactcaggaggctgaggcaggagaatcgcttgaacccgagaggcagaggttgcagtgagccgagatcgtgccattgcactccagcctgggtgacagtgcgagactctgtctcaaaaaaaaaaaaagaaggaaagaatgaagtatttacctgggaaactatccttttacctccagaagcacatggtaactgttagaaaggctggcgtaaaaaactgaacaaagaaacaaatggacacatagccacttgtaaaaaaacgtgattttagagagtaaactaaagccttctttctcagctgaatattactttttgtacttttgtgtttttcccgaggccctactgatgttggggaagttccacatagtcatcaggtaggtatagatgattcctaaagcagccccagccagcgtcagttctcagaagggcagctctgctttttatggccaaggatttagaatctgatgtcagacttcttgcatgtgaattttgctcctccactgggaggacatttgacttcagttaagttatttaaactctccaagcctgctttataaataaggatgttaaaagtgcctaccacatacagttcttttgagaattaaataaggaaatctatgcagagagtttagcatggtgcctgtcatagagaaagctctgaatagagtagcccttattattttatctattttacttgttgaacttacaaatatttcatttgaagaagggatttgcctgcatttaaaaatactttgaaaaatcactgttccagaatattgggattgtagagattccaacccagttcccccttgggatttttgtaacttgagttgctaatggagccagtgttatttctttcctctgcaattcagcaacctaagtccataccttgcctgttcactagtacccattagtggaaaagaaaataccaacccaggactcatatttcagtgtgagccacaggtgttgttgggtgccagcttctggcagcatggcatacaaacaaatgaatgctcttgccaatgttgggaatattactgcagtatgcctattacaaatatttacttttttagctggaatatcaggggacactagggtttctgtttgaacagtgctttgaggcagaactcattgaaacaacatggaaagctttgcataaataaattcttttatgattatacttgtaacacatcgtatcatcagactgcaaaataaaacttgagaggataaataatcccagttatttgcacataatgctagttactaatacagagctgtagataacttcgcataaagtataataagagatatttcatttttggtaaaaggctcctatcaactagcattgaaaaagcaatataatttgtgagttacaggctgggggttatagacaatgcctttggagtcaaagacacataggtttgagaaaataatgcacttaagagtgtctggcacctaaaacaaatgcaacaaattgtaactcagagtaagaatattaataataactagtattaatatattattctctagggatatttgatatagttctaccaaacagaaatgattagattatattttgttctatcctatgttattttttactgctgcttttgtctgtaattttaaatcaaccccaaaatattcacataaacttaaaacctgacttcaataatttcaattttctctgagaagttggtggatcaacacagaagtgtggaaatgaaattgaggtgtctgcattttcatgaccagcaggcatgataacttgtcctaaaactgtttgatcttgttacaatttctgctgaatactttgagtcatgcaagaatatagaatgccttttattcaaaagcttccaaaagagagatagcatccacagaaattcagagtgagctgctgaaaggcaatattaatcctgatctcgggatattacgctaaatatttgacaggaatccaaattttcctgtagccttccactaagaagataatctttcataattttaactgtgaaaggggaggatttgatcctttgaaatggaaagggtgagcctaattgaatttccttctttggtttcttattaaagatgggaccagattgaatcatattcaattaatgattgtacttggatatattgctcttttcagaagctgaaataagattaacaaagcttgaaaaagatgtcgggggcaacagtgccaattcaacacttaaagggctaggcatacaaaagagcaaagccctatttcaatgccgtttatttacatgatccttgagcaggctgggccattgttcttgaccaattcaaggactgagtagaaggttgtgtgaccttgaacatcagctatggaggcaaagtaaacatacaaatgtacatatgaatatacatacatggaaataataattaagacataccattctgacctgccctctcttctgactacacaccaaatacaccatgatccttgtcaatgatgagtcagtatacccctataatgtctcatctaggcctacccaaccacttttctgtctgccttcattgctcaggttaaagaatgtcttcttctctaaggttttatgcaagtctagtaaccatggaaccatgttttatggactaataattgtgatacaaaatataacaagtaaattagcacaattactctgaagattttaatactgggactgtccaggagcacaatgcctacataattagtctccataaaattctcccttttgtaagcgttcctcgggtatgttgtttctatgttaaacattaggatttaccacaatagacctcacattatttgctaactgtctcatgtttctgtttgtatgatatactgcttcactggtgactgtgtaaattgactagccctttatttcttcagtgtctgcatagcacaaaacacatagtaggagcttgattggtacttctccaaatgcagttggtgtgtgtgtttgggaggtgatacaagtttggaagataaatctgaaattagtatcctagctctgacccttgacatctgtgggagcctgagtacgtttccacatttgtagtataggcataaaaatacaaatagtacatgcactgtgatgatattgtaggacatttgtgcagggactggtatgcagtaggagctccatccacagtcattctgttgttgaatgaaaacactggcttaagaatgattttagaaggccaggcccagtggctcacacctgtaatcccagcactttgggaggccgaggagggtggatcacagggtcaggagatcgagaccatcctggctaacacggtgaaactccatctttactaaaaatacaaaaaattagccaggcgtgatggcgggcacctgaactcccagctactctggaggctgaggcaggggaatggtgtgaacccaggaggcggagcttgcagtgagcagagatggcgccactgcactccagcctgggcgacagagtgagactctgtctcaaaaaaaaaaaaaaaaaaaaaaaaaaggaaagattttagaatatgagaggcaatggagtatggtgctcattggcttggggatcctccatcagactgcctacatttaaaccccaattctaagccttccagttgcaagggttaaatgactgaatacatataaatcccctttgagcgcctgacacagacaaagatttagcttcagtattattaaggatgaaactacttgagacacacaaatgaacttggtcaattttcaaggtcttttaaaactcttaatctatattcctgtgaagaaataatacatgttcttgcctttaaagctccacatattagaaaacacaggattattctgagacagctctcacaccctacagacacacacactcacacacacacacacacacacacacacagagcagcagcagcattgtctaggtctaattttttccttcctctgtcaccctcatatgtgtgctaattgtagtaactgtgagtccaatcaatatatgttctgtcataaggagagaagaagctggactaggaagatggagttgacgctatacctgacattcagtttgaaacactgaatattagaatgttagtcttttccagagggtctgaataaatgacttgtctaaaatagattcctgaggaaaagatctagactcagaatcatgcattgaaccagaattatcaaagaaaagcctaattctaataaaattaaggctcttccagcagatggactaggtcagcaaaaggtgctctatttaactaactggaagtctttgcagcgttaggatacaaaacatttaccaagaaagtctaggtacaaattgcccatgtaatcacacatctgtgaatttgcagagttttcaaaatcatttagagattccaaggaaggggtagtgtgaactcagcaacaaaatgaaaaataaactaagataataaacttactttgtgatctactcagtatttaaattctttgaaatagacctcctctagcaaccaccattccacattgctttcattcttctggcctggttgcctcctcttccctttcctttaaatgaggtcttcataggatatctcagtttctttaggcatttcctaagcgaactctcagggaattaataccatatctaagacttttatttaaatatagactcttctctgtatcagtttcgctctttcagtctctgtcataaaaactctaccaggtatcattcttttttttcattcccaaatacaatataattgcatttcaagttacagaaactgaaaaggctgctttctgaatggaacaaaatgtcacaacaaaaaagacccactggagaaacacggacagagtgcaatgtcataggaaaatccagaatgtggagaacagcaagttgccagagggttccctgcagctacccccggaacttaaaggatgttctgaaagggcatcacacgtgagctctgttcagtggttataagagtcaggtactggaatcaagacaggaaggaagaaagagaggcagggaggaaatatagagtggtagtaattgggctgaattaatgactctagacagagctatgcacataggaggcagtggttctgacaaagacgaccctcctctggagggacttgccccactcctccaccatcaaaaccttccccatctgtgagtcattgctgagacccagccttccctgtagctgttgaagctgcctaacagctcccctctgacatctgatgaacttattgtccgcaccaggggttctcaactagggaagaattttgctgcagtcatcacatccatcataaaaccatccaagcccccaaccccactgcttcccttctagggtgtaggtctcctaatggactgcctcctaattgatggttcccaggctattgccccagggctgagggccagctccctggtgctgtcaccacctttagccattagttccccagcacctagcagagtgtgggctgccaatggtgtttgttgaactatcgaaagggaggacttgtgacctcctgagatgaagaaaaaccatgtttaaaggggctaatatccagccatgacagcaccagtgccagacagcctcatgtcaggctgtgtcaggcagctgctcagatggcaaggcctgctgccctgaaggcttacctgcctgggagaaagaggcagccacagagtgctcctccagaacacccctactcttcaactgcatgtgaatttctgagtactgatttctagtaagataaacagcatttaaggttgcctcttggtgctagtttttaagatgatatgaattgcatagtccacaaaacatatttgccaagatgtagcatttctttttatacttattctgcctgatggcaaaatacaaaaacgaaacctaaaactagtccaggattgagagattcgcttttctcaagcccatttcctcaggggttcaggtttatgggactatggcattgggcactgaaatgttgtctctcgctgtctccttgccctgcctggctggggtcagtgtgaacttcacaagtcctaccagcaatctagggaagagctagtcctgcctggttccactttctgttggttttagatgcctttgctccggatagttctcttcttatcaggacattagtgaaacaaaacaactgtgctcctccagtaatggccactggctggtctgaaggaccccaaaacctcccacttggatgatctggtcatggcaatgcactgaggttcagctgcattttctacctcagccctggtaggaaacttcctgtttcactgagatgctcctccatgggaagggccctcctttcttgcacactccctctccttcggctaacttttggaccctgcttctggaaatttcctgagacctttgagctgcccgcagccgtctccagcatggatcaccactcttctccctgagcccaagcttgaagcatgcagacttccatcaactgcagctccagctcacccctgagtctcctccttccacttcaaacctgctctttcttcttcctaccctagagctgttttctctactggaagaggggaggaaaggatgagtagagggacctcttgagtctgtttgcgttctcctggtgatcttttcttttaccttcacaagtgacttttgaacctagaagtcaagattatggcaggcttctttactggtatgttttagataatttcatatactcctgcccagggcaactggctgctcctaattgcataaaacagtgttaatcaatgtataataaaaacaagtgtatgcttttgtgacaatccaattcatgttaagtgcacaaatattgttttttaaaaagtccttttatttttttttcagtttgctgtattgtctaaaatgttctcattctcttgactgacctaggtgaagcttttaaatgaagctggaaggtgtctggggctccagtggtatgtcccattcttcaggtgagaaaagagaaagcccaaaagaaggaaggactgatgtcctcaagttttggtaccatggtctagggaaagactcacagcgtcttagggctatctcagcgctgtttaagcacaatggaacagctaacatagggggcccagaaactttgccaaatggcaaatagcttttaaagacaaaaacaaagatagatagatagatagatagatagatagatagatagatagatagatagatagatatagatatagatgtagatatttaaaaagatgtatacatcttctggtattgctttaaaattgctcttaatctttgagagggaagttgagacttggcttgtccctctctctgtttgcagtcaaacaagaggttagtgaaccctgccctccttatcccagcacggtgttaaaaggatcaagtgagataacaaatgtgagacacccatctaaaatcaggaaactcttagaggtctctgtgtgagtgttatctgcagggatttgccagagttctgtgttcttcttccttgcactctgatctttgcttttctactttatgaactcagcagaacaggagtcagccctctccatgaacttgatggccagctcctctgaactccaggcctgaccctctgactagcgctggccttgctgctcctttgaatccatcgcaacatttcctccacagctgacttcctggatcttcactcattgtgattctcctgtggactgtcgcctccatgtgaagaattattttaactaattacttgcattttaagatctgaagaggccagaatagataccatgtgataataaaaaataagcttttaggtaattttgttaatttcacctgaggacactaaacattttcttgtgattgagtgatttacttgggaaaggaaataatttattaaaaggtcattctctttatactaaaaaggggcaagttgcaaaaatatcaggcaatttaactttctcatgttttactgtcatgaaacagttctcaaatctaggtacatctgaattaatacaagaaatgagcttttttttttgtaggttgaatcttatagatttattcacaaataatgattcaataccaattttaaaaagaaaccctgatgctaggtattgtggagtttataaagatgttaaaaataaaatccaaagcaactactttttgggcaaaattggtttttaaaaaattagtttcaaaagacttcccatatatatttgacttaattctcataaaaatcttgtgacacagttattattgctatcactgttttatatttaagaaatccaaggctcacttttgtagaccttggatcaaaaatcccagaacccctgacttcaaactctaaatccttccctttacagagcatgtagacgtttggtttgcaggaaataagtatctctaagaggctccaatgcaaattgttatttggtccttctagggaggagctacttttcattggagtgattggagagggtataattaaattgcgattccacctggtcccagagaaagggagagactttttggcagcacagggagagtaaggaagggggagttcaggttgagggaggggataggtgaacagaggcacagaggggaagggaagctaagaatttttagggaatagcaattggagcagcttgcgataatgtgacacccctgaagaaagcaacaacagcaacaaaaaattagcaataattcaagagatgggttgtataagaccttattgctggaccaagggatttagacatcctccagtgctgagtggaacccactgtgtgtgtgtttgtggcagcgtggtggtggtttcaaatgaagatagaacgattaagcttgtgttccagggcacttggccatgtcttaatgcaagacagacttgcaaagagaggaggtgagaaccaaacaactgcaggagaaaactaggaagctgtcagagtggtccaaggaagaattaatatagcaaccataggaaaggggaagaaaggcaaagatatgagaaacgcaataattagaaaactgaaaagccttgacaatttctagaaggttgaaggtgagaaaagaatggaagtcctacatttcaagcttcagcaagtagaagatttgttcatgttataaatagatatgatattaaagaagaaaagctttctggagcccagaagtgtctaaagataaaggaaaataaaaacaaaaatagctaacacatacttgcatgcttactgcataccaggtgttgctaagcccttttcgtgtaataactcatttaattcttaccccaacttttggagctaggtaatatggcacctactttaaagatggaaacactgaagcaaggaaaatttaaacaagttgtccaaggtcacacagctggtaagtgagggagggagagggagaccaggccgcctggtcccagaagtcgtgtgtatgagcaccatgctctgctgccgctctatcatgagcctcgtcctgagcatgctgcttgattttgccctggaatgaccagatgaagatgcataatgagaaagccaaactcaagatgaaagcttagaagagtaaccaaagctaagcttgcatgtctggagatgacagctgaataatggaggagatgagacaaccatgggagagaggggagaggcaggaagaagaggtgagaagtgaggggaaagggagaaaggatgagaaagaagacagagcacagcttgaagtgcccatatttagtgggtgggaaagaggaggaatcagagaagggaaccaaaagcatgcagtaaacccaggaagacctctgggcaagtttcaagtgcaaccccagtagtctgaaatgaggaagatcgctcaggcaaggagctaaccaagaaagaaccattggtaaagctgaactagtgactctatgcgtggtggaaaacatgccaggaaatgtgcgtaaaaggtatggcttcatgggaggaacacaccacgactttgaactccatctctacccgccatcaattcactgcccttcccgcaaccaagcagtcagtagcaggaaaaacaaattgccatagaccctagaggggctcaatattgatgggaaacattcatgtgcatatcttactgagctacatgcagaattcagaggtaaatgtcaaggtccttgcactcgtgcttttagtaaaatagtcttacgtaaataataaacctgaattgaatcggctcaataactttatttttaaggcctctttctccgtctttttccttccttccttccctttctttttatttccttttttcttctctctctctccttcctttccccttcctttccctgcctttccccttctcttcccttcctttccccttcctttcccttcctttcccttcctttcccccttccctccccttcctttccccctcccttctcttcctttccccttccgttcccttcctttccccttctgttcccttcctttccccttccccttcccccttctcttctcttctcttttcttttctttttgtagagatggggtctccttatgttgcccaggtctcaaactcttgggctcaagtgatcctccaaccttggcctcccaaaatgctgggattacaggtgtaagccactgtgcccagcctctttctttttctaaaagaagggaatttgagacagtgaatcatcttgcatctctacctgtggccttcatcagggttctctaaagattagccagtctatgtccagctggctgagacagggtgccacatgtggtacttccaataattctgtccacatgcatgggccatttcacctctacagctctaagctcactgctgagagtacccatcagactaaagcaaacatgcctattaaacatgtcataaataggctagcaagaagcgccacacacagcagcagaacaaagcagaagtgggctgatcatgtcctaagtccatccacttaaaatttatacttctactttattcctctgaaaatattttgattatgttaccatctgaaatgaaagcaagtataaatcttctgttggatttattctcccctttgtcaaccttctggccaataataggtttgatattgttctgggaaaaaaaaaaaaagagggaggcgggttggtggccacaatttaaaagcttccggaaactcttttccacaaatcaaacctttgaatcattctgtagcatgaggaagctcatgtatttcattgacatgagaggaagagcgagcccgtatttaactaatctatcctgtatagtcacattaagtaataccattgtttaccctgagcagtcaagaggaaagacttactaaatctaaaacaaaagtagcgcatgtatgttcttggtttggttttcttcaagatttccccaaatgctgcaaattgaacttggccttaggagtgcatggttgagcagtatttttttcttaaagcatttttctgctttaaagaaagtctactgacaaaagaggaatcagagtttcttctttattttttttaaaacagggtctcactgttgcccaggccaagtgcagtggcatgatcacagcttactacagccttgaccccccaggctcaggagatcctcctacctcagcttcctgagtagctgggactacaggtgcatgccatcacacttggctaatttttgtatttattctatggacgaggtctcaccatgttgcccaggctggtctcaaactcctgggctccagcgagccacccaccttatatgcttcttaatctctgtagccatctttctcctttctataaaataacatagatagacaagatgctgtgtttacacagacatatgcaccatgtacacatgaataatgagagaggatgttcttattaaccttttttccacatagatttaattatccttgcacttccaagctttttgtatattcccccataatggcacttatcatattgtataaaataatttctcccctacccaactgggagtacaaaatcaagggtagttttagattcactttacattcctgttgcctattgtagagtagttgctcaataagtctttattggctcaaggaatgaataaatgaaagaatgtttccctaaactgctattcattctcatgttatgtatattagaaactgaatttttgcccctagttcttagtcctttttccttcacttttagcaaaacgatttagagctcttgtaccttgggcaaaagcaactgaatggaatatattttatagtcagaatatttcaaggaattttttaacagagtaatagaaaataatcaaaacaggtgaatggcatattatagacaacagggaacacacgttctccctaaaatgggaatactaaaatcagatatctctgaaattcgaaatagttggacttttgggtccttttccaccttgagaattctttgaacaaggaaatatagaggtttaccctaaggcgtgacggttccttttaatgatatgactcttcaactttcaaattctctatcttcaaaatctacaggccaatctgaaatggattctatgtcaaggttgcgatcatagattgtatcatcttgactttaccaccttttctctcttatgtgctgtatcgatttgaactataaaggaaggttaaaatatataattaacattattatgcctcatccaaatctcacagtttccagctttttttttttcaacagagattttaaaacttggatgcataagaactcggttgcatagcacaatttttgtgggttgaagtgccttgacaactacctgccaaatgtctgtgcatctctatgtttgagcatctcaactcccacgggactcaccatctcccaggcagtccatgatcagttgcacaaggccttgttgcaaggcagcaaagatgtacctaccagaaacatttattgatttgcccatatttgtctacttgaggcaatacaggccaagttgaattcctcttctcaacacacacgcacacacacgcgcgtgcgtgcgtgcacacacacaacaatttaaaggtttaaaagaaagcttatttgctcagtctgtgctgcccatctgttctccaggctaatcttccctgttctgttatccatccctcaggtaatgtcaacttgagtcattttattctcccagcaattcttctctgggtatattccaatatgtccatcaagtgcattttcatatgtggtaacctttcctgaacacagttgttttcagcatatgttgaccagtccaatgcagaggaagaggatgacctccatcattccattaatgcggcctatggtaacattacgtttttaaaagccattcatattgagattactattgactattcggatgcatactgttaataagcttatagccctctgatgagttgactgtacagttgattttgaaataatgacagaatttacatttatttcttttaaatcatttaaaaatatatatccaacaactttcattgggtgaaacattttcaatttaaccacacactattctcaaatgggatatacatggttctattctctttattcatactatcaaccaaaaacttgaatagctccaaggccacaaaagaggcacgtactatgccacaaaaaccttctggttgacatcaatcttcctttggggacaataattcaaccaagatctaattcaccacatggtattagtatccagactacagttctccaccttttccaccagggtaaaatgagaaaccttataaaaggttttcatatgctaaagccctaaaagaatattttaccaaaaatcaaggcagagaaaaatatattatttcattcattgctcaagctgtatttgggttagagcccccaaacccccaaaatgtatgccaacctggaagctgtgaatgtgactttatttggaaatagggtctttgtagctgtaatcaagttaggatgaagtcatcctggattagagttggttctaatccaataattgttttgtacatagacacagactcaaagagaagatggcccagtaacatgaaatattgcaatttttagagcctaatcagatacttaagagggacccagaagccattctttactctgatcttacagtcatggatctgaacttctaaatgcaaagcaagttctctgggaaccctctctcaacctcacctttctctgcatttcaccactgcaaataattgatggccaaagtttcagtcaggtgggtcaggaccagttcatgttcacatatcagaaagcatatgccccagtggcacatgagtatccttttcagtaatcaacttcatcagcgaaagtcaagtcattttctgctgaaaagtgagttgtgaaatcttgtctgtcttctaacagatcttttccctggaatgccacacacggccatgcaacaatcactcttatacacagaacttttttatcttttccaccaaggtaacatatcaacttcactaagaacagatgactttcatgtgatttttgagctaaacctccccttcccattgcagggcagagagcatgaccatattagtgtctatcaacaaagtgacttgcattctgggtcctaactgatgccagcaaccccacaatctcagaaagcctggcatgaaagtgaattatgactttgtctctttctgggctaagccatctatatggcttgcaaatgtatacttgatgaatgctactatggaggatgtctcttcaacccgaaggagtgatgggaacttcaaacatttccctgcttaaaaaataattgtgtgttgtcttccctcaagcacaattacacacacacatactgagtaatgggggctatatgtgcactgcacaagaaaatttagaggaggagaaacttcatagggaagaaaggattccatttagcagtcttaaggacaggtgatctagcaaatgagtcccctgaaacagcttaccagctcactccactataataatatttcaattatctgagacctgttagaaaacaatcaactggccaaaaataataatgcttggccccaaataccatgtcaaatgcagcctcctctccttgagagaaatgtttcccatgtctgcaattgcagaacacactgaagggcatccctgctccaaagacaagggagaatttgaaggaccaaagcattaaatgcagccaactaggagaggctccttgcttgggaaagcaagcagcagttgtgcaggcagtgcatatgaatgggattatgggatcaggggaagccctgattaaatggaatatgtgcccaagaaggaaatccactgatggaggataatccacatgctataaatttagacctatggctgataatatgtaatggagaaattgtccccaaatctcactataaaatttcatttgtaactatgcttctaagtggcatagatgtaggaaggaggcagtaggggagaggcaggtgatacattccttgcctgtacacaatctcctcaaacaacacctgtttaaccatttctaaaatgtaagatgttgacatgacagaaaggctctcagaagcagcagtgtgaaatcaatccttaaatccattcagaacaagattgacgcatcaggagttagactgtgaaacacacagaaaaggcaatcaaagcaggacttgtttttacatgccctcccgtgatgtcccagacccaagccttgccttgggaagccatgtgtggcctctttcccctgtacagtcatgccctggtgttagaagttactacttttcaccacacccaaatttagtataattcatttatttatattattagatagtgagcaacttgagggatcctctttccttctttttctctctcctgctattaccattgctacctaaataaattcactgttgaataagtgaatgtatatacaaagtagtaggactctcagttctccaaataaggcaaccagtaatcaatttaaaaatcttcaattttacagaaaacaatagaacttgaagtgttttattgtctttatctcatcatcctaagggaagagtcattagttaaaattaaacaatgtctgataattttgcccagtcatcaggtcacctcaatcaggaagtatgtaactagaaaatcctgaaagcaaaggttatcaaaataaattcgtcatttgtccatttcaagatacttatagaaccactgaataaagaaccctagaatcctccatctccttaatgcaaccaatagttttagacagaactgcaataattccaattgactaaaatctcacccacttaaaataatctgataaaaatattgtgcacagcattgaccaaataacttcaattctaataacaattcctaacacattagtaatagaggtggacaaacccttgtgaacaaagatgttcactgcatttctatttataatggcaaaaaaaaggaaagagaaagaaacacagttggaatttgacaaaataagggttattcattcagtggaacatgatgtagccagtaaaatatatttatgcaaattgtgtaattccattggaaaacactaataaggtagtattcataaaacaggaaaatgaaaggttatatatccaacgtgctctctaatgaatggaaggaagaaacaaaagaaggaaggaaggacaaaatatcaagtaagttttatttctttcaacttttctggatatgtttataatgaacaagtactattatagtaatcagaaacattaatgatagatttgcaaaaaattaagttgaaaacaagaaagaattacaggagaaagagtccagttttgagcccccccaccaccgctgaatcactatcatgtttgtcacttgcatggtacaattcatcatgtatatctaatttactttaataattatctgaaaaacagtaatggttttctgttaggttgcttttatgtcagtttgcaaatcagtaaaagggacagtatatgttcatttttagtacggctaaaaacaaacaaactggttgcctataataagaaatgaagaaattaagcttataagctttaaaatgttcttctaagtagcttttaaacatagaacttggcttttagagggcagcatatgtacaatggataatataatttaaatataaatggctattcagaatgtgattaccatctataaagcactggtgacttactttgaagtaagtatttggtatagaattatacttcaacatactgaggatattgataaatattgtgtttgttatctgaattaggtcatcagggacaagattcagaaaatggagaaacacattagaaagctttaacagtgctctaagtgcctttgagatgggcatctcattaatattcatatcaaatcatgtaatatttattaaacattcatttgtgtcaacatttggtattgacatcatagatcaaacaacagacttgtaaactcaaggtcttctctgcccaagaaagaagtattctcagcatttcctatttcagcttctgtagtctttggagtgcttttgacatggctgagattttaaaaataatcatacctatcatacaaatgaagcacagttaaatataaacattactttcttagatggttcaacatttcaaggctatctggataaacaggttgtacgggcctacatactttcagggattttgtttttctttcgaactcaaaaaaattaggtcaaactatcttacctacaattatgaagctatctgcagaacccaagatattctttagggtcattaagcaacaataaatgaatataattggaatgttacctatcacaggtacaaaacatctggggagccagttatatactttcatccaaagggtctgatttgagaaaatacattggcatgatatactcaactttaatatttaaaaatgtttaaataatattaaaaaatatttcgtgttgacttgtatctgagtctttgttaaaatgctagatgaaacacgattttctaccttttgtagccacaacatgtccatccagcctgatttgtttaaagcaataccaacaagaacaggatattatttacagagatagtcaaagatgaaaggctccacaatttttcttggcatgattataatatctcaaagccttgacatctattttttgtaaagcctaaaatgatacatctcgatgaagtttatgcccatttcatccctttcaaagtttaaggtcagctatttggtatgcctttatgaataataaaattatggctttcctcccttctaggccttattgtagccaagtggctttagtcattttcatgggacagattttccaatgtctttattattactctaccttcgccatctcatatttttaccactgggccctagatatatatatcatccattgttcagcatgctctacccagtggaataatcatatttagaatggtctataagatgatcattctccattgggtccaatttacaatctgtttctcccttttttctttcgtatgtttttctgctcattcaaattatgatcagaagctaaggcattttcatatccaaatgctctccccatcacttctaataccatcaccatatattaaaaatagaagacaatatgaaaggaaagcaataaaagaccctcgctgaaaaagtccttgcactttgaaaaacaaacttatttttttatacaagaaaacagaacttaaaccccctttttatgtttgaaatcctgacaatcaaatagctgtgacattaagacttcacaagcattaagtcttatatcagccgtggttagatgtaaataaatccaccataaaagtcagtctaggcaaaaacgcactgtaacttaattttctaaaccacaggagctgggaagcagctgaacttcactaaatcagacagtaccaaaatggataaacatccgggctctgtatcttttgtgatggtgtgccatatcttgttagattctctgcacatttgttgttttatgagcaatgatattatcactttatgatctcaaggaataacccacaacaagcataaattaaggatgggacctgtagcagacattgggagttccttgctaaattttcattgttgcttttattcttcactaacaaaacccccatattgcagcggtagcaatctacccaactgcaagagaacatgtcccaggcccccatgcagaaaggagtagcaattatgatgtaagtaggaggcactgattgccatcgtgtgggctttcaggaaaattctctaaaggtgcctgatttggcaggtgcccttttgcccttccctctccgccttcttgctagctgcactctgcatcagtcatattgtgacctgaagtgaccttgagagcagaagccatgtgataagaatggcgggacagaagagaaaaggagtgcaggctcctgatgacatcaaggagtcatccatatcacctgtaattcgccttcctctgcagttcatgttccatgggagaaagataaatccttttttgtatgtcatgatattttagatgtcttacttgcaggtgtacacaactcctagttgatgaaataaccttattatgtagtgaatttgaaggaggctgctgaccccaaatcagtaatacattagtctgaaattatttttccattagtaacaattagttggataaagcaaacacaatttctttttaattggcctttcttgtttaacagaagtacttatttcccagatacttggccaaaggaaagtaaactttaccagtctaagtagtgtcaaacccacacatttaaccacctttctctcagcaactacatagctgcttatgaacattatcaggactgtcggacacgtcataggtgtaacaagatctttgtatttccatttctgcactgtccaaccaatgtcttccgttaacacagctatgagcttcatctctaatgtgcagcattcgtagcaaaggggccccaggtaagagtaggtccttaagtcaggacaaggatgcattgtatttcatacaaaaaggggacttgagaggtacatgatgaagacagagattccatctgacaaactgattcccatgtggccggcctggagacaggggaaattggattaaatagtttctgatggctttatccaggctaagatttcaatgatctttataaacctccattaatcatgtaatcatctttccattttggaactgaatttagagcattttaagataatggcttccagtgtctgtagagccaaagctaaaatatgacctcaaagagtcaccccttcccttggtgagatatcaaatcctaccactgagaactctttctcatttgatgtgaagagaaagatgcccacagaaacacacctacaccatttctaagacagaatggcaatgcagccttaatctgcatatttcaaaataggatgcttttaaaagattttacagctggtttaaggatgagtgtaaaatatttaagatgggaagagaaattataaggtaattatttttagacagtctgaaggaacaaaatcttatggaaatggtttcattcagaacaatcagtaatacagatcaaaattaacactcatgggttgccaagtaaggagaggtgcaaggcaactcaaatagcattcgtttgtgtaatttgaaaaaaggaaatctattcttaaagggccagtttttctccctctcccattttttagaattagtgagtaaatctcaattcttttttctagttttttcatgctacacataataattggttatgcaactaaaatggtacaccttacaatttctaacaattctgttaaggacaaaagttaaacacgattttctcctcttgtctctgtttaaattagtgtgtaagtgtgtacgccctttcccaccactttatgtgattcagccttgatgataggtctctgttacattgcagccagtaaatctgttatgagcttggctgccatgtgcaaccatgcctggaggctatgttaaaaattctgagatccatgaacatcagcaaagtttttgttcagtttaagctgaacaaacagagttaaagacaaactttattgagtttggagtgggtccatccattgtcactggactaggtactgacaggctaccagctagagtaacgtttactggattagcgaaaatctactagctgttggaggagagaataaggtgctaatattaatcatgaagagcatgggaaaatgaaactctttcaacaatgaaagcaatgctcctttctaccatgaaagttttcatccctcttcctcatctcaatttcaaaacgccatatcctaagcatcaagtgcaatttaaaaacatgagcaacattatgtgttgggcatctagatggttcatgtgtgcagagccggtgaaaacttgaagggccttgcaacatcctggctgctgtccaaccaaaacgatgaaatatggagtgagacattatttcctatccccacaatgcacacctaccttgcaagtccacaatgtgacactgagtcttttggattctgagtgtcacctttgataaatctaccacaagggaaaagtaagcccccaagaaaggaaaggaaattttgttattgttgttatatacacctccagaaaagttatggatacattttcctggatgttaacaggactgcaagaggaggatctgggtggcaggagggggatgaagaggaggctgataaggactctcggggtttaggaacacaggcacaagccacagtctgtttaaattgttaagttatcaatgttgtcaaattgagatgtcaaaattatgagctggtctagggggaatttcatctgcatgtagacagatctcattagaaaatccttaaaatggttttctacaactgaagcaaatcttgcctaagaaagagttgaatcactacctgccttgtgaaatctaaatatgcatctagtccatctttggctagtgatggaccttcctcggctttacctgaactctctgcagttctgtgttcttttctctctgatgctaagttcatggcaagtagaactaacacaaagccttggtcaatagttgtagcatttggcatctggctaaggaaggattttcttagcattttccttcacaaagccagattccatgtatgttttgtacaattctctcaaattgatagagacggggtctcactttgttgctcaggctggtctggaacgcctggcctcaggtgatcctcctgccttccaaaatgccaagattacaggtgtgaaccaccacatttcgcccaaattgagaggtgagcttcagcaaagcccaagacttcatgggctaacaatttctctttggcttatatgagtgtaaggttcttatagggttcctctggggcctatcagaggaggctcatttagtccaggccttcctttcacccatagtcccaaaggtagacgttcggtgttatctccaagtgaaatcatacctatgtataaagaaatatactataatagttgaaagaataccacatgaaggatttaactttagttattaaatgaaaatgcctaaaatgtgtctggacacattttaatatactgggatcctcaaaaactgcaatggcctggattctgttgacctgataaaggcctattgaggtatactaatcattacagacagctttctatgtgaatcatgaagatgtatttaactcatgatcacacaatgcatgggtaattacaaacacgtaatgagtctgtaacttcctgttcaggcgtgggaagcacacactttcattaggaagcacttttacatgaactattactcaaatgtgtgtaggtccatgtggaatgaaatgttcctactttaaatatcaagttcagtgttatgtctgtttgatatttaaaacattgataagtacattttcaaagacttacgtgcaaaaagaggaaagataaaactcgcatcagttcatttttcctttactagtaattagcagatagaaaaaaggtgctatttgtgactaatgcttagttttatgattttaaattacactctgtctccattggatgcataaataagagccctctaactacattttcctcttgctacccttccaacactaacaaggaaattagctcacacatattcaccaccctatatggttatatactttaacattcagcaaaaaattctaaattgctcacttactgagctgaatcacatagagggctgaaattcatccattaatgaattattgtattgcctgaggtctgcttagagctacctgattttagaattaatggcagaataaatcttaagaagaaggccaatatattttaattttatgcatattacctatttgagcaatatattctaacatgagtttggctgtaaatatcttattactactaagtatcaaaaggagttcagaaatattcactaatatacttcatattgcaactttaaataaaattaaaatttaatctacacttctgagaatagaataattgtcgctcatttactagaataacgcttaggagcagatgcatataatgctcataaaaccatgaaagaatagccattgaacatttaactagaattgtcaggtacaaactataaactgtaacttaaaataattttattttcttcctctaactgcagaaatagcacctaaatcaattagagagagctaagaaatttaatcttgaggaaaaaataagatttttattaaggagagaaaaatcctatattttatttttgtatttagactatttcctttacaaaacagctaaatacaacattatgataaaaatttcataggtaagccaaaatagagaatttataacatttaagctaaatcaaagcattatttatagttttcagagaaaaacaggctatcttttgatataatacaaagaaaaatctattaaaatgatttttctaaatttggtttggaagagaatgggcttaagtaacttttctgttggttgctaggaaatctaaatgatgttcttcctgaacaagcaacacaaagcgctacgttttactgcagccaaagggagatgggatggggcaggtgaatagagaggggcgggaaatgacagcaggtctcaggcaatcttcatgctgtgcccattgggaggaaggacctccaaatagaaacattatttatctttgagaggtgaagtcatggataactttttccattcattttctgttgtattttatgagttatataagttaaatgaagatttttttctagaagttctatttgattctttttcaaatctccttgatcaaaacttcttaatagtttactgggttttgcttccattttcaagtttctttattatttttctaacagctacgcattagggtaaagctagagcttcaataatgagaagcagagattgaatgacctaaggtttatatctctctcacctggtctcagtgtgaatgggctagatcaatgggacagatctcctttctgcgcccactcagagttccaagtcccaaccaagcaattgctccaccatcccctaggacatggtcaacatgtgtgtggttaaagctaggttgatgccctcctgggctccagccgagtgtgaagagacaagagggtgcattgacacatcacttctacttccattctatgtgtgagatcctgatgacacagcctcacctgattgcaaagagaactgagaaatgtggccaagctaggcagtcatccatcctacatactactactaccgtggagtaggttaaaatggactttatgagtagctacccatcacaacatgaaacgtgaagatttcataggatatgcctaatatttccaatatcaaagtctctgcaggtctgactctgctatttcttctgcttttcacttactgtgtcatgtttccctttatgtttgaggatttttgaccatgagttcatgtttatgttctatgggaatatatggttatgttctatgggaaaataattttgcaggaatgttttgaagtctgggttaaagttgcattatttcacatagggaatgtatttgcttttgcctaacaaccctaaataattttaaaaatgtatttgcttaagttctgcttgggccttataggcaagtttccttgttggtatcttccaggcagtacagtcaattccagctctcatcattctgagattgcatcccttttgggtctcaccttcattgggctctgatctttacctgccggtcacatcacatgataaagttgtcagagtggagccataatggatgggcagatgtcttggtgcccactttctttctaaattcctgttgttactaaatcttggcttctacagattccttgtttttgtgccggcttcgcaaggcatttgaaattatgggtttttaaaactgtgtatgtttgttttatatttttaaccagcattttagttttcttattggaaagaatggaatctctggtccaagatagcatcagaaatggaagttccaaatatacttttataagacaatcatgaccatgattttagagagatcatcacaagtagatgagaactagcaacgcaagcctagagttttactactgagtcttgtgtgttatatcatacacagaacttggatttcttgatctgtaaaatggggagaataataaccatattacccatgtcagtaagttatgatgatgacagaataaggaactttgcaaattcttaaacagtattgccagttggaattgagactgagaacctcacaagccacaagcataagagcatgaatatgtcaataggcaacagacatgttaaaatgcaatgatttacaaagtcgttttctgatatcttccaccggccctactcctgctgagccagccctctcattattggtttcacctgtgaaacagttctctgccactgctgacttcaccgaatatcttctttgtacttccatctgcgttttatgtgaactctggagcgattagtcgctaatatcaacattggtgcacagtctaggaacatttattgctcccctgcttggcttaatgtttctgacttggtaccataatattattaatagtcacagggtacaataaaagaaaattaagtgtttattttgtttaggctttagccactttacctacagcctttttccattacatttgcacataaatgagcatacgccacattttttagatacaaatcaggttttaactttgctaatcatatagtttcctttctggtagtcttccaggctggtttcagtgtgactccagatgcatgcatattgtagcaaatgaagaaatggccatgtggtagatgtttgcccttttgtgattcacaaatagtgtttttgaagaaaaactatatttgtaaatccactctgaacattccttttcaattccaggagcacatctttaagttttaggctgaagtccattgttcaattccagattattttctagcaaatagttgggaacaactgccatggaatatgtaatcattgaaggcatgagaactacttgaaataaaagttactagaaccaagttttagcattaaagggcccccatttctcagcatgagaagcccaaagccctgagatacttaagtgggcatccaaggccaatgcagtgagtttattccatgtttcctactttctctaccacctcctaggcaatgttcttccaaatgaagtgtttgctttgccttgaaaagacaaattaatattttacatggcaacaactctttattccttggtgggatatttccaacttgatttatatgatggtgtctaaatgcttaaaagcttttgtaaggcagggtttcaatcgattaaagaatttagttttccttgaggttcttgcatcagatattatctcagaaggcctacttcctaagatttataatccaatctcttcctcatgttaaccatacattttggtgagcatcccattggaccaagcttggggatttcagttcagcatcatcatgtggagtgactgcaaacagcacgggggagcctgcatgccccaactttccatcaacgggctctggctgtacaagacttcagtttgcttgctcactagcaatatatatgagtcctctgggcttctgggaatatctcacaggttcaaaaaacagatgattttgaacagaaagacagaaacacagtattctaagataatctgtacacatgagtccttctttattaaatcaagaacttttaccttttcacttaaaggaagtaccttatggcttctctttgacatatatgaattgccagctccttgaggatagaaatggcacctatcatagtacctaggtacaaaaatgttcagcaaacatttgctaaatgaataaataaaataaatgggctgggagtggtggctcacacctgtaatcccagccctttgggggccaaggcaggtggatcatgaggtcaggagattgagaccatcccggctaacacggtgaaacccagtctctactaaaaatacaaaaaaattagccgggtgtggtggccggtgcctgtagtcccagctactcaggaggctgagacaggagaatggtgtgaacctgggaggcagagctttcagtgagccgagatcccaccactgcactccagcctgggtgagagagtgagactccatcttaaataaataaacaaatgaataaataaatgtggaaataagttaatgaggagtagcctgagatgtgggaagaaggcagtgaggagtagaaaacttggatgccaccttgtcattgccttcagctttgtctggactgagacttcaacttaagaagagaacttgcaagtcagacactcctcatcacttgccaacgtggcatggggctctcggtgaagcttgatgtttccatctgtaacttggggccaattatagactaattgagaagatcacatgatttaagatatgtaaatacacagaatagtatctggcactgcttttgctttttttttttattattatactttaagttttagggtacatgtgcacattgtgcaggttagttacatatgtatacatgtgccatgctggtgtgctgtacccactaactcgtcatctagcattaggtgtatctcccagtgctatccctcccccctccccccaccccacaacagtccccagagtgtgatattccccttcctgtgtccatgtgatctcattgttcaattcccacctatgagtgagaatatgcggtgtttggttttctgttcttgagatagtttactgagaatgatgatttcccattttatccatgtccctacaaaggacatgaactcatcattttttatggctgcatagtattccatggtgtatatgtgccacattttcttaatccagtctatcattgttggacatttgggttggttccaagtctttgctatcgtgaataatgccgcaataaacacacgtgtgcatgtgtctttatagcagcatgatttatagtcctttgggtatatacccagtaatgggatggctgggtcaaatggtatttccagttctagatccctgaggaattgccatactgacttccacaatggttgaactagtttacagtcccaccaacagtgtaaaagtgttcctatttttccacatcctctccagcacctgttgtttcctgactttttaatgattgccattctaactggtgtgagatggtacctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagttctttagtttaatgagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagatttctacatatggctagccagttttcccagcaccatttattaaatagggaatcctttccccattgcttgtttttctcaggtttgtcaaagatcagatagttgtagatatgcggcattatttctgagggctctgttctgttccattgatctatatccctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctaaaaattaccttgggcagtatggccattttcacgatattgattcttcctacccatgagcatggaatgttcttccgtttgtttgtatcctcttttatttccttgagcagtggtttgtaattctcctggaagaagtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatgctgagactttgctgaagttgcttatcagcttaaggagattttgggctgagataatgggttttctagatatacaatcatgtcatctgcaaacagggacaatttgacttcctcttttcctaattgaataccctttatttccttctcctgcctgattgccctggccagaacttccaacattatgttgaataggagtggtgagagagggcatccctgtcttgtgccagttttcaaagggaatgcttccagtttttgcccattcagtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagacttgcatcccagggatgaagcccacttgatcatggtggataagctttttgatgtgcagctggattcattttgccagtattttattgaggatttttgcatcaatgttcatcagggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctatggatccatctggtcctggactctttttggttggtaagctattgattattgccacaatttcagctcctgttattggtctattcagagattcaacttcttcctggtttagtcttgggagagtgtatgtgtccaggaatgtatccatttcttctagattttctagtttatttgcgtagaggtgtttgtagtattctctgatggtggtttgtatttctgtgggattggtggtgatatcccctttatcattttttattgtgtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgtcttctgatagcttttgaatgtgtttgctcttgcttttctagttcttttaattgtgatgttagggtgtcaattttggatctttcctgctttctcttgtgggcatttagtgctgtaaatttccctctacatactgctttgaatgcatcccagagattctggtatattgtgtctttgttctagttggtttcaaagaacatttttatttctgccttcatttcgttatgtacccagtagtcattcaggagcaggttgttcagtttctatgtagttgagcggttttgagtgagattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcggagctgagttcaattcctgggtatccttgttgactttctgtctcgttgatctgtctaatgctgacagtggggtgttaaagtctccattattaatgtgtgggaatctaagtctctttgtaggtcactcaggagttgctttatgaatcttggtgctcctgtattgggtgcatatatatttaggatagtcagctgttcttgttgaattgatccctttaccattatgtaatggccatctttgtctcttttgatctttgttggtttaaagtctgttttatcagagagtaggtttgcaacccctgcctttttttgttttccatttgcttggtagatcttcctccatccttagattttgagcctatgtgtgtctctgaacgtaagatgggtttcctgaatacagcacactgatgggtcttgactcttgatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacgttttggcatgattttgcagtggctggtaccggcttttcctttccatatttagcgcttccttcaggagctcttttagggcaggcctggtggtgacaaaatctctcagcatttgcttgtctgtaaagtattttatttctcctttgcttatgaagcttagtttggctggatatgaaattctgggttgaaaattcttttctttaagaatgttgaatattggcccccactctcttctggcttgtagggtttctgccgagagatccgctgttagtcttatgggcttccctttgagggtaacccgacctttctctctggctgcccttaacattttttccttcatttcaactttggtgaatctgaaaattatgtgtcttggagttgctcttctcgaggagtatctttgtggcactctctgtatttcctgaatctgaatgttggcctaccttgctagattggggaagttctcctggataatatcctgcagcgtgttttccaacttgcttccattctccccatcactttcaggtacacccatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctacattcttcatgtagttctcgagccttggttttcagctccatcagctcctttaagcacttctctgtattggttattctagtcatacattcttctaaatttttttcaaagttttcaacttctttgcctttggtttgaatgtcctcctgtagctcagagtaatttgatcgtctgaagccttcttctctcagctcaacaaagtcattctccatccagctttgttccattgctggtgaggaactgcgttcctttggaggaggagaggtgctctgctttttagagtttccagtttttctgttctgctttttccccatctttgtggttttatctacttttggtctttgatgatggtgatgtacagatgggttttcgatgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttcccagatctccagctgcgtgctgggagaaccactgctctcttcaaagctgtcagacagggacatttaagtctgcagaggttgctgctgtctttttgtttgtctgtgccctgcccccagaggtggagcctacagaggcaggcaggcctccttgagctgtggtgggctccacccagttcgagcttcctggctgctttgtttacctaatcaaggctgggcaatggcgggtgcccctcccccagcctcgctgccgccttgcagtttgatctcagactgctgtgctagtaatcagcgagactccatgggcgtaggaccctccaagccaggtgcaggatataatctcgtggtgcgccgttttttaagcctgtcggaaaagtacagtattcaggtgggagtgacccgattttccaggtgctgtccgtcacccctttctttgactaggaaagggaactccctgaccccttgcgcttcccaagtgaggcaatgcctcaccctgctttggcttgcgcatggtgcgcgcacccactgacctgcgcccactgtctggcactccctagtgagatgaacccagtacgtcagatggaaatgcagaaatcacccgtcttctgcatcgctcacgctgggagctgtagactggagctgttcctattcggccatcttggctcctccccccctgcttttgcttttatgtactgatcatcatcatcatcatcaatcatcagtcattccacaagaaactcgggattacactttttgatcctaaaaacagttcagctcaattgtcagctctttaatttttttttcaaaggttagagtcctctcaggtggcatgcaccatccttgggtgcacacccctcttttgtgggtgtgcttacctgtcatcttggcctcagcacgaacagccactttactcctgctaagtgagcggctcatatgcacttttttagactgtattggattttataaaaccttaaaattggtaatttaagtgccactagcaacttgtctttaacaggtggagagagatctggagcccatcctaggaaaaagcaaatgacatttctctcttgcgacccagtcattgcaaatttggtctgtctttgcaaggaacctagtgctagagccattgctaggttttcatatcagggggaataaaaacctgggaggggaggggggaagcaagcaggcagagggtctcaagctgtgggttggttggggtatatatacttagaaagacactgccttgggtgatctcctgataattgctttccaggaccactgatgctttggatacacagttaacatggcttcctcccaggctttatcatcataggctaaactcctcttgcatgaatctcttacctaaggtaatgttgatcagccactactcctctccccttgtcctgaccaaatgccctctactgtctctcacctcatcagggctaccactgcaatgcccaggagatgatgcaagccatccctacctcacttgaaaaattatcttactcaagtctcaaactttcacgaccatatgttatgctttagtttgacatggtcattgatcataaacttttatttatttttctttttatctcaacttagtgtcctggatgtagaaatttaattgagtaaacttctagaagcaattgttatagactaacataaaagaaaaacctgagggtaaatataaaatcatccacaatcccaccatcttaactctaatacctttaccattttaatgcagcaaatcaccccttttatatgtaattttatgtagctgtaaccagattctccttgagcctttgcctgccctaaaattctgcttgtttccatgatattataaacattattttccatatgtgagaaaaacatgttttctcacagttgtaatacaaggtttataactatcattttaatgtctgcatactgtaactttcctttagatttcttataaattatcttgtatctagtagcataagatatcaagagcatcttatgcttctagacattactgtggctttagatgcttttcatttaattatatgatgaagatcttggtgcaatggagttttggcactttgattattttgtaaggttttattattgcttctcctctcctttttaggctcccctccaccacctatcctttaaaggttggggttctcttgggtttcatgcacaagcctccttccacacgtctcttcggcccttagtaagctcatctactatcaagcaaggccttacctccccaaacattctgcagggtccgagacccatatgtactaaccctgcaaaaatgtaccatgtaatcacattaactcctcaaatattttcccaaacactaaacaataacttctcctagaagctgctctaccttctgagcagatattctcagataatggcacccctatccaccagatctgcttggttagcaacacctctaggaatcttctctctctcttctccgtatccaataggcatcaagtcctctgcagtgctgccttagaaatctctttacatgttggattgcttctcttattggcttccacatggccactgccttgatccaggcctttatcatcttgataaagatgataattgttacctggtttccatgctaaaaatttcttaccactgcaaccagtttgatcttaaacaaagctccctgattaaaaatttagttagggccgggcgcgatggctcacacctgtaatccaagcactttgggaggccaaggcgggtggatcatgaggtcaggagatcgagaccatcctggccaagatggtgaaaccccatctctactaaaaatacaaaaattagccaggcctagtggcctgtgcctgtagtcccagctactcaggaggctgaggtaggagaatcgcttgaacccgggagtcagaggttgcagtgagccgagatcgagccactgcactccagcctgggcgacagagcgagactccgtctcaaaaaaaaaaaaattaattaatttagctttttattggctacagaagtagttgtcaaagtttagcatgcctcagaataacctagaggacttgtgaaatcagagcttgctgggtattatcccccagagtttctgattcagtaggtttcatggggttgtgaggagatggacagcagagaatctgcaattctaatgagtttccaggggatactgatactgctattctgggagccatactttgaaaaccactgttctataagataatagttaagtttctaatcatatacattttgaaatcagggctcagtttatccttccagccttactttgtaaacgttgtctagtgaaaattacttttcagctattctaaaattaccaactatatgtggtttctatctgctttcaaaattacccctcgttgtatatgctgtaacttctgactgaatagcctcatatttaagtttttctttgtcaattggcaaacagtgccaattggcaagccagttactacagagctacaaattcaaacatgtatctagagcagttcaagagcaaaaatgcataaagcaggaggaaggaagaataaagagagttccatttaaagtactgtatgatccagcaaacccacaaatgggtacatatccaaaggaaatgaaattagtatgaaagaaagtgaatcagaggtatctgtgctcccatgtttattgcagcactactcccaacagacaagatagggaatcaacctaagtgtctgtcaacagatgaatggataaagaaaatgtgatatctatctatctatctatctatctatctatctatctatctatacacacacacacacacacacacgtacatacatatacacacacacaatggaatactattcagccataaaaagaaggaaatactgtcatttctacaacatagatggacctggagaacattatactaagtgaaataagccaggcatagaaagacaaataccacatgatttcacttatatgtgaaatcttaaagagttgacctcacagaagcagagagtagaatgatggttatgaggggctggtgaagctgcaaggcaaggattgaggagatattagtcgaaggacatagaatttcacttagactgcaggaataagttcaagagatctattgtgcaacatggtgaatagagttaatagtaatgtatttcatatttgaaaattgataagggaatagattttaagtgttctcatattaaaatatgggaggcaatgcatatgttaattagtttgatctagccattctacaatgttacatatataaaaacatggttatgtacaccattaaaatgtacaatttttgtagatacaaaaaataaacaaataatgaataataaataaaagggcagcctctatctctctcctactaattatcctctgagaatattgctaagtctttggaatttttcaatagaagccagaattctagggttttttttttgttgttgttgttgtttttgagacacagtcttgctctgttgcccaggctagagtgcagtggcacaatctcggctcactgcaacctctgcctcctggggtcaagtgattctcctacttcagcctcctgagtagctggaattacaggtgcgtgccaccaagcccagctaatttttgtatttttggtagagctgtggtttcaccatgcggaccaggctggtctcaaactcctgacctcgtgatccgcccgcctcagcctcccaaagtgctgggattacaggtgtgagccaccatgcccagcctagaattccagatttctaagcaaagtctccacattcttagatagtggtaatggatttcaacaaatgtaaaaccatatgctggctgaattaaacatatctgcaggctgaattcagcccaaggcccataagtttgcaactatagtgctactccttattcaagaccaagtccaataactgttcctccacacagcattcccgatgtctgccaggactcccaatgtgcacacacacatgcacaagcttagtcacactgtcctttctgttcttaaggtactgtgttaaaatttatataaaagcatgtgcttcaattaaaccatctacataaatgacatccccaacccacaactaaaggctcaagagcagaaacttagattaacttctttttttcttattttctaatgtagtatgcctatcaaatatctgttgaaggatggaagaaagatcgaataaacaaataaaggtaaactctattagaaaatagcaggcgatatcttattccatacatcttaacttccctttgtatggatttcctcagtgacatgttagatttttcacaatgaaacagtcaaattttagccatgctttccacagatgtacagaaaaatgttagtccaagctaatataaacactggaaggatttagatcaagcagcattattttaacctgtctttcaagagaaaaatgatggaatgattcatgacagtgactaaaggcatcaatattctcttatcataactccaggtaagctttcacatacatgcaattaatcacagcattataaatgggaaaaggtatgtgtcaacccaagaatcagctgtctcctacctatttaatccaaagaaacccaacaaaaacaaaaagcagaacagcaagaacaaaaaatcagttctgtactgtgccagacaaagaagaagtcaaaccagaagattcttccttatcctccatccatgtctcttttttattcctgaagttgtccagcctcacagttctgcatgtgatttgaaagcagttaaatagaaagttaaaagttttcgaattaattttaacagaggttttgttgagccctgaagggtctttcctaagaagaaaatgttattgtcaatggtgcccttcaatttatactttctgtcttaataaaactggttgcagagtgtgcaatgcaaagtcaggttgcctttcatcttttactaagcattaaagcattgaggaaaggaaaaaacactttaagataattgcaattttcttcaattatataatataacttcataacctgtaagggttttcattaaccaaggttcatcaattctaatcgggctgccctcgcattggagaggcccataccagtgtaattaaagctgccgattctgctgacagcattcttcagtttccagggcccttatcattgatggataagtcatcgagcagcatgtgatggccctacatattgccttcctgccttcacttttcaggagagaagctaatctccatgcttttaatttactcttcatacattcttcccctagagccaatgatattaatcagtgttttaaaagaaagaaattaggcaaaattatgttttaaaatgtttaaatagagccatctgtcttcggttctccttccccctttctcgtggaataggcttcatgctcttatagcacattgatttttatatcatggattaatattttctttaggaaaatacatctgatttcccggatcctctaacataaagtacctaaatcaataaggtagttacagatgatgctgttataattacctcttttctttcagaacagcttctcatcatgagttagatgtgagattggaatgcatgccatggtcccttatttgaaatgacccaggctaccacaacagaaccaagcctgcagaggtctggctctgaacaaccttttctcacacatccgcttttgttggtcagtctcaatactttctccaaaagcactattttaatcatgatactcccttatggagaaacttaaggttggattaaactatcctagtcagcaattaaacactttctccaaagtcattgtgctacgagactctaattttacttccttagaagagcaaaaaggagtgaggaacattgaccttgagcccaggcgttctggcctagtggtctgccttcatcagagctggttgctcctgctgtaggttcaaggtcaatgaactctgactattgctttcagcttgccattggagagctgtatcctccctttgataaaatcttcttggctgacttattttcagcttgaacattctgctctatctgctccaggaagacagatctgcttttggtgccctgcccatgacttacatatcttccacttagttacaagacagcctccttttcctcaggggatctgttccaagaccttcagtggatgcctgaaacctcaagtagaacccaaccctatatacactatgttttttcctacacatacacacccatgatagagtttaatttataaattagataccacaagagattaacagtaactactaataaaatagaacaattataaccatatactgcaataaaagttatgtgaatgtggtctctctcactctcaaaatatcttactgtactgtactcatcatttttttcttcttgtgatgatgtgataacttaggctactaagtgactcatgggtgtgtggcatattcagtgtggacctgctggatgaagggatgatgcacatcctgggcaggatggtgcaggtcagcatgagattttttcaggctactcagaaaggtgtgcaatttaaaacctatgaattatttatttctggattttccctttactattttcagaccatggttgatagtaattgacactgcagaaagcaaaactgaggataagaggggactgctgtgctgagatttatatgacattcatccagcagtattttttataaacactcttattattccattgcacctggatccacatcaagcctttaaaaaacagaggaaaactaaggactccctcatgaagaactaaatcttcaaaatctggtttcaaactcactttctcttttagatattgttctctatcacagtgaatctcacctggttccaatcatgccagcaagtccactgccctttactgacagcagcagtgacttttgcaatattactgatatttctaatacctattcctgacacatttctttgcacttttcctagcaaccccatttgataatgaacttcttaagggcaatgatctttgttttctttgaaacttcttccaacaggtgcaagaggaaccctggatttggagtcagtaactccaacatttactagcactgggatcttgaaccttcctagaaatctctggaagactcagtttattatcattacatggggacaatcatgtctcctgccctgacacctcgataggcagggctgtgggtaaagatcgaatcaattatagtccaccagggcactttgtaaacagccaaggctcatgcagatgctataacacttatgctgaataaattttgctaacagaaaaactagccaagatttatgacgaaacatacaggatagtgatttcactacccttaccctagtcaactgcgatgcatttcaaatgtttcatctcttttctatcaccttgaaaaagccagagtcttaaacccaaatatgtaaggatcagggagtcactagaaatgtgtaaagaatacctcgcacaagataagacactaaagcatgctggggacagtgacaaaatgaaaagtccatgtcttgtctaaagcagaaagctggcactagatccgcccaattgtcaccctgaagaaaggtgagccaactatttcaagggaaactgcaatccatatttttataagtgaaatacctagatgtttaaattgttggcctttaatttggttattaaaataaatgtgtagtgttcaaatatatcattaatggatatgccccatgtgtcacaagggtttgcaactttggctcaagatttttaacatctgagtttgtatgaacaatcagcaagtgttcttcagctccagtaaaaactaactctggaccaagtttttgggggctgttaaaaagaagtataaggcatcatgcctgcatcgaaggagaggaattaataattattatgtgcctaacatttattcagttactttacatacttaatcagtttactttaacataatccttatgaatttataaggtgattactgttacaatcactttgctaacgaagtaaccaaggttgcttgcccaggagcatgtgacataactggtaagtagtggagcaataatgttaactcagttctggttattgtcaaaactgatgtttctccaccatggaagggaacatttcaaagtagccagaaaagagaacttgaaatatttctaatgcacagaaatgataaatgctccaggtgatggatgccctaatataccctgacttgcatatacattctatgcatgtaacaaaatatcacatgtacttcataaatatgtacaaacagtatgtatcaacaaaaatagaacaaaactatcacagatccatttagtggagaccaaatttagtgaaaatcagttgtctttctgctttattgcagtacaagggaataaataaaagatgatgaacccagaacagaatcaaaagaatcaaagacccacagaataatcgaaatttatgctggatggtggtgacactttgataagacattagaaaaagatataaactggtgaggaatatgtcactctgagaaacttagtggaggatatgggcattgggttagggttatttaggatttgttttctttttcctttttttttttttttttgagacagagtcccactctgtcacccaggctggaatacagtggcatgatctctgctcactgctacctccacctcctgggtttaagcaattctcctgcctcagcctcctgagtagctgggattacaggcatgtaccaccatgcccggctaatttttgtatttttagtagagatggggtttcgccgtgttggccatactggtgttgaactcctgacctctagtggtccacccacctcggcctcccaaagtgctgggattacacgtgtgagccaccacacctggcctagggaattagaatttggataaatagaggatggtagggggaacagcataaatgagagactgagtggatatgagtaccttaccaggtagtaatatagttctgctttctcctcccctttcccttctaacaaacacactccagcttctgtgaaggagtatctgttggttttgcttggctccatgttctcccagcttttggtaacagcacccttcctgtttttcctttggggaactgtcctgccatcattctgtcctggggtttctctgatcctgtgcatagagcctcctgtacgaggtcacactcacatattcagaatctggaagtgagaaagtgtttactctacagaagcaacacaggcctaatggtgtctcttcaatcccttgggtagacaattctactcttcagaaggtaccagacagattgaccctcagttgcccacagccatggctgattcaacaatgcacctttgcatgggcttctcctccttctctaattcactcttgctcatctcctactcctactccgtggattcacttcccaaatgaactgcgtgttccaagcttttgaattatgccctgcctgggaaaaactctggttaaggcagttgttcgtgacaagattcccaaactgtcctgccatccagcattcccaaagccggattgctcaagtcaaagcaagatagctttgactctgctattgacctatcctctactattctaaaaatttcaccacttcacttttatcagctggtgtccatttctgtttcttgccaccaaaaaacccgaactgatttatgactctatttcaaatagacctatatcataccattggataatagaagaaaagttctgtacacatactaataaaaaaatctcactaaatgtcagtgtggctattgctttggatggcaagaaattctgaaacatctgacagtattattaaacggctcttgaaaaacaaacattatggatgggctgcacagtcatctggcagtgattcacggtgtttctgccaatgcccacacctggcatgatgaagtgttggaacccagcatttccttcataaccacctgggccttgaaggctaagattatatatgatttttaaatttgtgcaaatctataggatgtgtgataagatttttacatgtatttaatgtggagagatcaagtcagggcatttagggtgtccatctcccaagcacaacacattttttaagacttttaagttcagtatacaggtttgttgcacacataaacttgtgtcatgggggtttgttgtacagactattttgtcacccaggtattaagcctagtacccattagttattttttcctgatcctctccctcctcccatcctccaccctccgataggccccagtgtgtgttgttcccctctttgcgtccatgtgttctcatcatttagctcccacttataagtgagaacatgcggtatctggttttctgttcctgtgttagtttgctaaggataatggtctccagctccatccatgtgcctgcaaaggacatgatctcattcttttttatgcctccatagtatttcatggtgtgtatgtaccacattttctttatccagtctatcaatgatggtcatttaggttgattccgtgtctttgcttataatacatattttaaagtatagtaacactactctgctatcaaacattgaattataccttcaatcttactatatatttgtacactttaacccacttctcttcacccaccctctcctctaactcatgctagccagtctctgatctatctttccactctttacctccttatgttcacgttttttaatcttccacaaacatgctatatttctttatgtatgtgcatggcttatttcactcaagataataactttcagttctcatccatgttgctgcaaatgacatgattttattatttctaatgggtgaatagtattacattgtgtatatatataaaattttcctttttttttctttttctttttctttttttttgagtcatgcactgacactcaggctggagtgcaatggtgtgatctcggctcactgcaacctccacctcttgggatcaagcaattctcctgcctcagcttcccgagtaactgggactacaggcatgtgccacctcacccagctaattttttatattttagtagagatgtggtttcaccatgttgcccaaagtggtctcaaactccttagctcaggcaagctgcctgccttggcctcccagtgtcctaggattacaggtatgagccattcatctggccccaaattttctttattcattaattcactgatggatacttaagtggattccatatttttgctattttgactaattctgcaatgaacatgtgagtgcaattatttctctaatatattgatttctttccctttgggtagatatacagttgtgagattgctggatcaaatcataattctagttctagatttttgagaaatctccatactgtttttcatggtggctttactagtttgtgttcccaccaacagtgtaatagagttcccttttctctgaatccttaccaacatctgttatttttttttctttttaataacttctctattactctaacccaccaactcattgaaatcgttgtctttttttgtctctcatgtaaggaccactcctgtgatacagttttctcttttccaggtgagaaactatagaaccgatgcaaaaattaaacttatatctcatttttccatgacattgtttgcccactaaatcatacagctttccattgccactttaattaaatgggttagattcatactgagttcaagtatttttaacattcctttatctatctatctatctagctattgtccttcttcttatctatcatctgtttttctatcatttatcattctatctactaagtagctccaaatacacaagtatatccctgaaaagtggccatttttctaaaatctgcatcccaaattgcaaatggaaaaatctacattattatggtgcatctggtccttgttaattcttaatctgttgtatcttttactgtcatgatttcaccagatgtgcaagtctatctcacaagttaatattttacataaactactctaaagaattgttgaaacaaagttgagactccttggctcccaacactctctccatacaggagcagtctaagtctagctgaccaaaagccaagaagatcataaaaatccactgacttagaaacttgcaaatgagtccaagattctccccaccctccttgggtgtgtgtgttttaccctctgttgggtttacaaaagaaaagatgctcaggataatccagaattttattaaagattaatacgtttttgagaactttgctaatactctgcaaaaaaaaaggggggggggctttttctctcttaaaatagaattcagaacaacgggctttcttttaaacaatgggttcaaaaatagaacttgccatttggaaaccttcttgagattttctagaacagtggcttcccaaagtagctgatcattagaatcgctcaggggacttttaataaaaatgaagattgcatggtctccccccatatctattgaagcagaatttctggcaagttggaccaaatttcctgggtgatcctgatattcagccaggtttgaaaaccatggctagaatgtggagttggaacattaaatactatctaagcagttaacattttagtgcctgtggttataattttattctattaatttcctttggatttatgttttggaagtgaagcctggatggggaatcatttggctattattttgtccaaatccctcattttgaaaaagctctttgaaaagcttaaaaaggcccttgcatgatggatttgcccaccagtgtctagatcctttattgctgtagtgactgttgctcttctatcagaactgcacctctaagagcatgaagacaggcctgaggggaagatggaaagttatttctatcttggctgaatcctcaggattgagtcagaaaactggagaggaccagcagaaaccatctggtccagtccttgtcttcatgtggttatgatttgcttctaggaatttcaaagcagagagagtccactgctggtgtttcaagatcccgatagtgagtaagttcttccctagagccacctggtgttgctcacaagccggcatgtcctgattcccaatgcaggggaaacgatgccatttcccatccctttctaatttattccctagaactaagaagctacacatagaacaacatgacaagatggattaatcctaatacaagttaaacatccctaatcccaaaatccaaaatccaaaattaaaaagtttttgagcaccaacatgatgccacaagtggaaaattccacacctgacacctttgcttttctaatagttcaatgtacacaaatgttgcttcatgcacaaaattatttaaaatactatataaaattaccttcaggctgtgtgtataaggtgtatgtgaaatataaatgaagttgggtcccatcccaagatatctcatgatgtatatacaaatattctaaaatcaaaaaaaaattgaaatctgaaagacttctgttttccagcattttggataaaggatactcgaccagtatgaccatggtataatgacaaccctagactaagtcaagaaatctagatggtagtcccagcactgacactaacagaatatgcaaaatcaggctaatcattaatatttttgtggcttagtttcctcatctgcaaacgaaagaagtcaaaccctttctggcttgatgtagtatatgcctatcattccatcattcatttacttggccatcaaggcccttcaatgtgccttaatgaggtcagtgctcagtaaaagtagggaatgagacaaatatgtcccgtgaccacaaagatattatatttataaagaaaatggacaaataagaaacaaacattggtatgtaattacgtttatatcttttctgcaaaagaaaaggaaaatgttgagacagtcaccatttaggctagagtctttcctccccccgacagcacgcctggccctctaattccctaaaatgtggaacaacagatggcccatgcattccaagaattctctaaatggactgatttacccattagcatgaaactgatcaatcttattagattttggcagcttctagatgaccatatttatgaggaagtgtccaagtttgctggcagaactatatatcttccaagaaaactaatagggtctccaaactttagagtctaaagagatatggccctagtgtcagtattatcacttggctaggaactagtgacaaggtcaaaatcagaaactgaagtcatcgatcggcacatcagcttcacatagaaaaagtgtttcatggccacaaaatgaactattaactcagcccttcacccaagtgtgtgttggttacaaaggaacccaatattatatggataactcacttaaatatatcactagtgatggaaaacatcttctgtagcattttatttgctgcatactgggggtggggaggagggtgtcagtccagtattaatcaactctactaacaagctgtttctttacactgaggcaacacttgtaactttccagtatgtctttgggtcagttgcatagatgatacatgcaacaacactatgaggcagatgggatgatgtattgtatcacatgcccatctgaaaggataaactatggcctaagaggattgagtgaatccctctccagtcatgtagttaattggaaaatgtgtgcacgcactgcctcccacccatctccccaagtccctgtctataccaaaggactgcttatgtaaacacggatagtgacaaagtccacaaagaatatattacatggaggagaaaacacggaatagatcacacagaagagaacagagcacagttggtctctgctcactctgtataatccattgcattctttctcagaaagccaagttgccagtgactatactaaatgctgaagtaggtagacatcacatgcctttttccgcttatttgtttttaaagaagaaaggtcttaggttagacacttcagttctttgttcaattgcatttgagatatttcactgttgttgttgtttatcagcaacagtggctgcatcgtcattttcactattcctttgggatgaaatctcaaacccccatgcagtgaggctagttgtgtgacagtgatgacaagcacttgttccatcacctgaagtaccttcttggcaatccctcctatacctacctgtgatttaaagtaggaaagcccttaaacatacagtctgaaacagaattggaaattacagatggtttagcattcaacacatgtgaatcacagaaatcagttcagtcagctgaatttacctcattagattatcagaaattttgactctgtgacagcttgagtggtgaacgtctacaaatattttttttctctcagcaattttgcagaaggccaagattttgatgtaactaaatagtgtcaggcattatgaggagctgtttgtttttgttctcataaaaacaattagtaagctattccctagaatcattgatggacaccagttcattcaacgggtcattgtatttcctgtaattcagtcttcccacactttttcataagagctgtcattggctgggaccttctttgagggaaacaagccctgaaagaaacaatgactccagcttgtatgaatcgcaccctggaaaactcagcccagcacactgcaggagtaaaaggcagtgcccagccctgtgtctttgaaagactggctcaaaaatagcccggacattttcctgtttggagaactcagtaacagctgttcatagcccacatttctttcataccctccccagccacaaagaaaatacaaattcacactagctgtaggaatggacgttattcaacattcgtgtgccttcaaaaatagcacaggaagagttatagacacaatggagggaaaaatgaggaaaactcaggaggagtagagagactagggaggagatgcttttaaacaatgagaaacttaaaataagcaggaaggcaaaaaagaaagggcaggatttgaaaagtctacctctgagaaatgatagggtggtgtgaaaagggcactgtagtgggagctgtaaaagtcaagaatgttgttggctctgctgctaattagttgtgttttctagagcataccccttaccgtctccaggccactaccatagaatggtcagggggtggaggcaatagagattaagcggtctctaaaaattcatcctgattctaaaaatgtcacattgtatgaaagtatagaatgtggttattaggcaggggggagttgggagaaacactggatataccctccatgtatttatgtatcagtcccctggagaagggcattcagtggtctgaagatgaggaaaaaagaaacacacccagcttcatggccacttccttcccctatcctagaatagctgcctgagaggatggtgagaaagtggtcttacccaccccaggctacagcagtagcacccagaaagacgtaaagtccagttctcaaagacccacgaccaccaaatttcccctgtctttcatggagtcccctgtaggttcttgccaaggatcacaaattcaagatggcagagtgcatgggctccaacagaagccatttagcatgtaggtaaaaagtcaggtactgagccagacagaactgcattttcactttaacagaactgcattttcactttattgagggtttgatctgtgacctttggtatataccttaatctctccctgaacttaatttttaaaatatttctcaaatggagacagaaatgcagttatgaattttaaatgtagttgtcaaagtgcatagcacagattaagtgcttaatatacatattatctattattattgttaatgttatattcatggaatgctttacttagcttggagaagtgttttttgtttgattttctcaggtcccttgacctcctgaatcaccatatcatctttgatgaaaagcaaacaaaacaaccaaatcagaagacctctagcaagggctggtcaaagggcttccaacaagtgctggtggctgttgatcagacattgactagagctctatcaagcatggaaaaatcagccttaaatccctaatgtagaccaattagtgagtaaatctcaacattttaaactgggattccaattttatagttagagctccctagggcaacaaacgcacatttttccatccagtctaggcatatggagtgtttcccttacccctcccttcagaaaaaggggcaggctgagtacagtggcactttgggaggcaaggcaggaggactgctcgagcccaggagtttgagaccagcctgggcaacatagggagaccccatctctaccaaattaaatttgggaggctaaggtgggcggatcatgaggtcaagagatcaagacggccaacacggtgaaaccccttctctactaaaaatacaaaaattagccgggcatggtggcacgcacctatagtctcagctacttggaaggctgaggcaggagaatcacttgaatccgggatgtggaggttacagtgagctgagattgtgccactgcactccagtgggtgacaaagcaagactccatctcaaaaaataaaaaataaatttaaaataattgctgggcatagtggtgcatgcctgtggtcccagctacttggggagctaaggcaggaggatcatttgagactaggagtttgaggctgcagtgtgccatgatcgtgccactgcactccagcctgagccacagagggagactcaatctcagaaaaagtcggcaggtagttaagggggacatagtacatctccattttggcaatctcataggaagataagatgttttatttggttcttctgcatttgaactgtgctgagaaattagttaacaaaaagaaactataggcatacatacttatctgaaatgaggaacctaacacacaatgtcagccttttctgcagacacaggggttagataatctgaaagggccccatgggacaaatcatcctgagtgagaggagactctgagggactatttgatattcaggcagacagagattcaaaaatgtgtttcataggggatctttcttagcagaagtcggagaatacacagtcatccattcagaaggattcatgtgagtttctgtatggaagcaaggctttgatagaatggtattttaggggcaatttttacttctaacacacattgatgtagtcttcttacagcaaaatagaatcataggatttttaagtggcactaaacttatacaatcttccattgaaccccttcattttatttgtccaggtaactacttgactgtattttaaagtaaaccctgaatgacctaaatcttcgtgcaataaaatcacaatacaatacatgagagttctgtttgtttgtgtgtttgtatttgtttttgtggagcactcagtcaatctggctaaatgcccaaggccctggacattggaccattccatttgaaatggacacggtgacagaaatgtacctaaggaccttccaaggacaacagaacacacaggaacacaaaggttccaactaagtggtagaaactgtgataaccaactctgtaaatctatggatcagatttcacaccaggaactagctgggctctaaaggggagatttccagggcaccaggcaaaggtggttgtggagagggctgaggggaaataggctcaggatgctgacagaacaggggccacaggatctccaagacagaatcccagttctacaaatggtcagggaacaacccttggcatcttttcattttcaacataatttcctgaatatccaaatgaggagtactcatgacagagccctccctctgcccagcatcaacggctataaccctggaattgggtacagcccaagtgttgagcaaccctcactctcatttcctgagtggagtctggtccccagccaggccaagtgtggtccatggagagtagttacggcgatgctagtttttctagatcctttagggaacacccacctattcccaggtgattccaaagctgatccagaaaagcaacacatacaaatcctaccaaccctgtttttagatttcttacttctactgacggagcagttaagacctgccctgtggtaacaatgttatgtggagaaaagtacaagagtatcaccaaggttatgattaaatcccagagcatctctaaacaaatgaagcttaaggaaagacaagaacagaatagggcaaaggcaaaagatcccacctaaaattcaaaacactatctctatttctgcacggtcagcataatggtgaaaaggtcccaagctgagggatgaggatgtgatcagaagcaaagtcaagtgaggacactgggataggaggcacctcatgggcaatcactgagcacacacccatattttcatagtgctggacagaacgaggcagacccaggctgctaggtccaggaaaacagaactgacacaattgactacaagtttttccaaggaagtgttcatttttagccaagttttctttgtggactccagctctggctgtttgctttgtatttgccaagtttataatgtaagttttatgatttctgttaagaggagtaagtttccctcaaggagagatctaaagtaggtaagcctgcttacttttccaaaagaaccagaggaaacttcagggaaatgctaagctgtggaaacaggagaagaaaagaatttggatgtaagagacagagaagatgagaaattctcaaagtgatctcacattcatctatgagttcatactcctatcattcaatagtcatcaattcattcattcatgtgttcaataaatatttcttgggcttttatggtttgccatgttaggcatcagagaatgggcaatacagctgctcttgagcttgccaccttgtgtaagagatggataatacacacgtaaataaataggaatgtaatgtccgggaatgaccattgttctgaatccaactatcacaggaagtggggttcttgatggcccagcatgagctacttctaataaggtggtcagggaaggctgtctgggagggtggtggagcagagaggttaagacctgcctcatggtaacaatgttgtgtgcagagaggtccaacagcgtcaccaaggttatgattaaatccaagatcacctctaagcaaacgtaggctagggaaagacaggaacagcagagggcaatgggaaaagaccctatctaaaattcaaaacaccatctctattcttctgatattctatatgttaacagatagaatattactcctttcccagaatacatcagaatagatctgttcttctccatccctatgaagtgagggagggagttttgacaagacgtgaaggaatagccagcttttctgctaaggagatgggagcatagttgaagggccataagatgaccaaagtgactaaagccacatgggcagagctgagatggaggcaagagacagtagtcacttcccgcagagaccgttaggtcaggagttcagcatattgtttgccacatataggtctgtaatttgtttatttctgttgacagaagcttgtgaaaatatgtatttctttgcaataaatctgtgtataaatgtccttcacgcatttttactactcatatggtaaacagggctttttccatttcttctctatgttaccttctccaggagctcctgcccctgcaagctcttctgtaaggccttcccagccactccaggccagcatgcttgctcccatctctgatgcatctcccatcctgcccccaatccctgctctacctgtatcctatgccatatctagttagtgtgtgtgtgtgtgtgtgtgtgtgttaaggtctatcttgtcaccaaagaagctcccggtgaaaatacgggctttggagtcaagaaagatttgccccacccactaattcagccccaccattcaccacataagtgaaattagtttctcagcctcaattgtaaaatggggatgacaacattggtaccttacagtatagttgtaaagaagatgtagtatatgaagacagtgtttgggaacaggagtgaggccagcaggtctgtgggttcttgcggaaagcgggactgtgcctgtgattttcagttctatttcatagcaccttataacacaacgcttcctgtgcgtggtctctgaagggagcacaacacactccaaaaatcgctggatctggaacgatcagaaatagattcccttctaggttctgtctctaactagttatatgaccaagaaccaaagtaatttaattattccaagcctcagtttcctcatctataaaataggcatgattatgccaatctcacagggatgttagatatataacctgtgagattgtatatggaaagaagaaagcattttctgttctaaaattctgatcctgtgatttttcaactcttgttgatctaatataaaatccaattacatgaatccacaatttatttaacaaggaattcatagactcagtgcttcagtacctttctctgacaactccttcctggactggaagaccagggagtggtgaaagccatcttgctgttgcccagaacagaagtcacaaggggagggccagtgtttaaggtacatgtgactcaacacatggctatcagaaaacaatgtatttctttccaagatgaaggtcattaacaacctctgcactggcaaacctgacaaattactctgtatttatttcagcctcagatcttctacctgaaacagttcaagtgacattaaaaatatctcactaagtggcagtgtaaaattgggtgtagctagggaaggtcactgtgccctaacagactcgctcagcgactttatgcaattctaaatgtactctggccttgacagaatttacattttgctgttacacttcagtgtgttttagagagagccagatgtataacagttgacaggcatgcatgtcaatacaacaggtccataaagcaggaagaagatgggcatagggaaaaggtagctgataaataacaattaccattagccagtgactaaatactaataccttcatactattctttttcaagactatcacgtaaccctcaccatgactttggcaagcatatgaaaactggtaatagtttgggtcctactaaaatattctgtaactcaatctgtaggtaccacgggagtaaagaattttgtttactgatgtgtctcaaacactgagaacagtgtctggcacatagtatgtacttaacaaatattgaaacaaaacccaaaaaggaatgaataaatgagaatcctgttttgagtttccctgcttaattccaggttcattttatatcacagttgcaaagcagtttgtgtttagtcatcgtcatctacacaattaaacatggttcactagttagtttataaagctaatgtttccatttgcttatagtacacagaagagtgatacattagaatgggcaatgccatctcaagaaagaagagtgagcaggctggttaaatgatgtgacaaagatcaggcagaaaaaatagtgacaaaaggagcacctggaaggcccaaggccagctgctccctggctctccatcacccaagggcacttatcactctgtgggaggaaattaggcaaagggagagaggtcaagactttcttgcttgtccaagaaatcattctgacatcaggaaagtttgggtttgtgagaaaaagttggtagccctttaacttgatctatgtggaactcatgctttggcctttttgttcagagacagtgccgttgcactgatgcagcatctggaattgggagtaagaggcccatatgggacccctttccatttctgttttaccatttgcctctgcaatttgagacagacccttcattgtaccttaagtgttcattctcatatagccaaaaaccatacaggcttaccaacaacactgctatcaaggcctaatttctgtcttatacaaaaccttgggcttagggctttacctttacctttgttcaccaagatatctcagtttttttctctcctaatgaccttctcctctgcatttccatgtcattgcctcagctccaccttttcttgagtcttccctaaacaaacagaagtacttcccagccagtttcaatgtctcaagtcctgcatcccttcaatccattttccatacttctgtctgtacaccaaaaataaatttctaagcctcctaaccaagtgaatgagccccctcttagccaagagcattccaaagtaaacctgaaactcgacttcaggccatgatgagaaggtgcggtcagacatgcctcattataccctcctctctatggaaatcgggtacaactaaccagccttaacattaaagcagggatgttaagactgataaaatagactttttatagcaataagacacccagttccagcctagctctggtatagccatacatgtcagagagcaggcaccaaaagaaattattttaccccaaaatatatttttgacatactttgaaatggccctgcaaagtagaggaaaatctacattttgtcgagaatccccttccctttccaggtcttttccctgatccaagagagaactgactaagagtctggcatcttttaaggtatgataagagctctgaagcctgctacctggaagcttcatctgcacaacaaaaccttggtctccacaaccccttatcttaacccagaaattcctttctattggttccaggtctttagataataactttttcaaccaactgccaatcagaaaatctttgaatccacctatgatctaaaagcctccagtttgagttgtcctgcctttctggactgaaccaacatacatcttacatgtattgattgatgtcttatatctccataaaatgtataaaaccaagctgtagcctgaccatttgggcccatgttctcaggatctcctgggactatgtcacagtccatttctcactcatttttggctcagaataaacctctgtaaatattttacagagtttgacctgttgcctcgagacttccaccctacacgcgattccaaaaggcaatcttgattgcataggaaaaccagttgcttagcacagaaacacactgacgcttagtgcagtaggcacagggactgtgtacagatctacacatgcagaataaactggaaaccagccattacctccctcaaaccattgttagactcatccaagatttgtgaagtccagcgacagagcagctccttcagttactgcaactactgtttcatgacagccagtttttgaaggactgtagtcactcaggcacacaaaaagctccgaactactgaataacaggatgatatagaaggattcagtccagagacatgtctgtggagggggaaggtggaagattaactagtcatacctaggaataaacctgctaactcatctgggtagtgtaaatagtagatctgggtagaattaccagctgaaaattacattttaaatatactaatagtaaaatatttccttgctggttactctcaggcaaaattttatgcctgcctcatatagtgtcaggatgtctcaaaatctaaattaaattaaacaacacacttgctttgacagatcatgtgtttattcagaagtttattcaagccaggagcatgcacaaaatctgacagtattcaaggttataaatttttttaaaccactgtttcagtcaaatgtatctaattaaatgcttttggagatgatgatgttagtaaaccaggtcaactttttgacattatttacagacatgcagacgttacttgcttaacaaatcagcccttgaatcttcttgagtccctgattgattacgaagggattacaaagaaaataaaatcttgcagaaaaagggaaaccctcctcacctaagaaactgttaaccctgtaggtgatacatgggcacctctgggacaaaatcctgagctacttgttcatttcttactgaaaattacctttctgaaagttccatttctcattatcctttatggtcagttccagtccaacatctttttcaaagtctgctgagtccttcagctcatgttcatctcccttcccttggccatttataggacgaattttttattcctcttgattttgcatgtaacttatatattatcaagacagaaaatgcatctcataaaacttaggactgtaccaaccacatagcaactactacaaaaatgcttttggagctttgtggcaacttcacattgactagaactgtgattcttaaggtgtgagctctagcccaccagcatgggtatcagcaacttgttagaaatgcgaattcatggcctcactcagatctgctgaatcagaaactctggggttagagccagtaatctgtgttttaatgagtctttcaggtgattctgatgtatttatatgctcaagctggagaactactgtactgggaaaattggcatctattcggaaaaacttgaccacctatgagagccactgaggctcttataatagattcagagttgttttattaaaaaaaacttcccaagtatatttgcaaagaagtgtttcttgcaaaaagtaggcaccataagattagacatctgaggaaaacaataacaacaaaacaggaaaatgtttctctaacaaagcaacacagatgatatttccagttatcaggagaattacttagcacttactgtcagcacaaccacagcctcctgaattaattcatattctgggctgaatgaacgtgcaaagcttattcccatggaaactgagcactatacagattgatagggttatagagcatataactgagctaaagcaattgccaattttaaaagattagcattgacaatttaatgcaacacatttatttcccaaatatcaggagtgtctcatctacattcaaggataaaggactgtcaaaatttgatttaagaaaaaataaaaagccctactacaacacagcttatcatcttttgagcttgggccaaaatgaggcagaagctctgttttcttaatactcccttaattacaaggagactgtttttaacattggtattaaatgggttgctatggcttcctgcctgagagttcagcatgccaagtttcagtcaggagcaagctatgaatgggctgaataagatcctcacaaataggtttcacagcccaaattcctaccacagagcatcccattaggaagattcctgggaggtaacagggagctgacaatggtgctgcctcccttcactttccaagacattccttctatggcttctcactaatcgccttgtcctataggatccttgtcctgtgtaacagaaagctgcttcaaacagaagcggatctgctgcctgctgcttccaagcacagaaaccatgtggcagtttgtttagtcctccaataggtttgtttgttccttgggcaatttcagcgttctcaaattttatatatgactgtgaccagaagggaagaaggcaaacaagaagttcaaagcagagttaaccatgcttagatacaggcccctgtctttggtaaacaatgcagaaaaaactactggggattttatctctgtgttctcaaagatagaaagaaccccaggtaacacaacccgcaatggtgaaaatgagcaaatgcagtccccagagccatgcgtatgtctaatatctattcagatatccaacaagccttctggcttcaaaattctccactcctctgatcttgtagcttctcatagggaccaagcctttgaaatttcatgctaggttttagtgatttcggtttttgtgaggaaaaaaagatatccataaggaacatatgcccgacatttgtggctgtttttgtaaaagcttagcctttgagagctgtggctactgtgttgaagagcaagctctggtcgtttccagagcttcatcattcagaagttagggtcagagcaaactgctgcaaaaggctggggaggggacccagacatgttcctggattcctttcaggatatttacatttacatgcagttaggcaggatgtgtatgagggagaaatagagggagcagagtaaaagtgggaaagaaagaaaggatgaaaagggaggaggaagggaaagaatgagaaaaacggaaggaaggaaggaaggaaggaaggaaggaaggaaggaaggaaggaaggcaggcaggcaggcaggcaggcaggcaggcagccaagaagaaaagggcggcagggaggaagggagggagggagggaaggagaaaagaggaatggtagggagacagggagaagggaaaaatgggaaaaaagaaaagataaatatgtacaacttttatgcatccataaaaataaagaaagaaaaaaaaagaaaagagagacgcggagggagagagggagagaaagaagagtaaacacagcaaagacatactgtaaaagaaggaagtgattttcaccatgtctttcattcagctgtgctgacctgcaggtgtagagaaggtgaaggagtttgtactctttctccaagaagtgatcaactcacacctggcagtttgacacaattacctcacaagctttaatactcattatcttggcttccacagatacaattgttttatggctccaagaataatgcactcctttcggaaatccagcagtcatgcctgggttggcgacctcctgaatcaaggaactgctaactggcaatactgagttctaatacaggtggccaacccaagacaatttactttgcatggggagtaggtggctatgtaatactgtgaagttaccagtaacatttcaattctggactgcggctgccagatataaatggctttatcattttgtttgtgattttgcagatgtggttaaagtcacacaaaggctcataccaaaggaatatgagctgttttttggtttgagacccagtaccaaattggtaaaatgagccagctttcagtaagaagtttttattatgtggacatgagataaatatttaacttgcaaagcttacttgcacgttaaacgtctatcacagaaaagggaaatacccaagtctttctgtctcagtcatctgtgggttctaaaaatgcacaaactagatggaacatcataaacacattttcaaaaggccatgcaaaaaaaccaacaccaggtggacacatcttcttgccacctcatcagcgggcataccacataaaccagaccagactcaatgctgaagaaaagtgacataaaagtctaagtgttcttttttgttttttgttttttgtttttttgagatggagtctagctctgtcgcccaggttggagtgcagcagcacaatcttggctcactgcaacctcagcctcccgggttcaagtgattctcctgcatcagcctcccgagtaggtgggattacaggcacccatgaccacgcacagctaatttttgtatttttagtagagacggggtttcaccatgtaggccagactagtctcgaactcctgacctcatgatccgcccacctcggcctcccaaagtgctgggattacaggcgtgagccaccgcgcctggccccagtgttctcattttgcaaattctttgatttttcagaaatgaatggatcccaacttgtttctgacacaacaccatttttcaaatagtttctctgattattcacaaggatttagaagagcaagcactgtaaacacttccaagtctgggcttgattacctagaaatgtatctagaatgcattctatcatttaatctaaaatctgagtcatcttgaggggaaaacacagaatcttataaaaaggataaactgcttttaagaacgtggatgtctgattttggatttgcaaagcaatgccaattacaagtgatctatttgtttggaaaaacacactgaggataaattctattagtaattaattcaacaataatatgaatttgaaaagatgcatgctccgctctctaaaaaagaaatcagtcagaaagtctacctcaaatctgccaaatcaatgaggttttatccctctgaagttcacagaattgtaacttttgacaaactttaccttctaacttacaactcaagcgtgctcatcacaccagagacactgctccaataacacgtgtctttctgctgcagcattttggaaaactgaagacttctgagggacaaagcacatgggaggtctgctaaccagacatggcaataattaatctcaaataccaaaattacaactgtaatgaccacgtcctaaagaggcaacagtggcctcagcaaaacagcacccctaaattgattgtaaagttaacagagcagctttgggcaaagtggggagttcaaacattaaagtaggattacaaattaattttttaaatttatcttgacacacttgaaagaaatttaagcaaatatctcatttttagacagcagtataaacaatctatattgaattttcttcaggatcatctttatacgtaagtttattgggatagtgatgtacttgtgacagatttctttccctataaaatatctctcttcactaataactgatgcctgcaattccatcatagacatttccattattccttacttaaatacaacacagggaaggggtccctatgcttgattaatccttgtaacaccatctctacagctgtactgggaacactttgatggctggaaccttgtgttttccttcttcgttagtattccctgcaggacctcatcctgtgctaggcgcttgataccacagaatcattcagctccaaggaactggacagatcgctgggctccgtcctttgattacaaagacaagaaggtacagctgaaactcagaagaaaactgagacttctctggagtgactcagccaattagtgacaaacctgggaccagacgtgtggagcccatagacagaaaaatttacccgtcaagcatttactgagctctgctgtgcactgggcattgtactataagctgaggacatggaatgataactacaaatacattgtcctgcagaagcttgtgatctaaatgagttggctagactcatacaccaatgatcacagcaaatctacctaagtgccattataaaattgagtccttaattagccctgttgattcaatctagggaagcttagcaattgagacatagaaatgatttcttttggaagatttcacctaaaaaaaagtactggaacttagattccacagacaggtctttagctgagattccagcaatttcgagttaactttactaatcagaatattttatttgcatttatagatgtgaatgaagagctcatacattttagtcatatactcaaaattaaagtcgtgttcattcatttttcagtcaatgtgttagttaggtgtgtatacaaagaatgcagacagaaatcctgatttgattcgttcttctgttcggatctaactagttaatattaacaagagctaagctattaacttttctaaaggattaatttgtacattctcttggatgatggtgaatctcattcaagtgagaaaccttactctattcaatttttcatgaattctctcaaataattggtttcaagaaatagcactacacaacatcttatcattttctagtcctcctgggaattcctaaatcatgtgacaaggacactaatcacaaaattcaacagggaagtggtagtaacatgaaatactcaacatgtagtctttgctttataggagcctccaggctccgtagatccttgagtgtccgttcgcctcgcttgctgtgataatttcccgtgactgctactttggtgatccttatataagcccagaagaaagtcttgggtttccccagtatctcaagactccacctctgtccctgtctggctagtttgctcatatctgcatctggtttatatgtgcctctactcaaatcttctagatttatctagtttcagagatagggaagaaatgccatgcttggcttgtgatctgacatgacagtgaccctttgctacctcttctccatgcagacgttatgggccatgggttcttttttactctgtacctccacacgaatggtggctgatttccaaggggctgaaagagtggagagaacattggatcaaaggcagccctctagtgtgtgtggtggtggtgtttgatgacttttctccttcctttggccaaatacaatagatagatagatatggatatagaaatatagatatctcactgcttgtcctgagattcatcccagtcttaaaatctattcagtcttctaccctctttcctctgtatgccatatgtctacatcatatccttgatattcataaaaggtcaaagcagataaagactcaggacccagccctccctcatgccgtgagcctctgtgccttccaccccggtgactcccacaggggcacacaccacagctatgacagaagcactgcagacttttcaagaaaaacgcattttaaagaatagtaatagtttcaagattttaatagaagcacagtacttcggaaatgaggcgttcaatgaacgtgtgatgaatgaaagaatgaatgaatgaatgagtggcaagcttccaagtgtgcctggggagtgaggtggctccctgcagaggagggacttggatggaagttggcccctttcccttgctctatgttgcgatggtaggcatctgaaacgatcctaggtcacatccagttgggtgagcctacttctggcatctgagagtggacagaaacaatttcagctctcaggggtgagccagtttaggtgagccagttaggttaatcaagagtgtgtatggtttatccacagcacttactggaatagagctttacttggtagtaaacccagtcccaccagcaacaacccttggtttttatcttattatagtgactgttattcatttcttcctttactcagtcattcatggaacaccttggaatgctcctttctgctcaactgtactgggggtataactgtgaacgagtcaaagctcctgttcccatttaagttctcaaatgatcacagttcttactgttctggagtatgacttttaactttctcaaacaattgcttttggctcttgcctcatctgatccttatataagcccagaagaaaacagaggctcagaagaggttaaagattttgagggtagcacatggctaattagtagcagagctgggtctttttttatgacatggagagctatacatagtttctattagccagtttcattttcctttcaacagaagccctgcagcaacacacttatcaacatgggcagtgatctttggttggaccttctctgggcaaaggactttggacaccaaatatgctttctgtaacaaccactacacccaattttccaatttttcatggggatccggtaaccatataggaaaaaggaggaaccatcttcctgctcctattatactaagactcatcctacttaattcctcatttaaaacaagaacttttgttatttccaaacaatattcaattaccaaagagtttctctggattaattgcaggacgtcactctcctttaggatagagcacattgtccatcagccccaccaaatcagtcaagagtgaagaaggaagatattgccagggaggaaccaaggcctaggagccctagctgtcactctcctcctcctcctctgaatagaaactccctctgggcacaagaacgggctctccaagaccttcagggctcctgggaaaagtgcttaaatccacaataccctctgtgatctgttttccatttgcagagggaaaaaaaaagtctaatgttggaggtttagctccatgggaaactacaactgcaaattgaatttttgaaaattaaatccaatttaaaatgcattaaaaactatttaaagcaatcttctggtgagtccttggttatatgaggaatctttctgggaagaagaaaaggcaatccctggtgtatctgttgtataaatctgggtttacaccaatagaatcttcttaaaacaaggtttgggggcctgaactgcaaaggggtgaaggctgacttggacaaactgattccatttatgtccagccttccaggtgacatactatagctcagtttagcacttaaaaattaactttaattctagaatttctgtaccattcagcacatgcatttaaggtagcaatgtaccagagctgaggattaggcccaaattagaagcaggctgaaaatactataagagaaccctgatgtttctgcctgattcaagttacactgacttccaatcatgcattttatcttttggcatgcttatgtaggtggccaataaatgttacctttggtgataataaaacaaaagccaaactttcataagctagaatatccaaaagaccattgtctgcattcttggcagcagccagatagccagttttcccaagtcagcagcctctgaggaggctggcgaggggccagttcccagggttggtgcattcctggggcctggcaagaggccactgggaccctgtttcctctttccttctctctatgtagtggaaaaatgttcccattttgacccctctgagtcttttttccccctatcggagcaaaggcagtcagatgggaaatgttccccagttcccccccaaaactcatctcccactgctctaagctggcagagcttaaagcaattgaaggcataagacaaacaaaggagggttcctcaggccagtcatccagcctgattctatcaggagcatggtgcctggagcaaggagaaccagcgggaccttgtgcacagggagtcattgtacctgtgcttggaagactatgggcacttctggaagcttttggaataaaattacctgttataaatagacactggctgggtttcagggttgagagcaagaggccaagatttccagaaaaatagaatgctccatataagagggtctggtgtacagctcattaataggggactgctgagcaattgaactaagaagaaaggaatttgaggttggtcagacatgacctgtagtaaacacctgggtaaacatttctggcagataacatcatggatatgctattccacttttaaacatcatatatatatatatgtaaaccaaacattaataaaaatcttttctgaatgcttccttccatgtacagacaaagaaagctgccatctggaacggccacatcagctggtccacatgtttccagggtagagaagtctgcatgccaggcatggtactgcatgccctatttgtgttgtgagtcctttccctaaattcactcaacaaccctttgaataagagacgatcacctctactaatagatgagaacacggaggctcagagaaggcaggtgacatggccaaactcacacaggcagtaggaggcaggttgggattcaaatccagttcagcctcattctccagccaactcatgctctctccactgcattacagggcatctatttccactgtgccctttaaaattagtgctttgcacacagcaagttcttaatacagctttcttcctgaggctgccactgctacttctatatttgatagaaattttggagtttagcagataggagctgcaccgctctcgtcataacaatgtatttcctttgcatagggtgccacagcctccaaaacaattccttgttctttatttcacttaatgacaacatccctcatcatagtgtcccaccattgaagacacagatattcagagagtttaagaaatgtgctaaaggccacacatctaccaaacatttcaactccagctctagtctaaggacttacgcagttctaatgcagtgatcgatccactagaccaccctccctgcacctcagcatcacacaacttttatcaggactgttgaagagaacaccatgtcactggttacatggaacttgtgttctgaaggtgccacatcaaattgtctggtgaaaccaaattgacaagtccaagggaatagactggaaaacaacacacaaaaatctatttcaaataaaatattaaaaatgggctagtgttttctcagcccagaaatgtgagaagagatggtggcagagtatattattttatagagtcaatgtgctggatacactcgtttggcctctccaaatctacccttcacccttccctgccctggtctgggcccagagcactctatgggccccattccctctggcttccaattgggttcagccagtggaggcaccaacaggggacaagacagtgtgaggagaatgaagtgggagtgttcacgtcccgatccccttgctgcagggccagcacggttggccatatccctccacctaagtggcatttcccgccaaatggttcactccttatagccacatggttctatagccactttctaggcctagtggcaatgactccccactgtttctagctgcaggaggctccattattatcttgttgcactttctatatcctgccaccccttttaaagaggccctttattaaactctcctccagtacctggcatgagtgtgcaatgtgtctccttcccagactttgatgcagtaaacaataaaacaatattactgattttgtctttgtagacaaatgatgggaagttactcaaatcctctaagaggatgagaaaggctaactactttagaccaggctctctctttcagtcacttccttctcaccacacctcaccaaacagaaattaggtcagatatcctgcctcagggacctaccaaactgggcccaggagatctccacatagctacctaccacacccacagtctagcccggagtctactccgggaggaaggcaggacaccactggcctcatcccagtctgtctagttggtgccttcacagatttcactctcagcgttcaccaacccaagctggatcactgccagcctcatggccactccatctccaaaaacggcaggcctctgcaaacagctcctcctcacagaaagggcaacagcccttgagcctacttatctgccggctctgacagatggaccccagaattcaccaaaccaaatgattttatttccctctacacatctatgtgcatgagagcagtcaacgaattaattgcattaggaaacctaccaagctgaaaacaactgcttaaaaccaagaaccaaaaaggtgcggaaagacagaaggcaagcaaacctcaggggcatattcggaaatggacaattatgatccattaagcctggttaagaaactgaaatttatgaggaagaaacatctggaactgcctggcatgtaaagaaaccaggaggaaccactttttgggcttagagggagcaggccagacaaataggattccatgttaggagagaattgcaaaattagtgtataaaaggacagaatggaggcagtgcctctggtgttaactgaagcgtttgaatatgatggctcctggatttccttttgaaatattaattgaaattgggctggagatgagggctgcatgaaaactggcagaaagatcataaatactggttaaagtgagccagaggaatggaacatggcaatgcaacacgaagtaatgagaaatactgctccattcatggccatgaaccctatggatgtctaataaatattaattgataaaaatgaactatactgctgagtggtaaattagtgtaagaaacctaggctgctgaaatacagctaatatatatacagtttgtacagcatacaccgatcaatgaatgagaagaaaagatatgaaaatgatttagctatgtgatgcattttgccttgcaccaggaattaggggtaagagaatgttaatagaggagtcaggaggggtggtcagagggggcaagaggaaagttaggacaataattcaagattatagtagaccttgcttagggtcttggcaatttctcatgtataagccaggcaccctggagtcacaccccattcttttagacactgtggctttctcaataaatttctgcttcagggaactcaaggacaccatagattaaatttggaccaatttattggaggaagatatgacagccctcctccttggggaagccctcgctgatcaatgtagccagaagaacaacttcctctttgtaaccccatcagccttgttgtttgcaccactgtatacctcctggtattctgaatagtgtatatgtgacaagattttttttaaagctttgcaaagcagaaatcatagtttacatttcttagcactcatttcactgtgtttcagaccaagtaggtactccattcctgtgctgatcaatgagaaactcgaaaaagaagagcaggctcttatcagagagaacacccagatgcctgttaggtttgggaccagcttctaaggggatcgatgaaagctctacctcctgttatggacaaagcactagagagtctgccatgggaacgatcctaggctgccagagaatgatgcggaaaactcagttgccatggaaacttgtatgatctgatgattcccattgttgaaagatggtgagacaacaggagaatgacaaacagatcttggagccctaagaacacatggaacatgccaagcaaacatctctactcatttgtacttatttctgctatagaagcagtctcatttcatcatctgtcaataacatagcatttataaaaggctttcaaaatgtgtccagttcctgtttttatgtagtgatctcagcgacaacaaggatgcacagaactacctctgatgctggcagacaacacttatcacagcagctgaatacagctgaatgaaacaggtgtcacccgagctcctgctccatgactccagcaagggaagccatccatgggcagatgctatggtcagcactaatggcacgtgaagctacctaacaatttttgcatcacagattcctgtgagaatctaattatacctacagactcactccccagaaaaatgtacaaatgcatataacataaaatatatcaaagaattcaaagccctggaagtcttttcataaatctcccctatcaagcaccttgggactcaagagaatccaggacaccatattaataatctctgatgtaaaacaaacaaacaaaaaactttacacacacacactagaatcatccttgggcaaacctgaagagcagcatgccatttcctctctccaaccttcccaaacagcaccctgggcctgctgcatgtgggccccctttatcccatattcagcacccccatgactgtgtatttggttcataagcagctgctcactgctaagttcactcactcattcattcattttactgagctttttctatgtgtcagactttaggaatacaatgtgaatatgacatggcccatgccctcaggaaacctacagtcaggggtgatttttcttctcagggaacataatggccatgtctggagacagttttcattgtcacaatgagggaggggtgctcctggcatccaatgggtagaagccaggtatcccaataaacgtcctacaatacacaggacagcgcccatgacaaagaatgatcaggtccaaactgtcgatagtgtcgaggctgggaaaccctgttctagagcacactggcctgtgggaatgtgaaaaggccagaagtaggtattatgccagctcaggaaggggcgtgttcataagaactccggaacatgtggcttcgatgacagcctgccttcttttcagagatgaaaggaaggagagaaggaagcaaaggagccattcagagtgagtaacaaccacaatgaaggtggatcctccttcaggcagtgtcagaggaggcaggaccaattgcaagtgctgggcagacaaatggcatttcttccagaatctcctcaggggaaatgctgctgaccctctactcacctccatcagtcagtggcccagcagagggaatgtgcagccatttgataggaccatcactcaagtcataaaccccactgcatgctgggggacggctagatgctggaggtgccccatcgctcaccaggttctccctactcttctcccattctagtcaataactccaccttgtacatgaacacgccataatcagttctcatatgaataaaaacacaaaattgtatatatatgggtatgtgtgtacacacacacatgcacgtacacacacacactattataaatcgcaatctcttctaaagttggttccaaggtctggttcatcagaaaatcacaagatcagaaaatagacctagacctacattctacattccttataagtctccccttcccacctccattcctttgtcaattgttttgctgaaaccaagtctggcttccctctgatctagactgttctaaactgcaggctcctcagtgggcacagatacagcagacgtgctaatgcacatggtctagtcctgttgaggtagctgatgctctttcacattgtgaagcaccgtgaaggagctcccagtcactggcataaagcaattttctgcttcagagctgttagctgtgcagatgcattgtagtctggggatagccccagacctaaagtgaaatcccaactctacctcttaccagttccattgccttgaggaagttgatgaacttgttaagcttcagatttctcatttgtaaaataggggtaattagagttcctaccttaaagggttgttgttaaatattaaatggtagtttccatataaagtattgagcagcatgcctagcctatattaagcctccataaatttcagctactattactaagggaaggaagccatcctggttgagacttaatgcatgattcactaagtgaacatgctgagctgtctgctaaagtggctttgatgttcgattctgccatcctcattgctgacatgctctatgtccactgcttggacctagtctacttccgtcctccattcagactgtccccagcaccagtgttgctgcagatctccaatggccctccaagacttttcgtgttaggatctgatctcttcccactcttttggggctccctcaagacttgcagcaagtagcacctgtgggtggtgccctcctggcccagcctcccctgcctcctcctagctcatctgctcccagctccatccatgggacccggagatctgcactgttggagaacaggtgggcagggcacctctcctgcatttctgtacctgcagtgatgggctgagctcggctggtggacagattcactgggtagatacttgtctaagggtctgacacgtctctaactccacctccacccactctcaagagggcacagtcaatatttcagcgtgacattttggaaaggttgctaaaccaggccaaagctagtctattccccaccagttacttttctcctaaaaatggccttcactagatcctcagatgtcacgccatcttctgatacctggctcaggccatggtctctattctaagtacatgtaagagacacagaaataatagacaagttaggggaaatgaggcagttggaggaaaagaaaaactccctcttgttctttggccctccctgacttgatgctcatttgggaaatctcaaaaccatcttgatatcagagaacaaagatcaggcttcccagaggacaacttggcaggttcccagtggccaggggcacagggcaaacggtactttatgtactcttccatcagtagacatggtcaaagggactgagattagactagctggaaaccttctataggaagctggtgttttgggctctgtgcagtatccctatggtaagaggaggtctaacaagagaaccatgagagtcaagaaagatccagtcatatctgaagcagtacagaataaagacttttgttttcttagtattcataacccactagctgtaggctgtactgagcaacaccagcaatacctctattttgcatttagaaaaagtatccgcaaggctgaacatactctatgtcaatattttctaaatatttagaaaaatgccttctaaatatttttctactattcttcctactggggtatatgtacctttgataacagcctaaacctgttcctctgcctgcccgcatatcacatatactgagggtaaatacaaatcactacttagaaaatcagcacccaggaaacgtaaaacaggactttcaaaattcccattgctctaatgcatgcggatagccattacaatccagcctagtgcctgtctttgtaattaaagtgtttttgtaaataaaatagctacatttgatcatgtgtcttcagaggcagctctcttcctacaacaaaggtgagcagttgtaactactcacgtggcctgcagagcctgaaatatttactatctggaactttatagaaagagtttgctgattcctgcttcagaattacatctagtcactaaatagaggggaaataactgaagataaacagcagagatttaaattcaatatgaggaagaagtttccctgggagaaaaaattcagtaatgacatgaattggcaccaaaggatgcaggaccaatatccttgggttgcctcttttttctctactctcagtctgcagttaccaaattccctctgacgcttcaaactacagctcccccatggcccctccatgtagttgcacagctccaactaccgcttccccatggcccctcctcacatcttcccagagtgacctcagcatctactactgtcagtgccacacagttcatttccatgtgatgatatttttcctgcttattaggacagcttccctagataaactagaagcacttgaggaagcctatccccctgtatcagccagggagaccttccaggaaagagatggcacactcaaagcatctaactgaggagagtttggtaaagggactgtttactgaattgtggacagagctaagtcaaaccaacaaaagatgggctaacaacaaccaagaaccattactatgaagaatcgttaaggtatgggaaaagaaaaggtgccagaacatagatagagcagtggttctaactatagctggagttctggggagagggttgtccaacaaaagctgcaactttaggcaaaggtgcccagttcctgtggtccatgaccaagcagggtgagagtgggagaacaaacacctcgacctctgatctcctgctaggagacaagtaggacctctttctcccattggctaaacccaaccagatgccaaaaggcaagtccatgtggtgcatcctccagggatgattggccaggtagagaaggaaaaagagtggatctggagggaaaatggaaaccatccagcacatccccatagctggttttcaatagtgcttgttgactgattgtgttatgaatgttgtggaagtcttgattactataacgatttggatacaaacagtcaagaggctgaaggttgaattcagggatgtgtgcacgtcctttttttcctctacaagcttataaaactatactgctgtcggaactgaggatttagtgtggcagtgtggcaaacgttttttcttccttttgtgggggagaagaaaagagggtaccaggaagaaattcatactgttactctcatctgtgcttaaaagctaaatgtatttcccaaaaattaaaaagagaatgtttgttacttaaatgtgagctggtaagaaagataactcatgctccagcatgctcatcagctaaatactaccacagctacaagtgtcaaacagctacatgggcagcccgggaatgagtcttgcaaataaaagagcacagtgtgaaatgatgactttttctgatcaaaaagcaccctgggaagggctgaacagttttgggtcaagaagaggactcgatttctggggtgatttttatcgttatcagagagtagactgtacttgccgtgaacgtatatacggctactccgcacactcctactggtggaggcaaacttgtagtcacttgtctttctctctgggcctttaacccccacaatgaaacatatttttcatttcagtttcacttacgtatcactttctcctttaaaagggtgaataataaagtaaaaaaatcaccatcaatgaatatttcagtgtgttaccagggcacacacacatggacatgtatatgtgtgcacacacatacactcaaaccctcccccatgccacgtgactaaggaccacaaacttgttttccccaattggagcttttttcagtttttggactgtgagtttctttattctgtgattcctccagtctaaaaatgtaaaagccattgtaagggagctataatttctactcaacacttcaatgatttgattatataaaataaaaagtgtaatgaagttaatagcaccttattcttgcaatacattatgagaatattttcctgtaaaatctgaaagtggaaattacctctgggccccctaactctcaaaaatatgtgtcatgacgattattgcaatggaattttaagacttaagaacgtaatatgtttctctttcctctattcagtttcccacaaggacatcttctgttcctgggatagtatataatgaaagataaagaacttaagtgacaggttgttctacttttggtgtaatcctagcgtgtgagctcaggaagagcagataacctctctgggccttaagcagtctgcaaagtgaggagacgagataaccgattttcactttagcattctagattcaaaaaataaaataaaaagcatgcattgggaatgaaaactgtactgtaatgccaggtttgttgttcttgttgttttcttgtatttcacagcagcccttatctagaatcttccctacctgcttcttgcctagtaatttgtgtggcttcagcataaagctgaagaagagggcaacatcttgagttcagatccctcacaggccaggcatctttgatctcatccctggtctagctttctttctgatacttggaattcattcaaggtgctttcaatggttcccattcccaaagaatcaactcaaaaagaatactctagctgctattctcccagaagtagcatcttatttgaagaagagaacataatactataaccgggggcaaaattgtagtaacttggcctaagtgctataatgttgaaaagcatttaagcacccccctacacactgtgataggaaaggacatcctttttcagaattttcccaatctgggcatgcagatgtaacacagtctgcctctaggaaacaaggaaaagatttcactagtgtaaaagctctcctaagcatgacacagggagacttaacaggattaagtctctcaggtggtgccaaacaagttctcattttcacagcgttcttctatgccagcaagtcaagaaacatatttgcagccctcaacaagtttcagggtacagccatatgccagaaagaatgcaagctcaatttagggttttcagctagactggtaatgtgacaggattttacttatgcccattttcaagctatctttaggcaaaatttaaatatgagcattgacactgtttccctttttccgatctgcaagtacctacgatccccattgggggttactcacgtccccctgccctgtcttgtcctgccctatccctgccttcgcagctatctgggctctgccttcttctattttaccaattcccacaacaaaattctgctcatcggtttgacatttggcagtgatccaaggccatttattaatgagtgctactatgaattattgaaagacaatagcttattatgtttaactttatagggtatttgcataaaacttgagatctgaggcagaaatctatggctttggggaccaaccaataccgatgatatttctgggttaagagaatctttcttgagctgctcacatcataccctacggctgtctctgtccttagcctaggcctaagacagaccctattggcatgctgatatgtaaaaagtgtttttcttctgcaaaggagaggctgagaaattatctctttatcccaggtttccccagaagttgaaaagggaatacacatacatatacacacagagacacacacacagacacccagacacactcacacaccaatgtcaccacgttcaacctggagttagcaagacgtaggaggtgagatggggtcagatctacggagaggagaacctgaaatacaccaaagttggcctctaaaggtatgctggtcaatgcacagaccaaatagacacagacattgattctgactaaggagagaagaacttgacataaatgcttaacacaatcctcttctcaagtcccagaaactcacatctatgaataatttgtgaggcagagcctcagccgctaagaggtaaataactaatctgtccgtgacagagcaagacctacagctgcaaagtttgaaaggtataacggataaatcaaaccaacaaatagttcattgaacccccactctgctagactccaggacaggtgctgagcatatacaagtgaataaagcacatccctataaaatgtgcacaaggaaccaagctaaatctctatttcagaaagtttgctttctatttcaagtttgcttgatttgattccttgctctgttcacacgcattgcgtaacagaaaaggtgacccacacatgttggcccagagactgcagaagaatagccaaccatcagacttagtctaaagtgaattagtctgtttcactggactaagcagattttcacaccggatagcaaacccaaccaggttgttaagaataatattcatcagcattaaaactctcagaaagttagtttacagacaactgaactaatgcacatacctaagaaggtctccaagacttcctctgctcttcaatatttgaacctgtattgaattcttgttcaacttacccccaaggttaagataaatgggggatggaacaactatacgtaggcttagcatttggcatcagctatacagtagtgtttttgtataggctgaagtctacatcagttgtaattaatgtaattatatataatgttgacagattatgacatttgcctattaagacactatacaaacattccaataatttgctggcttttgagtttgtaaaaaataaatgaaacaaaatctcaagggatgttgctaatggtgtaactggaagagaggtttcaaaagcacagcgttcaggaaataacagtcaaagaataatgcattcaaagccaaaacatatagagtggtaaatgaatatttagtacttaccacaagactgctgtctagagacagcctttttccaaagtcccttttctcaagctgtctctttccctccatggatgaagttatttattttcttttgtgacttataagaatcccccgtctgtttccagggtcactgaaaagagtgaacatgtgttttactatccaagtacacagtgtttagacctttgtttttaactctctaaccagaaacaagcattgaagtcaaaaaatacccagtcccaaataataagtatagaactaggctctctctactcaaaagaccactccgtgttacaaatgtcagagttgtctttatggcggcccctgtgtttttataggttttgctaatggagttggggaatgggtttgcaggttgaatcagcagactgtagaaaaaagcaaacagtccgtttcatgccacacttgctccacacccgtcctctctctatcagccagaataattctgttactgtgcacatagatgctgtctgcaaattccatgagatcaaaccgacaaaaccacgctctataaccaagagttattgagctcaaggcccaatgaagggaaactgaaacatgaacattgtttaatttaaaaaatatgtaatttaaaaatatttgaggaacattgtaagatacattcctttggggatagattgattcaaaatgaatggtgggtgatgtcattactgtcaatgagtatttatagaacccactgtatttttaccatattagatatagttcatccctgaactccactgagattgctttttctagaatgattaagtattctggttaataaggattcatcatatatgttaagtgccagcttccaattttcacaaagatgtaaaaggcttgaaataaaagaaatgggttacagtaaaggattttttttttttttttttttttttttttgggatggaatctcgctctgtcacccaggctggagtacagtggcacgatctcagctcactgcaagctccgcctccctggttcacgccattctcctgcctcagcctcccgagtagctgggactacaggcgcctgccaccatgccaggctgattttttgtatttttagtagagacagggtttcaccgtgttagccaggatggtctcgatctcctgagctcatgatctgcctgcctcggcctcccaaagtactgggattacaggcatgagccaccgcgcctggcccagtccaggatttcttatccactagccaagtgaccttggacaagtcatttaacctctcagaaactcatttttctcaactacaaaacatgatgatagcaatcaaatgatgtatgggaatatgatttggatgccataaattacaactcatatgtaagttataattacccacagattacatttaaaaacagttaacctgaaatatgagtcaatataattcaatatatccttgatgattcagaaggtgctttgagatatagaaattgctcataatccttgtaaataaacatagacattgtactgctgatgcagaagagatgaaatacaatgctataccaattaactttttaatataattggaaagaaatatgttccacaactctcaattgctccaagcctgacatggatcaaacaggcaggatttcatggcccacaggatgtgggctgtctctcttggttttcctcatcaagagggttgagacagtggtgcctgagatggggaatgcccaaactatagtcaatcatgagaaactgatgggctcatattccagcttaggcttcctcctccatcttagtcattttatctcttactttcaagaacactaatttttaatacatcactggtccactcagaaactcttaagagttcaatcagaatttaggataaaatccaaagttttcaatatcattttctaaaattctaggcagtatttttcagaaaagaagttagttctgtatactgctataggcatgaccactagtcaactgaaatttgtttgggaggctgccttttctactttcagctgttcctgcctactttgtagcattctccctctcccccagtctcagtgactgtaaacactggtagttcagaacaccctctgcagtgatgaaccagctagagactactctgaccctcatatttccctctccaccaaaaacacaccctcctaagtcttgatcccaaagagcatgggagtttgatagctcataatagattgtgctttggcctttagcacatatgcattgagtgcctactgtacagaagacagtaggaataccctaggaatactgtatggaaaacaatccttacatgttagtgacacagtcatgtacaagaaaaacaaagtccccgcctttgtggaactcatattttagtgaggcatatagaaaacaagcaaacaaacagctctaaactgtggtaggtacagtatgaaggaaataacctccagcaggtggtgccaaagtgccaagcggccgggcacggtggctcacacctgtcatcccagcactttgggagactgaggcaggcggatcacgaagtcaaaagatcgagaccatcctggccaacatggtgaaaccccatctctactaaaaataaaaaaaaaaaattagctgggcatggtggtgagcacctgtagtcccagctactcaggaggctgaggcaggagaattgcttgaacctaggaggcggaggttgcggtgagccaagatcgcgccactgcactccagcctggctggctacagagcgagactccatctcaaaatataaaaataaaaataaaaagagagagaggacccatttcttaggaagaaaatagccaggaagagaatgcgtgaaaaaagtcctgagttacaggcaaaaactacagaggcttgtaagctaatgtatctctctcagctcttatgctaaacacaaaggttaatcttaggttttaaattccctaccttactccctactagcaggtaacattcaacaaattatttaacctatttaagcttccactgcttactctatatgacagcattgataataggaccttcttcatagtagggttttctgatgattaatgagacaagccattgaaatagttaggctggggacagatacaggtaggtaagacttaaatattagatatattgatcatcccttctggcaaatatgattaaactcattaaaagcaactctagctactgaactttatgctccttcacaggcagatgaggctgtcattttgggaaatggggatccttttgatagttctcaaatagtccaatctgcctatgtggaaagctgatttaacagctttccaaatggatttggtccatttcttttcatattaatggtaccaataatataggcagatataatattcaaatgatttagcaacaatatggcataagggttggccaatcataaacgtacagtccaatcagggctgacaatggcaacaagcggtacagttagagcagtgtatcctagccaattcccagcctaactacatgtactggccccactccaagaaggtgaaaatttgtgagttagaccataaaacaatcatggaaaggttcagagtaaatttatccaagtggatcaaaggaagactatctaaaagaaacaaaatggcaaccaggatgcagcaatatgaaaaggaacctgattaacaatgaaaatatcagaaaggctgaaacattccattgatcgcactattgggaaaagactacatacatacagcagagactgcagatccaggggggaaatgagtatatcatatcctaaagatgcctgggattacctgggccatttgtaccatccatctaactcaactaattcagagactagtgtcatcaagtaaccttccaattttatttaattcctatgcagtatcacttatagaagaagaatgtgctgaccagcaaatatcagtagacaatcttttgaaaaactacatttctagtgcaaactaaaaatgacagtttgacatcttactctttatatttattatttacctatttggttagcatattagtcagcttgagctgtcataacagaataacacagactgagcggattacacaacagacgtttattttctcatagttctggaggctacaagtccaagatcaagtgctagcagagttagtttctggtgaggcctctctccttgtcttgcagatggacatcttctcactgtgtcctcacatggcctttgctttgtgtgtgcacatccccatgtctcttcctctaaggacaccagttgtagcacgttagagccccacacttatgacctaatttaaccttaattacctccttaaatgccctatctccaaatacagtcacattgggagttaggggttcaacatatgaaatttgcaggagacatggttcagtccataacagttattttcagtcaggtttcaaatcacatctgagtgttctattaatcaaattcctaagtctaaaaaactaagggaaacctccgagtagtggggcttatggtggctacctccagactccacacctctctgcttgttatgtgactgttggatcttactgccccctttccacctcaccttgccctgctgtactcttctctgtattgtgcatgtacagatgcaaacatgatcaagacttcttggtcagtgtgttaatgttgaattctgctaatgggaggcagtgagaggagattagaaggcaatgggaaagaagaagccattctgcttccagctctagcagaacagcatcaacagcaggtgactgcaggctccagcaacttctgtgattcctccaatagatcagctaagaaagggcaccagcaatgccccagtctgtgggtaccgccaccttatccctctggctcctccagccctttcaacaccatcataaaaattccttgcattaaatccctctttgcttgaaacatctacagtaatttcctttttctaggcttgacaatgtttgatgtgcaccccatggagatgcctttggaaaggcagcaagccttccttgggaaatacctggatttgttattgtcagtcttctgaaataatagtctggaattattttctaataaatactaagcctctagaggacagagagagcattttatgttctgtgttcccctaggtagtataacacctaatgcatagcacatgaagaacatttgttgcttgcataaataaatgaatgaatgttcacagctgtctttgtgaacatataaagagcagggcaaaaatacaattttgtttagcaaagtaatactagacacatttacaagagtgaggttgctttttagccaagcatattcggatacacccaagcctcaaagaaaacattttgtcatgattttgaaatgtcatcaacctaaaatctatttacctgcacctacaaagagccataaccgagtagtgttaatgtcttttctatgtcttccaacatctctggttataaaagaatacatatattcctcagagcaatgggttggaggcctctccttccctccgtggggaagaaaacggtcatggagttgaaagaagacaggaaattaagcatccttttattgactgatagttattgatactaatcttcccttccccctcacatacacccatctctagctagtgaaactacttctactcagtatctgtagaaatctaagttggccttaataactcttttttttttttcaattttttctcacagttagtaatggccttttcatgctagacagatttttaacctttctaaagatgtcagtaaattctattttctgatatacttcgttaacaggctgtataattttcaagagagtaacaaaaccgcaccattgaataaaatctcaaaggcatatcccctcacatacacacagtcacacacacacacacacacacacacatactcactcactcagacacacacacctgatctagacaccactttctccatctcaatttctgcctttctgattctgccacttcccatccctgctttcatatattaatggtattgccagaagaaatgcagaaaaacagtaatgccaaaagggctctcttgcttaggcattagaagatttggttcctagctttctttgccatgtaaatttgagtagattcctaacttctctgagtttacattttttatgcttttctcaccaggtcattgtgaggtttcaatgagataatgccccagcaagcttttccacatctaaattcaagatgttttccggtcagcttcgttaagcaacaaacaatgcaaaatataattttttgcagcctcataaacatcccgagaacagagactgtgtcaaattcattgttatattccctgcagcatccaacgcaccagctcccacacggtaggcatgcaaagaataactgcagagtagagcacatcaaggacaaataacaaacacagtaagtttcctgtcgttgacaaggcagctccatgggttttcaccctggttgtaccttagaataacctggggaactgttaaaaaacatatcaatgcctaggtcccaccagatcacttgaatctctggggtataggctgcagggatcagagtaaaaacagccagggttggcaaccatcagttaagagcagtggctgtcaagctttgccgcatgttagatggagtcacctggggagtcattaaggcccatccctagatggaataaatcaagatctctgggggtgggaaccaaacattattattttaagattcttcaatatttccaaggtgcagtcaatggaacaccagtttaggaaggtgaagatgtcagtcttttcttgatctccgtcctcttctcaaaggctgagggacacatgattgttggtagcagcaactacctttccttagccaccatacccaacaatttttaatctgcaaaccctgaccccaaagaaaagaaatgttagatacaaacaatttggataaatacctttatccgtatctccactctcaggctcatcattcaaaattaagctgcttaagctgatccttcttttcattaagaaaacattgttgactaaaggtagaaatattaaatctagattccaagttaatgtacgtatatcataaaacctcagagtgaggtcttcacgtagagtttcagggaaagaacttcaaatggcaagcccaatgttgcagaaaaccatgactcagatgcccccaaacccacgacctcctttcttcccactgctctccatgtgcacctagctctcttttcaaagtgctaccaaatagaatgtttgaaactccagtcctctttgtattgaaatctttttattctgatttattaagtccatagaaaggaaagcactggctttctgtatgctttaaacacgtacctacagcagtctcattttggaagatatatcagctcaataactttctcctattgatacagctatttgtggtataaatgggtaagggtgtgtttgtgcatgcttatgtgtatgtgtgtatgtgttgagtctgcatctgtgcatgtgtgttcatgtgtgtatgagcatgtgtgtacatgcgcatgagtatatgagtgtatgtgtgcatgtgtgtgtgtattcacatgcactctgacaacaaaaccacccccacacagaaaagtgttgtgtccattttgaatatgagtataaaaacatgccaaatgatgtaattttcaaccataaaaattttttaaaatcctaccagccccctgaaactgatttagaagaagattaaatgctaacaaatttcccaaatgtggtattcatccttgccagataaattagtggctggaaatagtctcagagagacatgacaacaacccttttctttcaagtggaggaaaattctgcatgatgttgaaaactggttttaaaaaattgtttcctacattcatgctcactaaacgtctcactaataatattcagtagcttccggttgatggtttcaatgccagacaggcccctaagaatcactttcccatgggcccctcctcagataaatggctatggccaacacagagaactcagggagctgcacaaagtctgggtctggaaatcttgtctatttttcaacatgcagctcagtgaactggagcagtaaaaaaattgctatgaatctgaactaagtttcttaggaagagaggtcagagaagagaggtcagagaaaacttccaatattcagtaatttctctcactattaaaacaaattattgagatataattcgtatatcatataatccacccttttaagtatacaattcagcgtcaacccttctaataccaatatttattcatttgctgcagaaactggggattatgtctcactctcagtggggacacaaagaagtttcctcatcacttcttgaggcctcatcaagccagctgtcccatgtcaccatcatcttgggtagcagcatcctggacaggcctgagttcacattctccaactgccacttacaagttctgtgaccttgagcaacttatttcacatttctttgctctagtttcctcactgataaaattaagataataataaaaatccccttaacaacgtaactctggggattaaaatgattcctgttttaaaataccggagtagatactctgttggtataatcactcaaaagagttccattcattcaaaattaagtaatatatattctatacctattttgtcccaggccctgtgttaggccctgaagattgaaagaaaaacaaaagaagaagggaggaacagagaaagggaatgaggaaggaaggaaggaaggaaggaaggaaggaaggaaggaaggaaggaaggaaggaaggaagaaaggaaaggagggagggaaggagggagggagggaaggagggagggagggaaggagggagggagggaaggagggagggagggaaggagggagggagggaaggagggagggagggaatacatgtcctcaaatttcaaggagacctaaaatgtaagagagggagatttatatattgattagtaaaatgcaagataaaataaacatgtgaatgaacaaatgaacgagcacatgatttgagcaaggaggattcactttttattgagctaaccctggaggacttgcctttattgtcattcctggtgttgccagctgatttccagacacaaactattgctacatcttcaatgtatgaactaagaatgaagaaacagaattgcatgggcttagaccagggtaagcgttttagctctggctgctcttctcaaaccatctgttccttctctcccactcttcctttgtaaagatctccccctgcaccaccactctttctttctttcctctgactcttctccatttattgccttaaggaagatttataatacattacataaaacgtctacatgttgcctgtgaactcctaaagggaaggtcggtatagaaacaaaacagataaatacattttataaataaataaataaaatgtacacataaccccagtggattggaagaatatttagataagtggctagggaaaagaattttcacactgtgtcatctgctaacattaatgagtgaattaaattagaaaaattccactgccaaaagcaaaaacatccaaatatgtgggatgctgggggaattatagaccatgctactaaatgcattctgttcaagcttactttttttttttctttgagcaggctgtggagagctacacttaaaaagccatccaatttcaagacagtattttccatctggggccagttgggtagaatatgctctaaactctgcaaagcctgctgagagacaacacaacttgttaagaaaactgtttatgaaaagggatgttttttgaaaatccagcaaaaggtttaactatgatgtccccacacattgcagaattcattattctccattgaatgtctttgtgcacaagtgaaacaccaaaatgactcaggaaatgagtgcagtacaataaattggaagccagtacatttttgctaaggccctagctggtaattagaatatttccaattacctaggagcttttttttccactttaagaggttattcattcttcatgtatagtaatctccctccacccacccaccccccaaaataatcccgatgtgaaatgctaaaagccaaatcaagattaagagattaaactttaaaaccaattaacatactgaaaacaataggaagaatttttagtgaaccagaaaatatagaatgacattaaagatgtcctaagtaataatggctgccaaaatgaaatgtatgagaaaaatctctaagatgtttatctttttctactcaatgatttaattaaattgagactgatattcatttgttgagagggcagcgggctaaactccctcaaaaaggtaaaacaaggccaggttcggtggttcatacctgtaattccagcactttgggaggtcaaggtgggaggatcacttgagctcagaagttcaagaccagtttgggcaacatagtgagacccctgtctgtaggaaaaataaaaaactagccagatgtggtggcacgtgcttgtagtctcagctacttgaaaggctgaggcaggaggactgcttaagcctgagaggttgaggctacaatgagttgtaataatgccagtgcactccagcctgggtgacagtaagtccctgtctcaaaaaacaaaacaaacaaacaaacaaaagacagtaaactagtcaatgaccacccactaaaatggatagctagaaagtagagttaggttttacacacacatatatgtgtgtatacagacatatatatatatttatactatgcatacatatacacataaatacatacatgtgtatatacacacacatatagtcatttcttttcttctgcttagaatttccacctagttttgagcaataaaaatcaaaacttcaattactgggcctttttttttttcccatgtgtaggttgtttctttttattcaggctttgaaggctcaggaataaaaggagttctatggatatttggacagaccagtgcttctcaaatgcatgcatgggaatcactggcagatctcgttaaaatacagattctgatataataaggctacagaggagcctgagagtctgcatttctaacaagctgatgcttctggcctgtgggttgtacttcaatagcaaaggatctgaaacttaaaacagagaacttatctatgtacatgtaatagcggaattccaagcattttctcataaagctatgcacagccagccagttcttatgatgacttagttctttgcagaatccaagacaactatggcttaggttttgccccatgattctcgtgttacccttcactcaggacatttggaatcctagaatcttaggtttaaatgatgccttcccggccccctcttcacctacccatcagtacggttactgcttctaagacaggcctcactagggcttgcccatctcttcttgccgcttccagtgacaaatgggtcacattgtctttcggaagagcccctttcacatttggctgtctcgaatgcctagaaagtttcaatttgtctcttggattttcacctactagccatagctctgttccctagagcaaatataatttttctcttactcaaggaaaaaaatcccaagtttcttccacattttctcttgtgagaaagtttccacagcccataccctcctagttacagcctttgaaatgttgtagaacttggccaatctatgagataatttttttttattttgtaaaaaacataccatattaaatgcatttattttctttgtaaaagatataagctataacaaatgtatatagagtataatatgaaaattgtatacttttactctccctctttctactcttctccgcagagatgcttttaacagtttttctatttgtttacctatatacatatatattgatttttctctttctatataagtggcattgacatctattgttccgtgactgcatttgttcacctgatatattcaacacctgggcctagttcagtttttacagcttcatagtactataaaacagattatcaataaattgcttattaacttatgggtagaaatttagatagttgtttgtgttttctgattctagaccatcccaccatgagcaagtctatgtatctgttgtgcctgtgtgagtttctctataaagcatagatctcaaaagatggaattatagtgtaaaattttaaatttggttagaaattgactaattgccttccaaaaatatttaagaatatgtaagactacctgttttccatagagttatcatagctgaacagaaccaatcataaagcttttacaaatttgttggtaaaataagtgacttcattgtctgaatttataatccatgattattggtgaagctgggcatctttgttttatgtgtggttatctgaactatttttctctggattgcctacttaaattatttgctcattctcctattgcctcttcctttttgagctctgaatacattttgaatattaactccttattaagagacattgcaaatattttccccccagtctacctcttgtctcttcactttgttatggtatagaatgttataattaatttgcagtcaaatgcatcaatcctttatgcgttctaaattaaaagaccattttccatatgtcttcctaatatttttatggtaccatctgaagataattttgtcttgtaaacctacgtaaagcataggtttaactttatttttaaaagaatataaattcattgattctgtgattaaagtattcctcccacggatttgaaatgcccccaatcataacaaaagtcaacatatgcacaatccttttccttgaccctcaagtaaaaaaaaaaataagctaatctatgcacctgtccttgtgccaatatcacactgctttaattatgagcttttagtaaattttgatgtcatataggccagacttcccatgttgtctgtttggaatttttcttggccatttgtgttcatttttgtcttccatatcaacttgagaatcagctcatcaggtccaacaaaaagtaccatataggtttttattaaattggattgaatttaaatttacagattatttaggagagaatttacatcattatattcttgagtctttccattcagcgacatgaaatgggtagtagattgtttaatggcaacaaattcctcccttcctatgatgcccaactctcttttgaaatgtgtcttttatgctcttctagcttaaggatggtgctcatttctccaccccttgaatctggtagggcttatgaaccttttgaccaatagaatgtggcaaaagggaaactgagttctagcactaggctttaagaggtcttgaagcttccattccctctctatgaaccctcaggctatcatactgagaagaagcccagtctagcccacaagagggtgacagccactggaggagaggtgacagccacaccaactgccagatacctggtcaaggccactgtgaacccaccagctatagtcaaatactgagataaacagaggctgatgagtgattctaggtgagaacaacaaaagaaatacacaggtggtcatcccatggaatcaggaggaaaatcagtcattgttttaagtaaccaacttattggggtggtattttgggcagcaacagataattaatttgggtcactgtgttgttcacatccttcagtaaaggatgtgaagactgaaagaaaaaaaaggaagaagggaggaatggtgaaagggaatgaggaaggaaggaaggaaagaaggaaagaatgtaaacagcacaatgacccaaattaataaatattttattaataacttatttattaatagttattgcattaataaattacttcaatcattaatttattgaattaataagctaattcaatagcctttgggcataatttctttagatactaagtatgttttattactcttgagaattatttacatttttttctacttactttttctaattggttataggcagtgccagaaataagcctattgattaataaactttaaacttctgcttaggtaactttctgagcactctttctggttctaaatgtgcttatttttttctactggatttttttacatagaaaattgcaacgtttttggcttttcctgtccgatacttacaagtcttgtttcattttctggtcatacagcattgaccagggaagcaagtttttagcagaaacttttgctcctgacttcagtagaattagtagtaatgtttttatccataagaatgggattgatttctttgtagctaccaattaccagattgaggaatttttttatacattcttgaatctctatagtgctttaaaatgtttcatttttaaaaagttaaacatactgaaaagtacataaagcaacagagattcatgtacctactaccctgtatttaacacagattaatcttgtgccatatttgctttaatctttcctctcttttaagtaataaaagcactgtagatgtagttgtagccccattcccctattctatcctaccttctctccagcaatagccactcccctgtagtaggaaagcattcttgctgtgcataaattatatttctactgtgtatgcataaacctagaacgatatacagcactgttttatgtgtgttttagtttatgtacatatgatagtctactttctatattcagttgtaattgtttttcacttaatgttatagcagcaagatttatccatgctgataagagaattctagtttatttttaaatactttaggaatcctattgaatggacttaaaacggtttaccccaattccaaaagaatgggtattagttgtcttacattttttaccattttcacattgcaaacagtaatgttgtgaacattcttgttctggcatccttggatcagaggcagaagattctttctcatatggggaaatccttgggtcacaggttgtgcacatgtttgagtgagaaggcagtgccaaattgctccccaaaaatgactgtactgtagcaatttatacttatatcacccatgttaaaagttcttgtttttctcttttattgaaaataaatgctcggttatttgggtagttggatcagatgggctctggcagtgctagatgaaagccagtgcccccaccctgactggattactgtttcctttacacatttattcagggttcctcctataagaaggagctacatttgacaggaaaatatcaggccaggcattagtctttctgagttcttcctttatttcagtatatatgtaatttttattgcctgcctgccacccagaattctttaatttttccccctaatttcacccccttcactatgaaattttaataccacagatttaccgaatatctgtttatgtacagatatgtgtggcttctgaaaggccatggactattatgatattttagtatttttcattgtcccaagaaccaatgctcaccttcattgagaatgtttctaagatccaaaatacttgcaggttcataatttttcagaggctagagggaggtggagcacaattcaacttgattctcttacataatcagcagggcttgtggctcttttgatcaaagaatgtggtaatagtgacaatgagttctgaattatttcactaggggcacactcatttaaagaagtaccttatggggaaaataaagagctgagtaattgggctaagtcagagattgcaaacccaaatgactaatatgttgggaaggtaacgtaaatgcgtgaagccgcccctgggagctgtgcccatctgggcaggacccatgcaaaaagggcagctggcatccaattgcagctaaaaaccaccatgcagaaaggaaggttcactttaccaaactcttcagtttttcgagagtcagaaatccagatcatctatgtaaaatctctcaatgtttgaagattagttcggtttttaaaaagtagttcacaaaccaatatctctgagaagtgtgcaacctatagactacactttgattacatgagttcttataaaccttcctctttctctaaagtttgatagttatttttaaagtttgaattaatgtaaaaccccaagaagaagagaagattgaagtctcaaatatgaacacaaaaaaactaggtacaggaaaggggaaggcagcctaatttaatttcccatcacctgcctgtgcaaatggaagaaactctaactttctattcaaagatgatttactctccttttacatgaagtcaaaatgtggaagcaattatcataagttatagaaataagttctgaaagcacaaaggttttttcttcttacattaaaattaaaattaaaatattacttgggttactgaataatttttagatattcatatatgacattgcagcccagaaatttgaaagtctctccttcaaagacaattttatttatttctttaatttaatagattacctaaggtatgtaagtacatgcctctgtaatctttcagttgtctatatgtctttctttcttgttagttttattatttgtctcctacacacacacaaaaaataaaattcaggtcacatatggatattttgacctggattggatatttgaccaattatctgaattatgaccacatctatacgtcacattttgctgtgtagatggtttcagtggaggttagaaaaatgttgatccattttggaaattaaaatataaggtgtgtatttttggttccataactacctgtataccttctgacaaattaatttctctagtcctcaatttcttaacctcacatatagagaaaaatgaagtaagcaatctctaagatccctttggccttaaaatattttgatcaatatcacaattttaaaagaatttaatgcctttaaattcattgcatctaatttacagctttattgaggtataactcatataccataatattgatccatttaaagtgtacactttattggtttttagtgaattcagagttgtaccactagtaccataatctatttttagaacatttttaacactccaaaaagaaaccccatacgcatcagcagtgcttctccatcccctaccccttacccagcccccggcaaccattcatctacattctgtctccatggatttgtctactctggacacttcccacacatagaatcatgataagtaatctttgtgactaacttcttccacttcgcatcatgttttcaggaatcatccatgttgcagcacgtggcaatgcttcattcctttttgtaattgactaatattctattatatgggtataccatattttatttatacatttatgtatatatttaccagtattggacaactgggctgtttccacatttttgttaaaacactcctgtacaactttttatatggacatatgttttctttactcttgggtatatacttaggagagaaattgccggatcaaatggaaactctgtttatcagtttgaggaaatgccaaactgttttccaaagtggctgcatcattttacattctcaccagcagtgtgtgaggattccaacttctccacatcttttcaacagttgttgctgcccaccttctttttttaactatagccacttataagtgggtatgaagaggtatctcattgtggatttgattcccatttcccgaatgactaataatgttcagcatcttttcatgtgtttattggctacttgtatattgttttaaagggttatgtaaaactagattcaggagatacatatgcaagttttgtttcatgcatatattgcataatgatgagatttgagtgttaagtgtacccatcactcaaacagtgaacaatgtacctaataatttttcaaccctcaccttccacctcccatcctccctccctttggagttctcggtgtctattatttccctctatatgtccgtgcatacccattgtttaactcctgcttttaagtgagaacatacgatatttgattttctatttttgagttatttcacttagggtaatgtcctccatttccatccttattgctgcaaaagacagtatttcattctatttcatgactgcatagtattccatggtgttgtgtgtgtgtacatatgtgaatatatagaatattttctttattaaatgattcattgatggacacttaggttgattccatatctttgctactgtgaatagtgccaaaataaatatgatataatgacttattttcctttgagcagatacccagtagtgggatttctgggttgaatggtagttctagttttaattctttgacaaatctccatactgttttccatagaggttgtactaattttcattcccaccaacagtgtaaaatagtttccttttctccacatttttgtcagcatcttttgattttaaactttttagtaatagccattctgactggtgtgagacattatctcattgtggtttggatttacatttctctgataattagagatgttgagcattttttcaaatgtttgttggtcacttgtacgtcttcttttgaaaaatgtctgttcacctcctttggccactttctaatgcagttgttttcttcttgctgagttgtttgagttccttgtagactctggatattagtcctttgtcagatgcatagcttgcaaatattttctctcattctgtaggttgtctgtttattctattgtttatttcttttgctgtgcagaagctttttagtttaattaagtcctatttgtctatttttgttttgttgcattggcttttgaggtcttagtcataaattctttgcctaggcctatgtccagaagagtatttccaaggttttcttctaggatttttatagtttcaggtcttacacttaaatctttaatccatcttgagttaatttttatatatggtgagaggtaggggtccagtttcattcttctacatatggctttctagttttcccagcaccacttatatattagggtgtcatttccccattgtatatttttgacaactgtgtcaaaattcagttgattgtaggtatgtgcctttatttctgggttctgtattttcttccattaatctatgtgtctgtttttgtaccagtaccatgctgttttggccagtatagccttgtagtataatttgaagtcatgtaatgtgatacctccagctttgcatgtctttttaagagaaatatctgtattccaaatatcaattcagatttttgtccattttaattgggtgatttggtttttattattgagttctaagagttttttttatatattctggttagaagttccttgtcacatataatatttgcaaatattttctcctatttcatggggctttttttctttcctgctaatatcctttgaggcacatttttttttaaattttactgatgtccaagctatctgtttttttattgttgcttatggttttgatgtcagatctgaaactattgcttaatccaaggcagtgaagatttacttctattatggaagttttataattttagctcttacatttaggtctataattcattttaagggtttttttggtaggtttgagataggaatccgaatttcctcttttatacatgaatctccaattatcctaacattatttgttgagaagattattctttttctcacagaactgttttggctcccttgtcaaaagtctattgactataagtgagagaattcatttctgcactcttaattctctacctgtgatgtatatgtctagccttatgtcagcacagtactatcttgattactatagatttatagtaggtttgaaattggaggtgtgaatcttccaacttcattctttattttcaagatgatttggctgtttttgatatcttgcatttccatatggaaattcatatgaattttgagatcaacttataaatgtctgcaaaaaaatccaactgggagattgcattgagtttgtagatcaatctggggagtagtgccatcttaacaatgctcagtcttctggtccatgaaaatttgatgtctttccatttattcaagtcttaatttctttcaacaatgttttataagttttagtgtacaactcttgtacttcattttctaaatttattcctagatgttttattctttttgttctatcataagtgggagtactttcttaattacagtttggattgtttattgcattgtatctccttttagcttcaaattgaaaaactagttcgtatttccttcattcattctaacttttttgttctttgctttaaaagatgcatttttattttagctgtaatatattttctagttttatttttaaatctttttattaagtcatgaaaagactcatagggttgtatacagtatatctgaattaaacaaattgagatgcttagcctcctcaattaaatcacttagaataaattataagacttccatcatctttcaccagcactcattaaacacttcctaaatgtacaaaactaacaatatcttagctgcccacatttgctgacaatgcatgcaactccatcaacaagcaaactgcatttaactcctataacctcagaaaaacacagttattaagagaccaaaacataaataccctcatcatttcaagcttgttgcttaatatttgcatttcattccattaaaggaataatttccattgactgccaaaacgaacaaaccattgcaccataaagccacattttaattttactttaaggggactccatgcaaacccttttgaaggcactactctactattgccttttaaaattatgctaacattgttgaaggtataaaatataattatttgtctcagaagagaaataaaagaaattgtggttactttgtcttttccttagaaatataatatgaattcaaactaaagaagtcaaattaggtgagtggctcttaaaaactttgagaatcaggggaaattaaaatacatttaatttgcagagatttttttagcctaatttgaaggattcttgattattctaaagccaagccatggaagaaatggacctcaaagtaaaaatcttccataaaataatagttgagttagatatgcaacttttgtaggtaaattccctggcatatatgaacaaataaacatttctgtgaacaaaaaaaaaactgagctcagagaaggaaaaggacaccgaagtcttggacctactgacttctgtgtccagagggacacaaaaatgggaaagagtttgacatcaagtatacatcaggcaccaaaagctttccataaatgttgggagacaaaggccagccagcttacttcatgaaaacatagtctgggaaaagggtccctcaatcttgaagaaggattgtgaaaactaattactgcctggggtcacagcttacataggatgttgatctgcatagtagaaggaaagacagtctgaaagataggtcttgaaccaagtcacttgatagctcagcttcatctgagatgtacctagtttttttttggtttttttttgtggtttttttgggtttttttttttttttttttttttttttgagacggagtctcactctgtcgcccaggctggagtgcagtggcgcgatctcgactcactgcaagctccgcctcccgggttcacgccattctcctgcctcagcctcccaagtagctgggactacaggcgccagccaccacgcccggctaattttttgtatttttagtagagacggggtttcaccttgttagctaggatggtctcggtctcctgacctcatgatccacctgcctcggcctcccaaagtgctggaattacaggcgtgagcctccatgcctggccccccagttttatattatagaatagatgcctcaagtaactcataaaacctagttctagttggggtgtctggtaagcttcccagaggcatccataaatcctctaggtgaggagaagtgtgcacagagatgagaggaagctccaattcaagatgaaattgacagtttaaagcacacaaaactaagaagacaagcaaaataaaaaatacagataattcaacatcaaacaaacgaaaacaatgaaaagctaaaactgacagtaaaaagaaataaaaaccaaaacataaaatagaataccaatcataaaaaggatgagaaatatgatacaagaacaggcaaataagaaacaaaaacaaatgtataggaagaagatctactataaatctacagaaaaaaactacggtctaaaatgaaatgccaataagacaaaatctagaaaagacaatcaaagggataattaatgaattaaaaacttatgctgatgaatccacctagaataaagcacagagagaaaagttgaagagaaaaaatatccattcaaagtctccaaaatgtatccaaggaattctgaaaagagaaaatagaataacatagaacaaatatcctaagagataagggctgagaaattttcaaaacagaagaacatgtgaaaaatactatacaggctgggcgcggtggctcacgcctgtaatcccagcactttggaaggccgaggcaggcagatcatgaggtcaggagatcgagaccatcctggctaacacagtgaaaccccatctctactaaaaatacataaagttagctgggcgtggtagcacgtccctgacagtcccagctactcaggaggctgcggtaggggaattgcttgaacccgggaggcagagcttgcagtgagccgagatcacaccactgcactccagcctgggtgacagagtgaaactccatctaaaaagaaaaaagaaaaagaaaaatgctatgcatatcaacatgtatactattaaaaccataaaaacctcaagtgaaagacaaaatcctaacacatatgagagatgttttttaaatgacataaaatgaaatcctattagagagctagactgccaggatatttctagttagcaaaaattaatgaatgaacacaagacaatgatgtaatcaaagtgtttacagcaaataactgtgaacttagaatttcaaattgagctaaaacataatccaagaatgagggaaaaataaaaactttttagacttactaaaaacacacgtttttaccttccccagacactcactaaaataatgaaggatatactttagcaaaaaatgagagagaaggagtagaatataggagattgcagtaagcaaagacatggatcaaacatgtttataaatctaattatctattgccattaaaaatagcaattgaaggccaggcacagtggctcatacctataatgccagcactttgggaggctgaggcaggtggatcacctgaggttgtgagttcaagtccagcctagccaacatggtgaaaccccatcactgctaaaaacacaaaaattagccaggcgtggtggcatgcacctgtaattccagctactcgggaggctgaggcatgaaaatctcttaaacccaggaggtggaggtgcagcaagccgagattggctactgcactccagcctgggtgacagcacaagactctgtctcaaaaaaaaaaaaaaaaaagaaagaaaaaaaatcacagtgggtttcaatgggtaagggaaacacgataaggtcttagtgttatttttaaagggtataaagatactaaataaatcttattctttgttataaatatataagtattttatatatatagacattaaaattaatatgcatgtcacaaattataaggtaaccactaaacaaataacaaaattatcaaatcaaatccaagcagaggggtagaaataaaaaacataaaaaattaaatccttttgaaggtaacttcatgaatttttgtctcattgtctttcctactttgttaaaacttttaattgaaaaatataatatgataaatttaaaatcacaatattttaaatggaaaagagaaaagtaaaaggattcaactaaagttgggaactacataaatgagaacaaaacatgagagcaacattcacagagaaaatagcctaatttagtaataaaattaaatcaaagatggctacaataatttaaatacattttatgcaatatatggtaattacatcacgatccttcaaactcattatatgctcatacagcctttagaaaaatcattgccaagattatttaaagaaacattcctgactgtatacataatatgtggactggaggcaaagaaagcatcataagcatctttgctcctttaggacttggctgagttctcagcaatggtagacagttaataattttttgttgaataaatgtttgccaaaaaaaaaataagaaaaagagtaaaacaaaaaaattagtgttaacattgggctgtaactacatgatattgactaagaagtttataaaggagatttttttttttaagtgtcagatctttcacaaaatagagagggctgggagctaggctgaggactaagtcgccataaacaatgccccaaaccactttgcaaaactaggctgaggaggaagctgctactgctgctgcctccaaaacagtttctcccatgaactccctcaataaaatgtccccacctgttcaataaaatggaagggtttgcacgggattgtttgcacacttgactcacttcaggactgaattctctcacatggtacatctggttggtggagctgagatcatatgcctgcatcccagttgtgaggctgaaaatttgagttctggtttcaatgttggggaggagatggttatatcatggggatgtccctaaacatagaaaagctgttcatgagatcacaagcagtcacgaacatgacgaatgtctatgacaatacagttacaaaaatgggaatgcatactccataattctccacctacagctacgtactaagtataatttaatgtcattaagtattcttccacagtaccatatttgaggactgcccagtatctcattaattggatgtcctataatcctataatgtgttttagctactccttattggacatgtaggtggtttccaaattatagtagcttaactttgggaaaatccacgatcatttgcttcaggtaaacggggagagattgctaatgtcctccaccactaccctgtcatcccacgctatccagttttaaaccttccttagccttcaagtagcaaacctcagaacatgccgccatatttcacagtgccagtgaaatcgcagttctcctttcctccctgctcacataaccagcagtggctccagtgtttgcacagactaccttgacatcttttacactgtgatcttcatcccatcaccatttgaggggtccatctgaatagctatgtattacgttcttgtcatctcctggaaattcttaaactctgcagactatacttctgatactcccttcacgataaaatctgaaggtcttctacttctggtgcagtattggcatatggataaaatcaggagttttaaggtggtgatataaaatcacttaagttagcttctctggtctctacttttcttatttataaaatggaaataacaacactatgtataccataggtaggatcataatactatttaccttgtagattgttataagtattaaatgagatcatttatatgaagtatgatatggtttaaatgttttgtcccctccaaatctcatgttgaaatgtgacctccaatgttggaggggggacctagtgggaggtatttgggtcaaaagtgtggatcactcataaatggcttggtactgtccttgcagtaatgtgtgagttctgattctatgagttaacatgagatctggttgtttaaaagacctggggcctcctccctctctctcttgttcactctctcgccatgtgatataccggctccccctttgtcttccaccatgattgtaagctcctgaggtctcaccagaagccaagcagatgctggcaccatgcttgtacaaccagcagaactgtgacccaattaaacttcttctctttataaattacccagcctctggtattcctttatagcaatgcaaaatggactaatacaaggtactcagcacagtaccaagtaagtgtacgagaaatgttagctattcaaagtaaccagataaaattgtctctttttgtaggtcactggaagcttcacatccaatagtattatttcagtctgatattatcactcctaagtttcaaaaatgaaattttcatcagcaccaaaacctctagtctattgactagcattgtggccccaggcctttggctttctccatctttatttcccctgtgggaaatgaaggtctaccaaaagacctacaaaatctaccaaatttggggtctagaaaatcagcctcacatgctccttatgaaaactgtatctttatttccctaaaaacaatcaatacttatttcttcctttgtgtgtctacaacttgttccccttctggggtacttcattcagtcttggagtattacagtgtggactcacaagcaagtggtaggtgtttgcttgtctgtctttcccactagattggttcccctcaagaacagaagccacagctcatttatctggttatctctatcccagtactgaatatctagaacaagcttatcttgtttgaaatgaagttaaactactgagcaatggatttctttgcaaataacttatgctgcttcatgactacttagaaatagctgatgatttgtatcttaacagcgttgatttgtatcttgaattaaaattgccatgtctggaaactgatgcacccagagaaaaactgagatttcattcctcttttatattacctttggttacctcaggttacttatttggaaaaaaataaatctctttttcattattccatgaaacattccttcagaatattctattattaaaatatatacaaatatacacgtgtatacacaaacacacacaatatatcattctttttaaaaagtaatcatgaatatcttcttaaagtaaaaagttaaaattatgtagaaacctacatggaaaatacatgtacttatttaatatgtaagctttttaataaacataaatgataccctattatacatatttcttgacaatttgattttttccccacttaataatatgtcacagaggtctttccatgtcaagataccaatagctcttcttcaattctttaatgatgactcgggctccatcgtgtgaatggagtattatttgtttgattttttccttccctgttgatgggcacttcactgacaaataacttatcactattacagatgctactgcagtgtgcattcttgtgcatgtctcttcacacaaatggatgaactgttttctaggataaatagctaaaggtgccctttcctttcaaatacaaccaaatttctattaatctaaatcactgtctccttcctgttctatcccaatgattacttatactttcagttcagaaaggcagagaatgatgcccacaacttcccagaaatgtaactatcagccttcagaatcaaattcacatctcaaagtctctcctgcctatagaataattcatttgcaagccactctgatcaatatcattaacccagaactcccatgaccccatattattcacagcctcatcttaagggtagttctccatagttttgaaagtctgtttaaggcaggcaggaagacagaactcccctgggtccctacaaaacgagggcttatacaaagtcctgatcaggcactgggagggacactcaaaaggaaagagatgtagaaccaaataacagaggcagctagtgtggacaatctcaagctacaatcagttttttcttcatctatttttcttcattatctcttttagaatattaaactttttgctcatgctattcttggcaagattgcctgcctagttctgcttgaagtcagtgtggcaggagatgcagaaacagccaagttgggtgaccaaattcacaaggtgcacctagctagcggaagctggctgacgcgtttggtcctctacttccctctgccaatagtttgcgcagatttaggaagctgctgtccaaggcagagagtgaaggagatgacggaaactgaaagacaggtatgacctctaaaaatatgcatatttgtttccattgatcagcatcatgatacagagtttgataggctgcctatctgcctgtgggctctgccatcccacaagggcaggctccaagtcgaatctacctcagtggttaccgcacctagcacccactactagatctaacaatctaccttgttataatgctttcattggcactcactaactatgtatctacctggcctaagaaacaaaattgaaacattttgaagttatgtgtgagaatttcgtaccttacaagaagatagcatagaagggaggaggggagaggcaggattcgacagtccaaacgcttatcttttacaatgataaaagatacataatggcttaagcataatcccaatgacattggagaaaatgatacacaaacctcttcatcaggaaaatactgttgtttttgtagaagattgataccgtttgctaaaaatgccctgaaattattttggtttgttatggtactagattcgattagtttaatttggaaatctgagccggaacaaaataatagtctggttttgtctaactgaaagggcaaaaccagaaatgctgaaacacaaatgcattgctcatatgcacacacacaccccccacacccccgccttgcatgtgtacgcacacacaaacacacagactcagaacacatcttaaccatgcccaactggctgagctcagatcttcagatacagtgaagtacatccaagaggaagccaaaggtgaaaaagtgcccccactgaggagtatctgagtgaacagatttgcagaaaggacaggagaaagagaaagagtcaggaaactcattattgcccaagagattatgtattttcaaaacggtagaaagggcttaaaaggagtatttagaagagtacaatttatcagattttccacaatgactgcctctgtggaacttccctggagcattcttcagctctgtgtgataaacctgccgtcctgctcatgtatactccacttaccagatatacaagctgcgctatagagtttcaagggatatcacgcgatgtgtgctttgacataagggcacggttatcctgaatgtggctcattcagtggggctttggaagagcagagggcagtgctcaatgattgagggatgcccccaccctgtgcctagaatatgcctgttcccagcaccagcaggcaaaaacaaaacaaaacaaaacaaaaaaacaaaacaacaacaaaaaaaacacttggtgtaaaaccatttcaggcatatgaaaactctgagagacataatgagccctcccattaattctacaaccctatctaggcattctgctaacctggaatgcttgggtctaggaaaaagagcaattctttgtccaatgcttcaaaagattgagaaaggggaggagccaagatggccgaataggaacagctacggtctacagctcccagcgtgagcaacacagaagacgggtgatttctgcatttccatctgaggtaccgggtttatctcactagggagtgccagacagtgggcgcaggccagtgggtgcgcgcaccgtgcgcgagctgaagcagggcgaggcattgcctcacttgggaagtgcaaggggtcacggagttccctttccaaggcaaagaaaggggtgacggacgcacctggaaaattgggtcactcccacccgaatattgcgctattcggaccggcttaaaaaacggcgcgccacgagattatatcacacacctggctcggagggtcctacgcccacggagtctcgctgactgctagcacagcagtctgagatcaaactgcaaggcggcagagaggctgggggaggggcacccgccattgcccagccttgattaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcatgcagctggagatctgagaaccggcagactgcctcctcaagtgggtccctgacccctgacccccgagcagcctaactgggaggcaccccccagcaggggcacactgacacctcacacggcagggtattccaacagacctacagctgaggttcctgtctgttagaaggaaaactaacaaacagaaaggacatccacatcgaaaacccatctgtacatcaccatcatcaaagaccaaaagtagataaaaccacaaagatggggaaaaagcagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtatgactagaataaccaatacagagaagtgcttaaaggagctgatggaggtgaaaaccaaggcttgagaactacgtgaagaatgcagaagcctcaggagccaatgcgatcaactggaagaaagggtatcagcaatggaagatgaaatgaatgaaatgaagcgagaagggaaggttagagaaaaaagaataaaaagaaatgagcaaaacctccaagaaatatgggactatgtgaaaagaccaaatctacatctgattggtgtacctgaaagtgatggggagaatggaaccaagttggaaaacactctgcaggatattatccagcagaacttccccaatctagcaaggcaggccaatgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaacagagtgggggccaatattcaacattcttaaagacaagaattttcaacccagaatttcatatccagccaaactaagcttcataagtgaaggagaaataaaatacttcacagacaagcaaatgctgagagattttgtcaccactaggcctgccctaaaagagctcctgaaggaagcgctaaacatggaaaggaaaaaccggtaccagccgctgcaaaatcatgccaaaacgtaaagaccatcgagactaggaagaaactacatcaactaacgagcaaaatcaccagctaacatcataatgacaggatcaaattcacacataacaatattaactttaaatgtaaatggactaaatgctccaattaaaagacacagacgggcaaattggatcaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccaggttcataaagcaagtcctgagtgacctacaaagagacttagactcccacacattaataatggcagactatacattttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaatgagaacaaagacacaacataccagaatctccgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaatcaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcaacacatacattctcccaagactaaaccaggaagaagttgaatctctgaatagaccaataacaggagctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaacatgatcaagtgggcttcaaccctgggatgcaagtctggttcaatatatgcaaatcaataaatgtaatccagcatataaacagagccaaagacaaaaaccacaggattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaattcccattcacaattgcttcaaagataataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaatggccatactgcccaaggtaatttatagattcaatgccatccccatcaagctaccaatgactttcttcacagaattggaaaaaactactttaaagttcatatggaaccaaaaaagagcccgcatcaccaagtcactcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaagaaatttacaagaaaaaaacaaacaaccccatcaaaaagtgggcgaaggacatgaacagacacttctcaaaagaagacatttatgcagccaaaaaacacatgaaaaaatgctcatcatcactggccatcagggaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcgtgtcctttgtagcgacatggatgaaattggaaatcatcattctcagtaaactatcgcaagaacaaaaaaccaaacaccgcatattctcactcataggtgggaattgaacaatgagatcacatggacacaggaaggggaatatcacactctgcggactgtggtggggtggggggaggggggatggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaaagaaaaagaaaaaaaaaagattgagaagcgggtggggcaagccatgagggggaaagaaagcagatgaacgaacactctttttacagaacaaatccctttcttatcagttcaaccatcaatctttagttttctgaacactgttgctatatgctcaaattgtccaaggtatgatgagggcatgaagcaagtagaagtcagagcccaagttttaaaaagttttactgttgtcagggaaacaagattcatgcacattaaaatattagagtacattctttttctgtttatgtacttatttccaacctcattcccccaaaggatttgtgattacttacaaaaatacacacaaaaaccaaatgataaaataaataaaaagtaaacgggcaggatataagtgggaaaataataaaactatggtcaagataaatacaggaatatacagtatgctgtccagactagaggtggactataagttttgaaatccttaagcacaggcagtaaatcgcactgggcgctctatgcagagccaactggtatgaatatggcagagcaatgagttgccaaacctagctgtccagaagtgtcacttattaaaggcttccaaaaactccataatgaacctgaattcctggggcaggcaggcagggaaggaatgctgggaatctgcatttttaatgtcgtcagcccaaacttgggaaccacaactgcagggatttggaaataggggttgaaaaagaactcaaaaaatcagattccaggaattacggtggttgtggatctgaagcagggcctctaaggttagatggagtttaaataggtggagatgatgatagaagacattcccagtagaagtgtgggctagagccaaatcacagaagcaggaaggagcctgaggccatgaaggagacagcatcatccctagtcaccctggagcagtagtaaggggacttaggacactaatttattgctcaacccgctcaattttgatcaaatcccaaaaataattaaagaggctatatacataataaatgagttatatacagaaatagagatggtaagaatgtatatatttgttatctattgctgtgtaacaagttaccacaaatttagtggcttagaataatacacatttattatctcacagtgtctatgaaccaggaatctgagcagagcttagctggaacctctactcagttctcacaaggctaaaatcaatgtgtcaagtgtcagacctcaggtgtctgggatctcatctgaggctctgggtcctctcccaagctcatgtggtttgaggaagaatttatttccttgcttgtggctgtaaagctcatgatgacttgcttcttcgaggccagcagcagaatctctgaggcttctagtttctgacctgtagataatcttttaaggagcttgcctgatgaggtcaggcccacccaagaaaatctcctgtttttattcactcaaagtcaactgattagggaccttaattatacctacaaaagtccttccacaattgccatataatgcagtctaatcacaaaagtgttatctgttatattctcaggttctgtcctcacttggggagggaatcgtacaatggggacctggatcttagtttccatcttaaaattctgctttgccacaaagtacaaagtaaagatgagagaaaaatgttgcaaaggtaaggtatatgaaccaacagaacattggtaattacacatgtcaatttggctctgagcttcccagcagttgaagtacaaaggagttatgacccagtgatttcttagtactctgatcagttcctagtactgacttatacaatatatttctcatgtctattagaaatcatgaaatacagcatcaaaataaagtgaaagatacaaaatgaagtcagatggaatttgatccaaaataactctttgccaagtatgggatatgttgaccctaccgatacaatgggaaattggcaatgacaagaaccaagttcattggggtgcttggtcaatatcaggtaccatgggctggtgattggggtccctataaaagaaatcagctgtgaagacataccaggagttgttccaaggcaaggggggaaactgaagtcacacatgaactgaagttacaagtcagaggtatctaggtgtggaggagatgagagcagaagttgaagcactgcatagctaccaaagaatcttgcagaaaggttaccctttctgcaaccttggaagtgttcttgttgtcttggtgttatttggccacctccctgtggaacaacttttccccgggacatcttaagggcatcacttgatctctgtcagagctgatcaaacatctctgctttgctttacaattctcataattagttctaagcattcggtagcatgaactgcttcaccctgtgttccattgggactctataatgaacctgcttttgcatgcaaaatgctgttctttcttccaccgactaacatattatctctttttatgacctcactcaattccaccactgtctcccttccttgaatggctctcgtctactcacagagtcagcactgtctgtgtaattgctctggcttaagtctggtcttctacaatctgactatctggtccaccacaatgtcctcttcattttctttcgtgttcaaatttccctggagctcactatattgcatatacaaggcttatagatcaaaaaagccttggaatcctccagctcacctgcctttgcaatgaagcccattccagcattgtctgaggacttccagggaaaagaatctttttcataagttctcaccttgtttctaaatgaacaaaagttcttcctaatattagaccacagtaacttctctttaacttccattcttagtcatagtgctgctttcttgagtaaattaaaataccacacttcctttcatatattgttcctgggagtataaattggtataatccccttgaaagactgttgggcattagatctgagatactctattattgctatgtgtagcaattacacaagcactcttaacatatatgtgtatatttgtttaccaagagacatgagagacatgtgccagcatattcataatagaactatgtgtcatggtccaaaattggaaaatatccaaatgcccatccatagtaggaagactatatggtggcagagtcacacaatggaatattatacaacaatgtgcataaagttataattaaacacagcaatacagatgaatcacacaaacataatttgaaggaaagaagccagacacaaaattacacaaaccgtatgattccaattagataaagtacacaaaaggccaaattaatctaagccactggaagtcagtatggtggttaccttagagaatgtgactgaaagggaatttgaggaaggcttctagggtgctggcaatatttcttgttttgaggattagtgatatgggtatattcagtttataaaaatttatcaagctttatacttaggtgcaattatctgtatgtattttatacttcaataaaaaaggttaaacattttcctcttccaaatgtcccaaataaatctaatttatttagccatttctaatatgatatggactgtagaatgttcacgatcctagccacctacttataaaaacttttcatttgtcaaacctctgatcattcatttggaacttaatcctactgattggtgtgtagtattctttaaacgccccacgtgggattaactccttctccccactatgttatgaaacccataaagataaatgttttcccctttgattttccagtagcatgtgtattcagtgtagattgtacactaagaaaatactcatcttcccttctcttccttagcaagtgcagatgaaagtggagattgaatttacataggacctatttgataaaccaattcaagaatctttcttttttatttcaatgaaagtttaatgctaatgtattcagtgaagccaagttttattttgcttattttgctctctgccctcaggctgattgaggagtgacctttgccttgatttatgacagacgtttgggtatggagagatggagactactattaagcagatccctctaaaagatctgagtaagtatttcttatttccattcctctcatcttcattattcataaattcttccaatgtctgaaacccttccttataattttctcttctcaagaaggaacatactcatttggacaatgagacaatgagaaagaagtcttcttattcctgtagttagtggtatcatccttcctgataagctcaatagagggtaaaataaatgagcaacagaatacaaaccacatgcctagcaatggagagaattctaggttctaaataatgaaatgaaaataatatttttggtgctgataatgctcctggccgatagcttgtctttccaaaacaaatatcataagagaaatctgcagacattcacatcatgaatgcggtttttctctctgcacacacactcatttgcacgcttggcacctggaatgcttggttggtacacagtttgctgaaatttcctttcccatttggcacaacttttcctagataacattcatgagcatcagtcacctccacaaatagcaaagagagaggccagcttcttggccacattcatattcctgccaccaggacacctttataaccatacttcagactacacaagcacagccctcgcctgcccaggttttctatgtataaaaagacatatgaacgaaagagagagagagataatgaaattatgagtctgcagattcttaccaagcctgttgaggaactatctctacaaaattgaagacatgtcagtcccttataagatcatacaaaacatagagggaaaatctaagaaagctactcatgcagaaactatttaatcaaaggagaaagacaattataacatctgttaatcttctgtagaggttataattagatgctttggagaaacaccctttcaagggtgatcctttaacatctgttgtgaggacacacagcattgtgcagtgacgaatcacctcggcactttgggaaaacaggggactactgggatcacagacactgccagggtccccaggctgcccttgcatgcagcccagccctgagcccactgccctgaggtgggggctttcctccttggtgctttgataattgcctgtgttgtgaatcaggctgcaatcattgtgtgactatgaataacaggatcacagcactggaaacggccttgagaccatctcatcttctcccccttcactttgcagatgggaacacttgatcctatgtcctttagctggctcatggcaggattttacaaatagaattgttcaatctctctgttcagattactctccactctaccatgctgcttgctccttttggtctccctttcgtttggcctgtaatgtggatgtgttctttgtttaatgagatgagcattataataaagtcctagggcatttgaagattatggagaggtggtctttttctctggtctctggttcattaagagacactgaccatggtcccttctttgctctggagaggaggaggaggacgagcagtagagataaatgaagatgaggagggagaataagagcaaaagggaggagaaaataggagaggtgagatgcaaatggtgtagagggaagaacgaagacagaagattgagaaataaggtggcatagacagagagatgtgaaagaggaagggagcagccagggaagatggtccaggactacagaaaaagggtattgaatgaagaccctatagaaggagtcacatcctccctacacccttctgactccgttacctgcttctactctacttcaaattagcagttctacacacacagaagaccacaggatttgacaattttgccaaacgaaatgcagagatgataaagccaggggcatcacataaacagatgcaatgtgctgagcaaaaaaaaaaaaaaaaaaaaaagcccatatggcaggaacataataaaagcactcatgacccagaagcggattgggggtgcacattgttctctgtagttgttttggagtggcaaatactcatttgtgccaaaatactgagtaaagggaactgttgacatttgacattaggattaaacaacttcctaaacctgggacacacagtgctgtcctcacctctctcattgccctaagacagtcactgaagtacaagggcctacgtcgtcctcaatgataagagccaataatgagaacagtattattaatatgtattaatagtattattaataacgtattaatactacttacatgtattgtgagtctattttggtacaggcacttgaggtagcttatctcatttattcttcacgatgaacctgtaagaaggtaatataatctaaatatgtggctcaaataattactgtgtaatctggaacatattaacctcttggtaccttggtttttgcatctaaaaatgggattaataataacgtctatctcagtggtctgttttaaggattatatgagacaatatgaatagaaagcacaatggggtcagacacatcatacacatttaataaatactgggcaaaatcgctgctgattttttaagaatctcacagcctagagtgcagtggtgcaatcagggcttactgcaacctggaactcttgggttcaagttatcctccaatctcagcttcctgagtagctgagactacaggtgcacatcaccatgcccaggtaagtttttaaaattgtttttttagagatggggtcttgttatgttggccaggctggtcttgaactcctggcctcaagtgatcctcccacatcagcctgagtcactgagattataagcgtgagcccctcacccagctactgttgaaattactacattttatggatggggaaatcatgcctgacaaggttaaataacttgcccaaagtcagtagagttcagaacagagatcagaacccagggatatccaaggataaatgccacatgggtaagagctgtagttataagccttccattatactgtctgcattaattgactccaaagatcaaatcctggtctaacgtaccatgatgtctcaggaaaagaatgtttcacagcatacagggctctagaaaatctctagcccaaagtaggaaacaaaaaggcacattactaagctcaagacatctatctgttcccactcctcttgtcttcatcaataagaagataaaagaaatccttgcccattttcttattcatttgctctcatacctatagagcccccattggacaaatgccatgaatactgattcttgtactatggggaataaagaggtactcacacacttattgaaagttaggtataaaacccaatgccaagctttgtgccccgagtccacaggcattttgactgcatgagatttgaatgccatcagatgaggtataaacatgaatattttcgtaagtataaaaatggagaagagaaagtactaatttaaaaatcagaaaacttgtgtatattcatctattcaccaaatatttgatggacgcctactgtgggccagccactgttctaggtcctaaggttacaatttcaaacaaaacagacacaggctctgcttttgtgaaacataacagcctagatggggagatgttcttaatcaaatagttgatgatatatttaattatacgggtgataagtgctatgaaaaacagagagatggagctacaagagtacatcacaagtaaagaaagccttcctcaggaagtgttctttaggctgagaagaagttgtacccaggaggatagagtggggagaagagaaccttccccagaaggagagatttgggtgaataagaggagctggaaacaagccagcaggtaggaagagaacagctctggactaccctgctcctccccaccactgtttccttgactggaaagtgggtgtgatggagaacatgacacgctctcagctctcggagtctagcttctctttgctgtgtccaaagtgagggcttactatagagtgagaagattcttgtccagctgcatagaatagaaaacccacttttgttgagagtaaggctcactgaaatgtaggcagcaagtataacttgtgcctaggtcaagagagccatcatctctctcagccatgttcaacagtcaatactgggttccccaaaggctcagatcccagggccccaactccaaaataaatgtcctagagagattttatgactaggcctccacagccctggtttggttgatggcttattaatgatctattctaattctccaatttcctcttaagaaaacaatgaaaatgaaaagttaagatatctaatttttccttatagaaataaataagatgcactttaaaataccattttcacagttttactgctatttatcaggaatcctaaaaacaagagcttctttaacagggtggctgtaactgttggcaattggcctgtatgtgaaattttacttagtttaacaaggccctctactggcaatctgcatgaacaccgtctccaaaggcaaagtttcacattattttaagtgaactgttttaactactctcaataacaaagtatctcacattcctgattctataattcaaggctcaaagaataagtggggagaaaatcaggaaggaaagaaataaatgtcattttgagcattcatttagtggttcataaaataacattacatgaggtatcatttgctttcctctgatgaagctatactacatgtcaaaggtactcagaaaggaaggatatttcttacactgaaatgtattgagtattcatgagactataaaaccaagttatgattgctatttaccaactacaataaaccagatcgtttctatttacccaaatatgagtaactggctgtaatgagaataaaagaaacattggaggcaggcatttaaaattgttgctgatatggcacaactaattattaacttatcctccttggcaactgacaaaaaaagaacatggtgacttgagaatataactactcacagaagatgaatgttttaaaaggagattatatttgacatatatgtcaacgggctgttggagcaactgggaaacttcagctatagggtcttagaaaactaagtaaatattaaaaatgaggcaataactttaggaaaaaatgttaacataaagatgtgatcatagtgatttgactcaacgtaaacaatatttgtaatcaaaacaaaaataagcactatgcatgtaattaaaactgcgatataattatattgaagaatagggatgctctgggaggtacaaaaagatatattataatctaccataataataaagaagtagtactttgacatacacacagaaacatatgatttaggaatattacataaaaacagctgaagaaaaaaaaaactcagaaatggggtagagagggtggcccaagagactgtaagattttatataaatatacacacacatatatatatacacatatagagaaacacatactcaatgtttatatatatgagcatgttagagctattgtttagtactaatattcatatatatacatagatatataaacaatttactattgttggattttctgatttatgagcatgtattactttgactttttaagttgctacaaaaccagttagcactgacaatggaaaccatttgagaaatgccttttgggctggcctggatcagttctatgtttctagattcaatttgccaaatgaagcaagttgcctttatggagcggtttgtcagacatgcgtctcgacagtaacacttgttcccacatttcagaactaacagctcttctttcaacaccgtaatatttatctgccatgttattattcccagtgtatgctccaaaatgggcttgggactctcctctttcctcttgaactcagtccactgggcttctacaatgcatccaaattctcctcaaaggaatcactaatccggtaaagttgatttctaaaaggagagatctggtttcttgccctgaaaataccaagattaatttatgtaactacggggaagtaccctgtgtaattgaggcttccaaactgacacgatacacttcattaggcaagtatgtattggggcattgtaaatgtgtgggtaatgttctatgtatctgagagatttattatttcatctataaaggaaggacaattgggaatccaaaattccaaaggcattaaaccctgtagagttagagaactggagaaaaagaaggctataaggtactttgtgcttaactgggtccatgacttgccagagtgttcagactaaacccttctggctatttaaatccactttcacaaaatgctaccatttccttaggttaccattttcagggaccaaccaaatggccaaacattatttccaattttttctttgtatctaatccctggattacactcttgaccaaactttactaggcctaccaaaacccacaccaagaatgtaaataatcttgatgtttaaccataaacttgggctactctacaaaaagattcaggtctggccgggcgcagtggctcacgcctgtaaccccagcactttgggtgaccgaagtgggcagatcacgaggtcaggctattgagaccatcctggccaacatggtgaaaccctgtctctactaaaaatacaaaaattagctgggtgtggtggcacatgcctgtaatcccagctacttgggaggctgaggcaggagaatagcttgaaccagggagtcagaggttgcagtgagtcgagatcatgccactgcactccagcctggtgacagagaaagactccataaaaaaaaaaaaaaaaaaaaaaaaaaaaaagattcagatctctgagattaaaggaaaaataaaaatagtaaaggactgcgcataggcgttagacactttggaaagactagaaaatgtgaattgccagtttgaatgggtggaagtattaatctgctatactgctctgccagtgcagtcaatcggggcagatgtgaatgaccaaaacgtcattgtgggtgaatgtgaggctcatgaagcctccatatccagaaagcggtaaaatgaaaggttaagagtatgcactgtggggttgagtgcagtgtctcatacctgtaatcccagcactttgggaggctgaggcagatggatcatttgaggtcaggagtttgagaccagcccggctaacatggtgaaaccctatctctactaaaaatacaaaaattatctgggtgtggtggcaggcacctgtaatcacagctaaccaggaggctgaagcaggagaatcacttgaacctgagaggcggaggttgcagtgagtggagatcgtgccattgcactccagcctaggcaacaagagtgaaactccatttcaaaaaaaaaaaaagtacgtgctgtgggttcaaatcctgcctctgcctcttatccacccatgtgacttgtgcacattacttaacctttctgagcatcagtatttttgcttggacaatgaatacaatgatcataataagatagcatgagcacagagcttgaaagtgtgcctggtatacagtaaccactcaatagtgattgatgttggaagaaaacattttaaatctgtttttattgtgcccatcaaccatgtatccatacatttttttcatttattgagaactcattgtgtgccaggtgctgagtttacaaactacacttaagattacaaatttgacaactcaaatttggcaacgactctatctcaaattcactagaatctagtggcagcagcggaaggtaaagaaatacttttaaaatggggctatgcagtgtaagcatcccaacagagtttagatagaataccatggggtgtgactgtttcttcatctgagagaagtaagaggggagacagagcagggaacgttgtcagatgaagccaaggaacgtggaaggatttcagaatgcaggaccgcagtcttctctcttaagtagggagggagacaccacctgagggaggagcacaggcaaagctgggactcaagagtgaagcaaggctcacaggtgccaccgtgggaaaggggtaggcacagggcaggagtcaagtggaaatgaaggcattcagtgagcagtattcatccgtctactcaacaagtaattccctaagggcagtgtcatgcatggtgctaagtttggggagtcagttggcaggtgtgccctcgtgagacacagaggctgaagaggggaacagaagcacagtgaaccaatgcggacggagttccatggtgcacagggacacctacctgcggtgactgggatgtgaaaagctgctcacaggacaggaggtgcatgcaagatatggaggataaactgagtgtgtggagaggtgctgcaggagtacaaaggtgcagatgtgctgaagaacatacaagcccagcatatttcagtaatagagagcagctcctggtagctaggccagtaattcccatcgaaatcatctgaggaactttttaaccatggctggatctgaatcccaccttagaggtcatgattcagtaagtctggggtgggacgtgggcatcagcaagataaataataactgtagctaatactcattagcacttaatgtatgcctagcattgtgcctattgttttagctacattaagatatctaatccttctccatcttcccatgaaggaggcactctcattatccacattttaaagaagagaaattgaaatagaaaagttaagtgaattaaccaggatcataaagccggcaagtggcagaagcaggacttgagcctgggcaggccagttccagagtccaagttttcagtcactgtgctgtgctgcatagtgaagaccctgattagccatcaggcccagaatccccaagacagctctaagtccacactgtggagtagagtgaaatgagccaggaaagacagccaggcatcacatcaagaatatccccgtcttcatggtcagaagtctggcatcaagggccttcaaccacagtgaagaagaatttaaagccaatcagcacagtaatgtggtaattttgccaaccaagtcctgaggcttgggtgtttgcaacaggaaaatggatatttaattcattcatttatttagcataatacattgaataactactctgtgcttagtgctgtagctataagaagtattatatagcaagcagcccttgctttcgacggaaagaggtatttaacaacatggcaaagagctccagatcccagggcaaaaaatggcacaagataccatgacagtcgaaacaagtgaatcaccacttggaccaggagagtccaggaaggccccccgcccctaggtaggaatgtcagggacaaggaaggctccagagagaagggtaatggacgggtgtatgcgatctagctgaatactggaaactgaggtccaggcttcagtgagagaatgaagtgggaaggaggaatcaatgaaaaagtgaagagaaggttccactggagagaggggcccaaaagaggaaaagcaaagcaagctgtggccataagaagaagtctgagacttggaagtaaagcacaaacactgagtatcagagttgggaatcacctcaggtatcccagcctgtacccagtgcaaaatgccttctgaactatttcaactgctgaggctgctccatttgcttttaggccattatctgtaaaataatcacagagttctctttggtttgctagtgaaaacaatgaggaacagacaccttaagaaatgtaacgagagccaaagacaaaacgggaatgttctctctttgccagaccaccttcatctgtacacctgcacatagccctgttcctacaagaaggcataggaaccgcgtgtgggtcccatttctttttcaatatttaagaacttgagaagtgggacacatgctggaatgaacacaggaagctcagtttctagttgtagctttgccaccatcttactgggtgctcttggacaatcacttctcttccttgtgccccaagttttcttctgtgaaaggataaactttgatgaatagtttgaaatctgttttagcagcaagtcccttattttaagcaaagaattgcaaagagcactgagctctaatacacaaaacatatctaagcctaatgtgttctgatggaaaaaaatggagctgacaaagaggcaggatgttacccaccttaggactccctggaaaacagtcaaatattttgaggccttttgacactggcttctcacaattctgagactagagacaaggaaaaggtagtgaaggctgtcaccatgtttctgggctggtgacagagcagctgaattcaggagcaagccaggctcctgagtgagtcatggggttcacatgcggagctaacaggctaacagccacttcttgccaatccgtgcagcgggctgggctgtcaggtctagagggcaggaatcagctgggatttgctactggttgcaagaggctgaactgcaggcactgaggagcagagctggtagcttgaaggacagaaagacaatttttcactgggctcttaagcagaactcccgggtggcaacagagaatagctcacgggccagccggtgcaggtgggataagaggttcctgtccaggctggcggcatacatgaagctcactcttcctatttaaatcccagagaatatctggagagttttaaagagccctgaggcaggcaaaagagaacatgtggattttgtataccgatctagctcagtgtcaaagtttgcctttttcagtagtacattaacttgggttccaactcagaagacaagtcagaacattgaacatttctccagatactcaatgtgaaaagaatccaaatagaaacagtttcaatttcaaaatattttttgatacatacacattcctgaggatgaatgagcctgtgtgtgtgtgtgtgtgtgtgtgtgtgtgtgtgtgtgtgtgtttggggagagagtgtaggtaggaggggacgagagaccataaacatcaacatccacacactagaaatccataaaccacagaaagaatcagagacaaaaagtgggttctccctgcagtgtaccagttcatgaaaaagtagccttcatagttgtctgctaaactttctagatcagcctaatagttttttggttggttgtatctctttaaaaaacaaaaacaaaacaaatgaaaaaccaaacctgacctccctgcagaggcaaatgaggattagccattcagtatctccttatcatctgcatcctggtatttgttctcagagacaaggggtcctctacccctaattccagtccactttagggccctatagttacttagaacaaacgcatacttgctgtgacagccgaaagagcctggagaaatatgtaaacatcatcatctcactttagaaggaaaacaagctgtataaataagaaaaactgttacaagagtttaaaaaaaaaatcccaacagtcttacttgtagttagctcttcagtcaacacatatcacagtcctggagacagacacaggaactacaactctctccagctaaaaatttcctcccgcggttggttatcctctgtttatttttgaagcattcaaaggccacgctaacagaacagactcggttttcctgaacatccacagcggctgggaagtcctgccgtgaatgcggagcaagtttgcggagacttgctccctgggctgcggctccgtagttgc

SEQ ID NO: 2579 - DNA, 896661 bp, Homo sapiens; identical to SEQ ID NO: 2578

SEQ ID NO: 2580 - DNA, 639024 bp, Homo sapiens; identical to SEQ ID NO: 1872

SEQ ID NO: 2581 - DNA, 105174 bp, Homo sapiens
tttcttaattggtttattgaattcatttactggtttactgaagactttaaagagggcaaaagatatattttgttaagagatttgttaattttgagaagtatcccattgattactgtaagaattatgtttataaattagattatttggcactgtagtaaatatcagtgaaaataaactttaactcataactttaatattttcatacaatcaaaaaatagagatatactctaggcataacataaattgttataattgatcagaatatcttgaatatatttttacagataactagtggtttctactagcagattaaaaccaagagaaaattaaaagtaagttcacatttaaaaaaaattataagcaataaatacagcactacagccaccactaattctatatacattggattacatttaaacaaacactgcattccagaatgaatattttatgaataaatgcattggaaattaactttaggaaataaaatgacaaattagaatttagaaaattaaaatatgactttcacaagtaatcacagtaaaatgcagatctacattttaaaagctagaaatttccccaaatttatttttttgacagcaaagaagtttgctttaaaaaaagtgtcagatttactttgctttatgagtatgatacaaagatattaagtagcatttagcttttgagaaatctaacatttaaaactattctaaaaatatatgggtacaaaactaacagtgattaatcatgaatgactgctacgcctcaagactctacaacagacaaaccctggctataaaataaatctgatctagaattaatattataaaagcacaacaaaaatacttgaaaattacatgtttattttaatataatctctgatcattcaacattttttactgtcacttctactgtcaagatggttgagagttgacagtttgtctagaagaaggctgatatatgtcaacatggtcagcaaaggatttaaatatgggtctttgaataataaatagctaataattgagtttattaaaatgaatttttgtataatttaggcagttgaaggtctagaacagcctgcgttcctttctatggcagcttgctatgaaattcatgtttcaaacaaaacaatactttttcatgcatagataaattataaatgtactgaccagaccattctatatgttaattcttacgaatttagataatttgtcttagcaatttgaaataagttctgaactcaccatctattgacatattgacagcttaagaaacaacttatgatgagtaatttgtttcatccattttaatcagattgacacacttaaaaaacagatacccatgacttttcccaaaattgacttttactaattgaagtcattcttgttctttagagatttcagcggaaaataacattagagaaactgaatcccatgcaaatttcactttaattcattagcaaggttttcttctatctttatttaataaagtctgacaataattcagtaagatctgacaataattttttctcaatgatatattcaagtatttccctaatttgtattatatacagtagctctattaaaatattaaagcattgtatatggtatatatagtatccttctagttttttatatttcttgaatagcctgggacatttccaaagctatatatcttcacatagtaaaagtcagtaaagtaatattttaatggggtaaaatctataaaagtagcagattggtatttatcacagtagttgtttaaaatttctggattagaatgtgagttcattgtcaaaatgaaaaaagaaatatgtcaaacacacctattattaaggtatgagttatcaaaacaaatatattcaataaaatagtgaccttgtgtttttaaaataaatatatcttatgatagatgtttctgttctcttagttctcaaacagacttctgatgctggcatctggttgtctttaaaatatttaccaaatatagcattccagactctattttatttaaaaaatcagcccagatacagtatcagatattaacatacacacattgttgcattatatatttgctttaaaaattacataggttgtatgtatttgatttgagactataaaataaaataatggagtatttacaagctcatttttcacaatttctttttacaaaattccaagaaaataagaaatccttcattgattttctttatataaaatgattgctaatttgtttatacagtagaaatggaagggacaaaatttatatttacagctaggaattccctcccactgtttggtaagacaggaagaggttgacaaggtgttttgtagcatcaactaagatgttttcctaatgatatagaagtaggattgcatattatacatcctgttcatccagtttccacaatggatatgccacaagatataactgatgtgtcagcaaatgagtagatcataacaattgtactcagttgcttttcatagagaaaagaaagccagcagggataattcacttctggtattgtccatttgagagggtagttacaaaaaggactacggcactctgggcaaaaaaaaagtcaactgccccaatcaagatgggataaagagttttaaaactaaaagctaattttcccttcatgtttatagaccttagctaggtctcttggggcaataagggtagaatcatgcccaacatgtatgtttagttttacagccatttgtttgtgaattcatgcaatggtgtgctggaactggcttacaccagctcagaaaagttgattgtgcttttctccaattccacacttggtgatgtcaggttagtagcgtcacatcaggcatagtgggagtatttactgacaaacattacaaaccaggatttcttttttcccacatagagctggatgttacactcttatcaacacactactaatttcatgtgaaggctcttctttatgacattcaaaaagtcatttaatattgaagtcttctggctacagagtcatgggtccaagtccttgagttaggagaagcacaaaacagtgagacaaccatccttctattttcaattatataaattttctggttttaagagaacattttcaatatcatggatgctttttccatttaagtgttcactaggacagtcatgactataacctggaccatcactgattgttgacactgtgtaagacgcactacgaagagcttctgagttggaaaagctgtttccaaattggattttgtattgattccagtttcttctcagaattgcttgaacctatcaatcaaaaggaaaacagaaagaacaagaacaacccattaattgaaatgaagacactgtttttgaagcacaattaaataggtcttggagaagagcttttttaaaaaaagttatgttaatcagtgaataatatagcttcattttcttaatttaaaaaattaagtgtaccatcttcacattaggaaatgtattacaattacattgtactttacattccattaatatttttcatggcatgttttgtcttcaaagcttttataattcatatgtatttattgttgccaaacaaataggtaatctggacccccatttacaagatttcatgtgcaacattgagttttatattaatgtctttattaatagaatgagaagacaattcgtgacaggataagcgaaagatacacaaaagaaaagaagttaggatacgaagaatacaaatcagcagcagcagcagcagggcagtagcagcaacctttgtttctgagtgactcccatatgccagaaattgtgctacattctaaaaaagggagcatgatatttgtcttcatggagcttactacatagaggaaagaaaagtgttgaacaaataattataaatctggtgaatattgtgaaaaataaatttaggaatgtaaccactccatttttatatatttgaatcctcttctgctgaataaatttgcagtttaatgacttccttcccctctgtttgaagctagagatcaggggtaggtgggtcctatacagtaaaatattggtcataatggaatgtaaggcacaagagtgaattttcttcattgtcagtcaatgggcacaaatgagaacatttaaatacatctctagctcaagtacgttgaggacttttccatgtctgatgagtgagcacactggcttggagcagcctgcttttaggttatgaatgtgttagccaaatccttgtgacccgatctatatctgcccagagtgggtttgctttgaatggtcttccccaagctctctattgctctttggctctttcagtgcttttccaaagggaatctgagcatctcacagcaattttctggtaattcattttctacgtactgaggtataattgtttaactttctactacttatatagaattcctcaactttctcttcactatatccatgtatacaaatcaatattaaatctttaaaaagggcttacttctctcttgttatttcctagtctaatggattaaaacacacacacacacacatacacacacacacaaaacctcaattcctccaattacaaacattctatagaaaataggtgttccaggatgtctgcagctttacaggatacttcagagttcctgttaaagtatcttatagtctgtcacttaaaataaactcaaagttttattgtctcatttcatgtaggaaaaaagaaggagcaaatataaagccaacaatgtgtttaggtaaaattaaatgaggtattaaaattatcagttaatttcactctactatatagttcaaaaattatataattaaaatgaaataacttcgtattgaaagttacattatgatgaagttcagtaacttcagccctttcaagctcaatttaaaaaatatatggtaaccatatctgaagaaaacaatttatattcatgtaaatatgctttgaaaataaaagcatttataaggcaacaaatttatttatcttgcaaaaattaaactttcctctcaatttagtaatataattctaaatcctccgtataaaatatctaaattcagataatttaaaaataacatctgcatatgtaacaacctcaagatcatgagcaaactacaaattgaatggcttcagattgtgaattttaaatacatattcagagattcaaaataaaaatgaccattgaccaattatctagatacatctgatgagaaatatttttgatccttattttttgtttcataaacttctcctaattttgttactaaatgctgaattggttgagtatgtaatcaatatagtttctggttgaggggaagtggcatatagctttgtataaaaaattctatataaagtatgagaaaaagctgagaggaagtaatatcttagctgtgagtctagtacttatagtcttaaaaaggaaagcttaaattcaatttggaaggaaaatggctattgaaatatatgactgtttgctcttaaaatatctactttgattaaggtcatcactctatttcttccttgcaactaaatcatcagaaaaaccatagaaagccaatttcatgaactgtgaggtcttactatagttaaaaataaacctaattaaagatccacaggccttgtagacttgtttgtttatgttatttgctctaaggatgttacatttttcttctgcttcctctaatacaatatcacacctgttaaatacgacattaaagcagctactcttaataaacttttaatgagaaaaaatcagtaggagcaaatttccattgtaagggaagatagctgggtgttattaaagatatgaatgtttttattgttttatgcatgaccatgtataagtagtaaggcaaatgtttagaatgtaacattacaactttatatacccattaacacccaataaggaactaactttatactccttaatgggaatcaatttaaaatatttacgaaacttttataaaaattctacgtagttctcatgaaagaatttgggtttaattgtctgtcctcaacaaaactttttgctcatcttatggaatatctaccctcaggtgttgttaaatataaccttctgatgactagagtccctagtttatgatcacagtgcacatttttgtctgagggcactagggataaaatgaaagtaatccaagcacttgtcaagccacatttatttaactagtgagaaatgctaatagcaagacgttagctaaaaagtgcataaaaggtgggaaagaaaaaaacacaaatattaagctaaaggcaggcatttgacctaatgtggaaaacaagaaggaaactaagcctgagcaaatgattttaagaagtacatgacatagttggaacaaaatgaatttggcagttgtttcttcatgttatgagagtgggaaaaagtaagaggcattgagacaaaaagggagggatcacagtatttcttaagaagagaaatgaatcatactgaaacagggattgtatctccagagatgaagaaaaggaacagatattagaaatgttgtgaggaactgaaagatttgggaacaacctagctcaaacattgtgtattattgtaattttccaatgtcaaaattttctcaattttaggacatggcagaagatcaaggttctgtgtcccttttgtttacacagatcgagtgtaacaggagtgttaggcattactttagatattccctgggcactctttctaaataaaagagccaatttgggattttgatccaaaatgattaatgttcctgttggcacatgtgtttttgaaaataagtgatttgacaaatcaaataataagtatactgagaatctcatgaagtggggcatggtgctaaaaactttatctttcttagcttgtatttatttttctgagacctgtgtagagaacttgctttaatttccctttaagaaagatagacacaggctcctgaaatttgccagcatttgccaaaatatcacagccaagatgaaaagtagcatctttggtgattaaatgcattgctgtgtttattctacactgcctcctgttacaaaatattttactagtgagtgtgttttgaatatttaaaaattagttcatggaattaaaatctgtttctgtagatacagaggtctacctttcctatttcatgcatgttctttagcatgttgtccatatcactctcatctatatttaattattacatcctatacaagtagcatttagggttgtctaattcagtgtatataacattaaatttatagaggtatataataaaatctatttgaattttactatcaaacaaatgatttatctattttttgtaactgcattctgtctatgcttctctgatttcagaaaaagttgctcttgtcttctgtatagcagaagaattatggaagtaccacttaaatgtatgaaatatagtctacaatgtgtggcaactctacacctcattacaaataaataaatatagataaataataataatataaataaatacgtgttgaacttgagatatattttaattaaaaactaaacattgagttttattatatgtcaagatgaggaagtaaaaatattacttaagcaagcgcaaataacatgttatagtttttcatgatgtgtgcatgatttccaatgttcatttgttttataggaatggttgtcataggttataccaactggtcccatgtgttccccatctgaagctttatgataagcttcacattatcaagtgtctgtgtctcactcagctgctgtctggatttctaaactttgttcaattttgccaaaatcctcctacaggttaaattgtgtcgagcagattaaaaacatataaagagctaagtcaatagagctcagattactgagctataacacatttgtatgcataagaaatatgttggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcgcctgtagtcccagctactcgggaggctgaggcaggagaatggcgtgaacctgggaggcggagcttgcagtgagccgagattgcgccactgcaatccggcctgggctaaacagcgggactccgtctcaaaaaaaaaaaaaaaagaaatatgttaccagctttcaaaatgcctgaaacttcccaagtaggaaacgcatggataaaaatctagaagtactgaagagtacatggtcatgttatgaattagagcattctcttctaaatttcctaacccattgaatttcttccctgtataaccaagagtttaatttttaaaatcctttcgtatttgccataaagttgtttccataggctacattgtaagacaggcaaaaaagagaaagagggaaaatgagatgatcctatttcttatttcctattagagtgtatgttctatgagatttgggattgcctggcactgtatctggggaaaagctcagacttaatgggactcaaaggtatctcaaaagattagatgaatagcatttgaaatatttttaagtgaggttgacttttccctggctttgaactccaatatgacctgagcatttgagaaggagagttaaacctatggtaagagattctatggttctttccctgatggaaacagaatttaacatggttgttcctggggaatttataattttatctcatttaaatacatggatagatagacagatagcaaatataaaataatagaaggaataaaatcaattatcatacctctccattaaagaagcagaaaatggtagagaccaaaagaccctgtaaaagaaaaatagaatgatctgaatccaaatggaaagatacatgtatttgtaatcaaatagctgtacaagtagtcaggagtaaaccaaagctatatgtatatttaattccaaacttctcaagctgccttcttatcaagaatgccatacctggaagtgcataaggatgtgcatgatgtagtcatatacctcctctgcaatctttccttcaggtcgccatggaatcagcacaaattcaatgccaagcaatggcaccaagataagagtagctctcacagctttcatgtacagattggattccgcttggtgtgtaacttttaacttggtgatgagaacgcgtacaatatttaacaagaaaaaaagattcacctaaaaacgaaattaaatggcatctgaaaatcatttcatatttaatattaagaagcattattcaagtatctccaattttataaatcttaaaatatttttaatgtacaagaatatttttaaagggtattattgcctaaggcattaatttatatttctggaattgtgatttatcaatttaacaagtacatcaattttaataaacaagttttaaaaaagtaaaattaaattatggtataattactgtggaacatattcagttgaagaatatttcagtttttctcagctcattttcacgtgcaattaaaaaaatctgtggtctaaaaactaaagattttgaacattttcatatcaaagaaaataattgtttatggaaaaatgctaatttttaaagcatcccctctttatcatgtccatatgacatactttctaaatgtatattataccataataaccattttcatctttcaaaccaaaaactttcctgtttcttctagtaacaataatctttacaacacctctccaaagtatcactgtaatcctcttttacttatgagggaactttgaaccagctgatattcaaccccagtcattctagagctaaaataatttgacattctataagacttcctgttaattactgtctgcaatgacataatattcactatttttgtgcctcaacaactttctcgaagagacagtagtttctttggatgggagacataaacctttgacactctaatgtgactcagcaaacagggtcctactgaaacatatttatttctctttctctcgcataatacaagtttatctttctcttattttcacccaagttagagtttatctctttcttattttcacccagtcaatatcttttactttggtccattttctctatgcccattccttatgccttccatagaatcatgaatattaattccagaagagctccataggggctaattgctattctcttttctttttcctcacccttagttctggcatctgccctttgtttaataatcttaaattttcaatctatgcaccaaatataatttatatccacacagtttaaaaattgcaaaaaatagtagtttcccatttattatagaaaagaattaacagagagcctgcatttgctaaatggacacatgtgtcataaaaataactgggcacaaaaatattctaccactatttttagaaaatttaatagaacatatgcttcaaaaatatacagctcactaaaatcctaatggaaacacatctatgaaaagcaatgtttgcagacacagaaatacgataaaggcaaaagcagaataagccatttcaacaggtgtgagaatgaaatgtgacaaatcaacatgtcagctgttattccactcatcctaatatattcccttcttaagcatccattgctctttaaaaaaagataataatgctcttttatctgcttaatatcaaatattttataatcttaatacattaaatcataaactataaaaagacagtagaaacattgcaatttagatgatcccaattatatgaaaatttttaaatgcaaagtgcttctccacatgggaagtctgatttaaaatgtgaaactagaaactagagttgacaatagagtttattctattagctattttataaataattgtcttagaatgaattggatgctatttttccacacaacatagttttgagaattataatcccttcatcttactttattttctgtaaatatttccatttactataagcaaaaataaaagaagaattttaaattttagaagaactatgtctgaatttcacccacccttgagcaaaactagttcagtagaaaagaagaaacctttaactgacatactcataaagtttacatagctagtaggcccatcaggctattttgatatcacagtaccacgcttgggtcatgacaggaactggggtaaatctatacagtggctgtaggacagtttctggaagtcattcccagacaatcacttaactatgcactgaagtcacctaaatatctgtcactgaacccaaattaaatgtatcatctctcaacttcccctcaacaggatctcaaaaatgctgtagtcactccagtaccaccctgctcacatggaaatgtgatggaggaagtctgagtggaatgacttgtgattaaaatatcttatttataaaaattgtgcaaaaacatatgataaccatgagaacaattactagggctcttctgaggagcttggaattggccaggaccaagaaggagctctggagcttaaacaaggacagaatgatttatccggacagaaaaataggttcctaatcttgttttaggccaacaagatgggaaagttttaggcaaataatgtggattttcgcttcttttcttactgaccagcttgatgggctatattcctgtatttcatccttactcttcttccttaaagtttacatgaacagatgtttccaaggatagtgtagatgacgttacattttgcatttgctaggtgctttcacttcctgaaccttactgatttagaagtctgaatcatgtacccctctgtgcagccagatcttttgtaataaaatattgtcttgcatttgttctggaatctcctgggtagcccaaacgatatattataatttcttcaagctctcctcagagtagaagcatggtatcatgcagaaactacaagtgaggaaacttggaaggcattttttcaagaatttataatattctatgcactaactgtgccagatcacttaacagaaagcatctcatttaatccttataataccctgtgaggtatatattcttattattccatcattacagatgagaaaacaaagacacagagaggttaaaaacaaaataaaacagaaaacttgctctgagatgatacacaggcagctgtggtagagccaggattcagtgctgactcttttatgcacacaatgcaaagccaggcagtctcagggtacaacttaaacacagtatgtcactcatgcccttagaatgtaggagaaggaagggaggcaagtgcctctgcctttgaaattttcactataatctacattaaggtatatcaaaaaatgttatgaaagtcataataaattctataagaatggcttaacaatgatacattttgagaatggtttgaacagtgatccaacgcaaccatatactaaactgcagctagcaaatatagttaaataatagaatatctgtatttaaaaagagtctgaagagacgaatgaggaagctttgaattttacatgaaaaatatcacatacatacacaagcacatatataaataacttgatcgcagctgtaaataaagggtatttgaataggaggagaggaagtcaaattgtctgtttgcagatgacataactgtatatttagaaaaccccatcgactcagccaaaaaactccttaagctgataagcaactttagcaaagtctcaggatacaaaatcaatgtgcaaaaatcacaagcattcctatacaacaataatagacaaacagagagctaaatcatgagtcaactctcaatcacaaatgctacaaagagaataaaatatctaggaatacaacttccaagggaagtgaaggacctcttcaaggagaactacaaaccactgctcaaggaaataggagaggacacaaacaaatgaaaaaacattccatgctcatacatagaagaatcaatatcgtgaaaatggccatactacccaaagtaatttatagattcaatgctatccccatcaagctactattgactttcttcacagaattaggaaaaactactttacgtttcatatggaaccaaaaaaagagcctgtatagccaagactaagcaatcctaaacaaaaagaacaaagctggaggcgtcacgctacctgacttcaaaccatactacaaggccacattagccaaaacagcatggtactggtaccaaaacagatacatagaccaattaaacagaacagaggccttagaaataacaccacacttctacaaccatctgatctttcacaaacctgacaaaaaccagcaatggggaaaggattccctataaaataaatggtgttgggaaaactggctagccatatgtagaaaactgaaactggaccctttctttataccttatacaaaaaataactcaagatgcatgaaagacttaaaagtaagacctaaaaccataaaaaccctagaagaaaagcgaggcaatatcattcaggacataggcatgggcaaagacttcatgactaaaacactaagagcaatggcaacaaaagccaaaattgacaaacgggatctaattaaactaaagagcttctgcacagcaaaacaatcaccagagtgaacaggctacctacagaatgggagaaattttttgcaatctacccatgtgacaaagggctaatatccagaatctacaaagaacttaaacaaatttacaagaaataaacaatcaacgccatcaaaaagtgggcaaatgatatgaacaggcacttctcaaaagaagacatttatgcagccaacaaacatatgaaaaaaagctaatcatgactggtcattagagaaatgcaaatcaaaaccacaatgagataccatctcacaccagttagaatggtgatcattaaaatgtcaggaaacaacagatgctggagaggatgtggagaaataagaacacttttacaatgttggtgggagtgtaaattagttcaaccattgtggaagacagtatggtgactcctcaaggatctagaaccagaaataccatttgacccagcaatcccattactgggtatatacccaaaggattataaatcattctactataaagacacatgtacacgtatgttttcttgcagcactattcacaatagcaaagacttgaaaccaaaccaaatgcccatcaatgatagactggataaagaaaatgtggcatatatacaccatggaatactatgcagccataaaaagaatgaattcatgtcctatgcagggacatggatgaagctagaaatgatcattctcagcaaactaacacaggaacagaaaaccaatcattgcatgttctcactcataagtgggagttgaacaatgagaaaatatggacatagggaggggaacatcatacactggggcctgtcggggggtgggggtgaggggagggatagcattaggagaaatacataatgcatgtggcgcttaaaacccaaatgacagtccccagagtgtgatgttccccttcctgtgtccatgtgttctcattgttcaattcccacctatgttgtggggtcgggggaggggggagggacagcattgggagatatacctaatgctagatgacgagttagtgggtgcagcgcaccagcatggcacatgtatacatatgtaactaacctgcacattgtgcacatgtaccctaaaacttaaagtataataataataaaaacaacaacaacaatgaaagaaaaaaaaagacccaaatgacaggttgacgggtgcagcaaaccaccatggcacatgcatatgtatgtaacaaacctgcacgttctgcacatgtatcccagaacttaaagtataacaacaacaacaacaaaatgaatagcagctgtaactaaaataccactcctaaggactgtaattgcactatgatctctaatactctctgagacaaagcatgctagattgctagtttgtattaatttactttctcattcaaataatgtaatacacttgtaatcccagcagttgtggaggccacggcagaaggatcactgcagcccaagagttcaagaccagcctgggcaacatagtgagatcctgtctctataaaaaaaaatttttaaaaattatccaagcatagtagtgtatacgtatagtcttagcttctcaagagcctgaggtgggaggatcccttaaacccaggagttgggggctgcagtgagctgtgatcattctactgcactctagtctgggcaacagagcaagaccttttttcaattaaaataataaaaataataatagtgtaataaaagcatcgaatgtgacttctgttttcctgcaattacactaaaatgtctaattcatgcactcacattaactgataataattataatgtaaaatttgcataggtattttgttttttcttatttgtcacctcccacccccccctgctagattcatcctctattcctctctgtgccacaggaggatgatgtctgtgaacagcttcacccagacttccttgccctgagacatttgctgcatctggctaattggaaaaaccaaaagataagagtatgggaataaagataaatttgagtctttgtttctgctgcttctattctgccaggctgtggttttggcagtggttgtttttctctactcaagatcagatctcttactgggtgactcctcccaatgctcatttcactgcactaacatttctctcttcaggtctagctgtgataacagcattccattgttggtccctaatggctcaccatcccttactaattagttcctttgcctttcctgcgcatacatcagatatgataccttcactaaacgctattcatttaagcactgtgaacatgcatgtccatctgtgtccactgggaccctgaaggataccataggccagatgattcagaaataaagttgaaatgtgagcaatgataaggaaaggagaatttgttacataccagtaaagcagcacaaattgggccatggataatgtagaggagatgggtatcagaactgatccagcaactagagaaaacataataacattatgttgaaaatttttattttacattattccagtagaaataataaaaagagattttcttacttgtcattgtaatataagcttctagcaatggcatgtatacaagcaggaatcagtggaaatcctgtaataacaaaaaaaaaagaaaataaataggcattttttctacagatggtatttcaaaaatatgtaattaaatacaaaaattcaaagatactctaggagcaaaaaaactagccactatatatttgttgaataaacattatttgtatcatcaacaatacacattataaagtattaggtatttacatttttgtgtttgtgtgtttatgtgtgtatgttttcttctactataattcataagtcattttgaatcagtggacttcagagcttaactcttaagatgtgtttcctaagccacaaggattagaagaaattcagcattcgtgtactttctgtgagatggaattggccaacatttggtacattatcagatgtggaaaaaagttgagaatcacaagaacttccactatgagagagattactactagtaagccattatttgaagaagagaagaagaaaaaaagtgattaatttatgtaccaaaaatttggcagcctttgaacattctaaatcagctcttccaaatatgtaattaagcaatgctttataaagttaatcagaatacactaaaattgtgggtgtgcgtgtgtgtgtatatatacacctctgtatatgtatttctttctagatatagatagtttagatagatgatagagatatagatagatagatgatagggtagatagatgataatagataagtacaacttcagttttgtttctggaaactagtcctgttaaattcatttctgcacttcatattttgtattattctagttatttttaatatgtcagaagtatatcactgtttgctttgtgaataataccacatcaggatattgtgtagaaaaaataaatcttttgcatgcctttattcaattactaatccctctactcttaccgtaaaatgacaatattttaaacaaatatttttagaatggaacttcaaagatgtttgaacccaatgctctcattttacacgtggcaaaaatgaatattcagaatggtacaaagactaaatctttaatttatgattctacttctattgttttagtcactacatattcagccaagataccctattcattggcatattcaatagaaaaaaagacactattatatattgacttgtgactactgaaaacaatggatgagtcagtgatactttgcttaaaatgttgcaatttacaagaataagcaaaagttaatcacctgatattctttaaaaatgattactcattggtatattcatattacaaaggaacctggcatcctccaaaggcttctttaatccactgaatcaacaagtatgtataataacacttaccccagccaagaaaataataccacattaaatgttgcttctctgcaaacacggccaccacaatgagtgtgtgtaggtaaatgccttcacagagcatccaaaagtaattacagcccatcaggtaaagatgaatgaactgggacactttgcaactaacctgtgaggaaaaaaaaaaccccaatatttacttgtttatgaattcacatgtaaagcaatactctagtttagctcaggaaacatggaacattctcccctacacacaaaatcctatacattaatgattaggatttgtggaatgccagtcttcgtattcatgtaatgatgcctttagtttttagccacagactccaaagattgataatggtatatcttccagaaaaaaagtgtaacttctaaatctactttatttagtgaatgtgtattttctgaatgtgtttttgttgttatgtaattataagtataaaagtgtcacacataaataactttacacttatttatatcatcatgaatcccttgactgttacattctgttggaaataatagtaattttaaaaccaattcattaaaagtgcccaaatacttgaaaagtttgcatattacatgctcctcatgcaaatgcttattaagaaataatctaatacatccataggttatcctatccaaatatggagtctgagggctttgtgtaagtaaaaggaggacaaaattatggtttcccttccatttttcctgaggtctccatttttgcttctctacttttaaacaggcaggaagagagacattcaaattacagtaaagaaaacacaaaagagtaagagtgagtttactcttaaacaggagaatacaattaaagctttcccaaaaatacatgacctgttactcctattggctccagtttctagtctgaaaatcaataaaagtttagtggcaattatcattatttttgaaatagtttttttaaccaaaaataaaattgaaaagaaaatgcactggattgttaatattgggtcatcacagaatagtaataatggcatctgcataggagtcagcctaaaaatacttttacatatattgttttatttaattcttaacggtagtcctatgaggtgtacattatcataggcatatattttatagataaaaaaacttagtaccagagaagttaaatgatttgctaatatttatacatcaatcaaatctacaacctgaacattccaattttgttttcattatatacgatgcctcctaactaaaggatatttgtaaaacctatttattcattaaatgtatctgcagaatacgtaacattaaattttaaataatgtacctgtatgtaaaacacagcattatattaaagttcactcaaaggtgaaaatgagatagtctactatatggagagaaatcataaatttcagcttcaactttttatctaaagagtttttaagtatttatatttaattcggcttctaattcttgatttcattaaaaaagttaatcgataaaccattacaataaaaaagaattaagagcatactgcagaaaaatatttctatgcagggcattagtaacagagacaaaacaaaaatatatgacaatttataatgtgtttattaaacacatctttgcgtacaaatatgagatttagaatctcatgctctgcagcttcaagacaaaactctgaatctccttgtcttacagaaattcactctaaaatggcaggacattagccagatttttatgttgctaattataccccagtgtgttttctaatccaatgactttagagtggaacatatacaagattaagcaatctggatgcacaggtgcaaacaatgcagggacttttagaattttgaaaattactctaaaaacacacataaaacacacatgagactgtttattgacccacttggtaaaaattctttcccttcctgatttcagtcactagataattttttcttttaaaaaacactttatatagacacacacacacacaaaatatagtaaatatcccataaacattataaaagcagataatttttaaaatttgaatgtatgtttatgtatgcagatattttaatttaaacattttacatatgcatatagcttacacaaaatatttacatttagataagtaaattttaaactgtttgaaaaatatggcctgtaaggcaacaatttataaatatttattgagactgaacactgtagtttttaaaacattatgctatgaagtttaatcttatgtaggatatgtacaattcattcttttcctggttttattgactttttaaagtcagcctgatacaaaaaatataatttatttaaattttccatgtgcgtgtactatttttcgaattacgcagagttcattgctttgagtttttcatttggattgaataaatattatgtagtgataaactattatgtgccatagcaagaggactctacagctataaaatgaagtgaagatatgtgtacatgtataaataattgaagcaaagaaattattacacttttttatgttcactctgtatcttggggaatactgagaatactctgagggaatactctgtagagtatatgtagctatattccaatgtagaaaggtaaatatttctcaatattccccaagatataaagacttgaaaatatatatatatgtcagacttgaaaatatacatatatgtgtacttaattatacacattatgcatatatcagccatgttccccctttcccattaggcccttgaaccaagggcacaatcttggtttacttacaggatttgtggctactaaggcctggttgttggccactgcagtgaggtgaatgattgttacaacagagttacaaacaaatgagaagaacagatttttgtgtaaggtaatcctttggcaacttaggctcctaaaaagcaagaaaaacaagtgtgttgacatcatgaaatgtttttttattaatcattattcaaataagatacattcccaattcatagcagctgatccacttttgaaacaattattttttctccctaagatccactcattacaaaaatcttaattagggaaaacctgtaagtgcttaaaacctagagacaaatgagttgctccagaagaggtagatatacatagggatagaaaatttgcctgtacaagtcctctacatgactttctctattaatttctgaacataattaatagtttaattcattttgcaaacattgggattcagttaagttagataattgatcaaaactcctgcagctaattaatttgaacactttgtatttgctgtcagattctcatgtggataacttttttcattacaccatatatattgttctgtttaaataaaactgtgtgttttgttgtgatggtggtgattacacagaccgatctggaaaaaataacaaagtactcagaatagatgaattgataaaaatgtaaatttagcaaccaatgagatttgcacagctttactgaatttttctaattggtgcagccatatataaggtaaaaatagtaccaccttttactagagttcctcttgtataaaacaaaagagagttcactgtgtggagttcacatagaagtagatttcaagaaaaagtgtcactaatgataactgatgtcactcttagattgaatccacctccactctaagaagattgtgcatatatgactgcctgcccgtgttcaagcgctacttcctttataatgcatttactcaaaggcttattatggataaagttttaaaatagtagtatgggatccacttgaacctgaatacttaatgtcaagtgtgaactcatatgaaggaagacctgaggaattatttcactacagaggcaaaaaatttcatgatgtgtgtgtgtgttttttttttaaatatgctattaatatggtcaacctatataatccaccatatataattcaagccaaaggcttctattttggaaactttaaggagatctttacctaattttatcactaaatctctttatcttaaatagactgtgtgcccaggatattggaattagggtgggatgccacggttttctatatttaaaaattcagtttagagtatattgcctctgaaattacctttcttccagccacaggtctgtgattctatatatagctctagtaattaaagagcctggaggcatatttgatccaaatcaatattataaattgtcaatatattccttctacaagacttctatgaagggattcatgggcaagatggctcttggaatgattgctgagtgtgtgtaagacattcatatgccaacaaataagtgaaatccagctggaatccatcaaaatagaaacaactggaaccagctagtattttcatattaaagagtggtttactttggcttgactttgtagtgtataggagtagtgacgcagacagtaatcagggcttatctacaggttattgattatattctatagaaaaaaagaatctttgaaacttttgaacaaaggagtggcatgattcctgctattacttagagaaattcaacactaagagaaagacaatcgtatttttgataaaatgccacagcagtgacataattactttctgttcattgagcatgaagagagttaatgaatatcagaaaaagtctagtaaataatgttcttttcaaatcagttatattatgtgtggtttatttctgtcattcatcagtgttccattatgaaagttatagacatataacatttgttcatatggtcttattttaaaatgcctgctttgagcttaccccatgtctattgagtgccaagtattgtttagagagaggaactgcttatccatgcaaatatacatgtttttagtaatacaatataagtaactcagctaccatcaagggaaaaaaagtaaagcatttttcttaactgggcgattttgtcattttctgctgagcacacatatatctaagtccattggctaagtccatatctataaacaacaaaatttcatagttttaaaactatgacgaaaagattgagaaggtttgcttaaacagcaagtaagatatatttgtaagaagtaagttggaataaaggaaagcaaacatgaaagaagactttcaaaaatagaactattctgccattaaaaaaatgaacttctctcattcaccacattacggatgcaactggaggacactacattaaatgaaataagccatgaacagaaagaaagactgcatgctctcactcacttgtggaagctttaagtaagttgattgcatagaagaaaaaaagtagaactagaggctggaaagggtaaggggagagtggagatggggagagatttgttaaaggatacaaaattacagctagataagaggaataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaagaggaataaattctagtgttctatatcactgtaggatgactatagttaataataagtagttttaaatagctagaaggattatgtgggcatattgcatgatagtaaaaattagaaaaaaattaaagatagctagaagaagaatattgaattttcccaacacaaagaaattataaatatttgggaagatggatatgctaattatgctgatctaatcactatgtattgtagatttctaaacatcactatgtaccccataaatatgcacagttatttcatgtcaattaaaaagtgaaataaaataaataacgtgatagaagagctgaaagataggagctaggaacataataaatacatttatattttaactgtttatattaataatattcacatgtgaaaagattggaagggagtaaaataaaatgctaactgtagttagttgataaaaaatttaatcctcttgtatacagttaaaggttaatcctctttgtataaagttcaatgtcctctatgatggtctatatttctgttcctctcagaattccattttttttaccctgctcccacctcaatttgtcttgaaaggtaagtacttaaaaatgagctgctggtatatattatcttccaaaaatgtcattattgtgagtataaccccacacacacacacacacacacacacacacacacacacacacacgacatcttattctcttattatgggataaaaggatataccatatttctctttttaagacccaaacaatatcattatgggcaaagttttgaaataatagaatgaaattcccttgaaatttactgaatgtttaataccaagacaaaacaagttcttaagaagatgcattaaataatttcattacaaagacattaatttagagtgttttatacaattattgaaataatgtggtcaaactagatagtccaccctatacaactcaaaccaaagactgctgctttggaaattctgatatccagtttagctgcccaaattttagtaaactggaccatcgccacatcatttcattttgtgttgtgtaaatatgtcctactgcctaaaatactatttagtttcttccatttctacctccaggcactgtgcaacttaaacaaatgcagacagatgctaagtaacatatggtttctatcaatgtctagtgtaaaaatggcactgatttttctgatgatgcatattgtttccttctaaacatattcattaacacatgtaagtagattggtacaaataaaatcaacctgtaagtgaaaaccaaaaacatgtaattggtaaacacatggtttgttcaaatgaagccctaaaatatttgtatattttttcaaatattaacctgtaaccaattttacctactttaaattcttaaatattcttattttattcaaaatagtgaaagcaattatcttagagtcttagagaatgtttacaaaaatccttcgatttctttaaattttataatatccctttctatccccgcataaccacagaacagaaaatggggtttgtgggtccagattgtttgtatttcatattttttacatataattattttaaaatgccatttcaacatttaaaatgccatttcaacatgcaattttggccagcagagttacagaggcagttgatgttattgtgtcaacaaaatcattatgctttatatgtaatgaaaccgtgtctttcaattcacttttggaacaattttagaagtaagtagcgtcaagtcactatgtgtagttcagacagtgaatctgaactctgccatctattgatggtataactttgggtaaattatttaagatcttgaatctttaatttcctaatctgtaatttagggctaacaattgtacttcataggattggcttaaaagttagaggagataaatcacttaaaatgttagcataacatctaacccatgataaacactccatgttaagttagctgttgttttttagcataattatcatatggttgattttaatcaaacgctctaatggtttttaggtacaaatactaaaatagcatccaggtttacctcagtaatgtcaaacttcctctatattaaaataagtatgttttaagtaactcaatcaaacagaaaaatagtcattttttttcttaccaaacaagaattatcattagacagaatttccatatgatgaagggcaatacataaagcaacctaaattatcttcccaggaaatttcattctttctatagttgttgccaaattgccaggttcactatcatgcagatcccaaatattatagtacttcatcttcaaatttctgccactagtatggacaataaccttgcctctgttttccatttgcttttgacatgagctaaaaacttccaaactacttttctcaatactaattatgagcaaaatgaatcatgaaaggagaaagtacaagcaatataagaatagcacagtctacaaagtattgctttcttattctagcttatctaatttaatttccaaattctcagatcttttcccccaaaaaacactagcaacatatccaaaaggaaagccctgtcaatctgaacactgccacaaaccataggcagaaaacaacaagtatattaaaagaatcagtagtgtgactatcttttgtctattcaatggaactctcaagttgatggaatcacatgtttacatatgagaagtagatataacctctttcaatagctctcttttggaggctgctggtgatccaaattagattaggccagattagaaagagggtgagtatttcaaccaaggtgctcaatgaaggtcctagaggataaattattgctcttcctccattatgctccctcttcccatgcccttgggctgcttatttaatgaaatatagtagtatcagactgcataaggaatagccatgtccattttgtatggacaactgattttctaccatttgtgaactgctttggtaagactgcttttcctggtcttctagtgagcaggaaaccaagagaagaaagtctttctgaatacctgtgattcttgggctccaaaaccaaccaaccaaacaaaaacctttttagaggcaaaatttataataatagcagccacgatttttgaaacccttagactatccccagcatagagataagcactttaaagttgctatcatatttaacaactccttgaagtattattgtcttttaataaaatggaggtaagtttctcaaggttacactcttataaaaagtgatctattgagtttgaattttgaagttctcaaggaagcaataaggcttctgactactttataatccatctagtcacttactattggatagtaatattttggccactgttactagaactggggaaacagttgtgaataatacaaagcaaaaccctgacctcatgtgactcacactatagcagagggtaaataggcacataaattaaacaatgtaatcccagatagtggtatgtgctttttagaaattaaaacaggactaagggatacaaaaagaatgtggccagggtgagaagaatacttaacatacagttgaaacaagagagtatagaggagagaagtattccaaatggggaagacatccctgtttgtcaaagccctgagcttaaagtttctgaggggcaagaacaggccatgtgacagagtacaaggtaaacgtccaccatggctttttttccattctacagaatgagtaaattaaattcaaagaacatcacttactgaatggctttttgattctgaagttcatactcttttgtgttatatagcttttttaacaattaatgaaaaattgtttactttattctgtttttaaattattcccatctctttcatgtaagaccttcttggtttttgacatcttaatgtttcatcagcaaatattagcagcataatatctagtcattctgttttttctttttcctaaatactaaaaatatgctacagttttgagagtgtgctttgactttctcatatatgtctgtgggtatgatcgagaaaaataaactgtctataataatggaaaacctgattgtaaaatatattatgacttttgggagaaaaaatgttatttatttctattttctatttcaaataacgaagttttaatctattcaaataatgatataattttcaaaatttattgtcattctattgccaggaaaacttaggtatgcttaaattaaatagcacatttaattagctcaaacagaaaagattaaattcatgattcagaatttgcatatttatcaaatatatctgtaggaataaagatatgtgatatttaatgtggatttatagctttatattttttatatcttaagtccaaattatctaattcagttactgtatttatatttccatacctgggactcttctccataagccagtaatagcaatgaccttatagcagacaggttaatgttaaagcatgtccattacttcttgcactactctgtctgcattcaaaccgtatactttatgtagaaatgcaattattttattatataactaaaatggacatattggaaacattttggcaccatctcactttatggcataagaatgttttcacctctcacaacattcagttggagagggatggatttttatgtacactaactgattaaaattcattaatttggagatagacccaataaaacatttaagaaaacctatagttctcacgcctgtaatcccagcattttgggaggccaaggcgggcagatcacgaattcaggagatcaagatcatcctggctaacacggtgaaaccccgtctctactaaaactacaaaaaagtagccgggcatggtggcgggctcctgcatagtcccagctactcaggaggctgaggcaggagaatgttgtgaacctgggcgggagcttgcagtgagccaagatcgtgccactgcactccagcctgggtgacagagcgagactccgtctaaaaaaaaaaaaaagttaaataaataatatctaatgtaaagcctgggatacagaccgcagaataggctatatctcaggaccatagtgtataacaaatttacaatgaataaatggacgtaccgtgagttaagagagcaagggtgatgctgggtaggcagtgacaggtatgctgttcagggaatactagatgactacttttgaactcagtccttgtcaaacctctgacagtgcagtattgccaggttttaaataaatgaaaagcgaaagttccaatttgtcaaaacaggtacaacatcagagtaattagtagagcaaactctataggtttcaacgtaggatttcattaatagttagctgtgtttaaatatggtttaaagattaatcatgtgggaggctgaggcaggagaatcgcttgaacccgggaagcagaggttgcagtgagccaagatcccgccactgcactccagcctgggcgacagagcaagactccattttttttttttaaagaaaagattaatcgtgcacaattttcagagaaaagttatagcttaaagaaaaactgtacttgctctaattgaagaaaaatatgaagaaactggaaatgagataacaggtcacaatattggttaaatatattcagatgtgatctaagaaaaaatgagaattttggtcatttgtactgagaagcagaaatacaagcactaacaggttattttaataagttaaattgagaatgctttggtctaccagttggatagaggttatttttttctgaattttatttgggacctatggcaagtacctacaaaagatatcattgtctacatagttccaaatatgcaacttggcttctaaattgtttggggtcagtatctgaatgttagcaaagacgttctttaaaaaaacaaaccaacaacattttctttttttttttccctataaaagttgggtagatgtcatatgctctcttttctgtggaaaaagatgaagccttttgtctaggttgtgagatttgctctgctctctgattttaaacggtaattaaaatataatttgtaactaattccagtagagtttattttttttttttatctaaagggttccactttgtttttccaagaatcattacgagtaagagtcattgcctctcagggcttggcaagccctaaagttacgtctctttctcttttcccctccctctctgttccctttctttttatctcctgctctgacttgttcctttaattggctctaatataaaactgaagtatatctggtgaatactgttttgtgttctctgtttctaatttaaagaatggatgagtggtagacttttctctctctaaataaaaaataacaaacagtaccctaaatcaactttttgtatggttcttggtttttattagggtgggtcagtgaccctcaattaccaaagaagaggaaaaaagtttcccataccgagtaagcaagaataagtacagtataaggaactgggttaagaaacagaaaggatctgctaatagtatttttatacacagtgaatgattttatgtgaaacatcagctcctctaggaattgttttcaggttagttggatgaaagctaataatttctattgcccctgactccacaagaacatgattcatgaaccattcaaattcaatattttctgaggtggccctactcttctttggatctagctgcagtctttcatcttgttttacacagatgcttctactgatttgaattttagagtcttagtctaatgcctttctttgttgatggagacaaataaggccagacaatcttaagggacatgctgaaggtcacaaataaggcatgggcaagtctgtcctatatgtaagcttcaaagccagttcatgtcttcattccttaaaaatttattgagtgcctactatgtgcaagatcctatgctaagccccgagatgtgtaaagaaacaaagcagaggagactcctgctctcacaaagctagctttataaaattattttcgttaattctagtggcatatctggtagatcattctatggaataaatgttagaagtatctaaattcaaagactaaaaattccttaatattgattcaaaaattgagtaagctacacggtatcttctggtcataaaaaaatcttattacttttgactgatttacttaaccatagttttttctaacataattattaattttgtttataaaaatgttcattcaatgtttacttatttttctacatgaatattttctttataaacatggtccatttaaaaccagaacttgtattatttaattttgtttttaaagatcttaatggtataacatacctaccagggctaaatatttatattcaaacctcgtaatggactaataagaagtgagaacaatgccaatcatagataacattttttgaatcagacgctctgcttaacactgcatctcactgataacactgccattatctcagcctttatagcaaatctatgatgtagatactaatatgatctgcatttttaatatgtataactgaggattagaaaaatgaaagaacatgttccacgctacacagcaagtaagtgacaaagtggaatttgagaccaatactgcctgtctgaagaacactctcaggctgggcacagtggctcatgcttgtaatcccgacagtttgggaggctgaggcaggaggatcacttgaggtcaggagtttgagaccagcctgggcaatataatcaaaccctatctctaaagaaaaaaatatttaaaaaattatctgggtgtggtggtgtgtgcctgtagtccttgctacttgggaggctgggtgggggaggattgcttgagcccaggcgtttgaagctgtagtgagctatgatcttgccactgcactccagcctgggtgacacagtgagagcctatctctaaaacaagaaagaaagaaagaaagaacacactctcctgtaatgacatctagacatacagaaagtatttaaaatgctatacatgagttttacttgaagacggtttctcatgttttacctaaggcctgagaatgataataataaaggaaaatttgcagttttgcttctctcttttcaaattcttcatttttaaagatttgtagagtcaattaaaataatgaagtgagctagaacacagatcaggagaaatcttgaaaatgttaattaattagaaaataagtaaaattaggtgtgagactagatgatctcttcactgcttatggcttataatttctatctgttgaagttttacccatcattgaagtgtttgcttcaattagagtatcacctcaggaatcttcagattctatgagttagaatggttctttcctttctcagtgttccccaggtctttgtagctccagaatagcactcatttttttgttttgttttgtttattttactttgtattactattatatgagtatttcagatgactacataaatgtattctgagtgcctatatgattgatatagtctaatgaaaaaatcagtaactcttactactcattgacgggctcctaaatgccaggtactatatgagtctactttgcgtagtattttcaataacatcatgacccactgtaaacacacacacacacatccctggggcttatttaaagcaaaatcaggctaagtccatactattagcaagtagtgatgacaagtttggaatacatcccatgtcttaatcattgtattatactatccattaaaattgagttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaattgagttatgcctgaattcaactgcatacctcttatactaacttgccactgaaaaattcttttttttcctttcagttcactatatagaataaacaggtaattgtactttcagtgaaaacttcaagtggaagtaaggtaattatttgaaaaacatattttttcttttatgtagaggtcaaatttcttatattggcaagacattcatttgctttaacaaagtgttgccaatgtagcatgttatacatcttgtttaaaagcatgggcattttagcaaataacaaatgcatgtatttattgcacatagtaatctttattttaaaaaatattatttttctaaaaaattggcctatttatatgtaaaacacgaggacagtatttgggagaaccaaatttctggcctcttttggaatgaggaatgtgcctacaggttacatctttaaagttaataattttgtaaatatatacacaatatcatttttaaaaagcacttctctatagatgaaataaacattctctggttttaaattttaacccttcaattaaaatttaaaattacttgtgaatatcagttgaacagtatttgttcttgaataaaacatacataaatacagatataaaaatattgaacatgattttattccaattctttatcaataagaaatacagtttatgtgtgtagactgctttaagcttgccaaatactttaacagataccaacttccctgatatggagattatatattttgattaaaaagataactctttcattctaatcctctttattcaagtactgtttcattcatagattcttgggtgtggaaagagcattaaagatcctcaggtctagctatgaacccagtataggaaagccatctacttcaactttcctgagtgacaggaaggcaaatgcaaggttcattacattttgtttagttatattcgtttttttaaatttttttaattgagctatttttttctctgtttattataccaactgtattctcaattatagtaatttggattcttgaaatcatacattgtgccttatatattttgtctttttctggcttaacactcttggtgtggtaccttgatgcccggatcagttgatattttcttcaatttcttcacttgataagctaatttttatgatatcttgcttttgctctcatatagtgaactaggagaataagtggtctgatttgagatttaaaattgaatactctacatttgttggtatcatttggcttgcagcattgttttcacttggcagccctactcttatctaattagttcacagcaagcattttccattaaatcttagactctttcacatgaaggaacataaataattttgcatttgactttaggaaattggtgcaggactttacttatctttactaaattctaacttgtttgggactgtatgacttagaattctagaaaccattgtccttccctgtagccactggttttgacaggcaaatgtaattattatactttgcaactttatcttcttcaaaaatttaatgtgctcggatatttcaacttatgacatgcaaaataaaaagagaccatttaatctgaagactttcagctgtattagtttttaatttgcagagatagtggtcttccaaatgttaattaaaattttaccctatgtctactatcgttaattgcaattctggaaatattacagtaagtaattcgggaagatttcactgaggaagtgatgctaaaatttaaatctaaaagataaatacatttaattagactagggaggaggcaaagagaacaggcagggcaagttaatgattttgattttatattaattacaatggaaaatctaaaaattttaaagcaaagaatggcaaaatcaggtcaatatttgatctaaatatttgaaactactattctggctgccttggttagaattaaatgaagagagaaagtgaatttactgaggctagatagaacaagactgctggtgatggcagtagtgatcaggaaatggaatagattagaagggtttcaaaaggttaagttcacaggttataaggaaagagtgacagagaagaaaaatgagagaaatgtatcacagattactcttaaatttctggccaatgtgattggatttctggtagtgtcatttgtaaagatgggtcactctggaagaaaaccagcttgggttaggaggaggtagataatatgaatttgttttgaacatgttcattttgaaatatttttgagatgatgtgtttcaagagccataaaaagatatagaccctttgaccaagaaatcccaagactctgggaatgtagcctgagaaaatagtacaaactatgggaaaagttatagtcaaaaatgtccattgcagtgttttttaattgaaaaaatgaaagcaatgttaatggtcgaaaatagagaattgataataacaacttttgtacacctactaaatgaaaaattatttagctgctcaaatgattgtttaaaaactgttcagtaacatataaagtgctaatgataaaatgctgttataaaaatagttaaaatattttaaatactataattaaaactgtagaaacaatatgaaataaaactagaaaaatgttagaaattgcttaatagggtattaaaattataggtatatatatcttctttgtttaaaattagtagaagaaggaagttggaggaagaaggaggggtaggaagaggaataagagaagaggaggaggaggaggaaaaagaagaacaagaagaaggagaaggagaagaagaaacaagaaagagaaggaggaggaggaggaaaaagaagaacaagaagaaggagaaggagaagaagaaagaagaaagagaaggagcagcagtggcggtggcagccacaggagcaaaaggagcagaagatgactacaatgcgatgaagatacaatgaaacatagctacttactcttgtcacgctgaattctatgattatatatatgctgatgatcaaagttatgaaaatcatgtgaagggataaaataatgcatgcatgacttagaatttaactttctataaatttaaaattggttgttgattgctttgttcaaaaaattggagctgactcttcctcctcaaaatggagtgaattacaagtaaaattgaaagtacaattaaacctttttaatgatgacccgccaaacgaggaaaaaccctaaacaaagtgtatttagattatatttttgatgatatatgttaaatgcctttgctattatttgcacaaaattccggtttctaaaatggacacttattctgttattaaaattgtccaaaagctaaacacacaattaagaaggcctatactatttaacagttcccaaagcaaatacagttaggtttatatattagtttggactcccttcttattatatgtcttcacttttatatgcctactaattttgtaaaattcaggttaagatatttcatcagtctcctctacatattttacaaagctaagatcaacttatttcaacttattttaaacattataaatcatctatattggtatattttgtcagacatgatgtaaatatgcacatgatggggcattcacccaagacatctagtaattttcttaaaatattttaaatttacttacttgaaataaaagaatatgccaagcgagataagcagtgatgcaatagacaatccgtgtccaattatggtcaggtaaaacaaatttagtgcagtctgtaatttgtataaacaaaaaaatttggttcatatcaatactataagtatctgtaatcccacacatgcagaagttcaaattcagttgaataaactatatttttagaaatatgtgatctgatagccttacaatgatgagtttacaaaccaataaatacttgaacgtgtctggaatgaaaaatatctatccagtgaaattatcaaaatttataagttgtatgcctttttatttttttaataattttttaaaaaattagaagtcaaatattaaatctatgaggcaaaacttttattgatctagattatatactatatgaaactagtattttatattttgtgcaccttcaaacaaatgctacgtgatgatttgttttgttcagatgtaaatgccagataaaggtttattttcaaactgagtttctttttcctttgacaaatttgaagctcagagacaaatctcaatttgttaacttagaagattctatgatctgtacaaatgtgttctttctcatggttttcacttttttatttttatttgtctgcattccatttatttgtaacctaccactttattgtgtatttgtataattctcttccaattcttacctgaataagctgggaatatgttatttataaacataatgatagctggtagttatcaagagcttactatatgctaatcttttaagtatttcccttgtgttaaatcaatccttatgaaaataatgaggatggaatctattcttaccctcatttcatatatgaggggactgaagcagagagatgtaaaatggctttttcaaggtcaaacagctggtaagaagtagaaataagaaatcaggttttaggactcacagttgtaatcactgtgataaactgcctctattacaaacacatgcaaatacatgcaagtgttttctatcgaagctatattatagtgccaaactgtaattaaccttgactccaatgtgtagtgtttaaggatgcgatagttagtgcgaataacctaagacccagtcagaatgagatccttctgctgagggagggacaggactctttaaaccctgctgggcttatcctgtttacttgagcacagtttcagaggtcattctagaaattccactgcaaatggaagattttccttttcttacacttttaaggtatgttttctttggaaaatttgaaaccccaatactgaaacattgacttgtaaattacactattacctaaaaggattgctttttcagtgtaatgacaaaatcaataataattttttccacggatatatttcttctttattcttctcaaattatattatgaaaaggctttataagggaatggaataatgactttattttctttaatacagtattggacaaaggagctgtttaaacagatactgtaagttaaatttcaattcagaattatgacataccttcactttctcgtgggtgttaacattacactgggtataatttgtccatgttctgttgcttgctggatgtctaaaccagtttccatcttggtcacagatctttgtaactttttctttaaaattaaaaaaaaagggaaaacaggaatttaattaacctaggatttattaaatagatgtcaaggagatatgtagatacatttctgcttttacctgatggatcaaagtcctgaaagtaatcagggcagagctgcattgattcagttcctgctgcaacatcgttccagcagagccatccatcccaggttctgttgcagtaaacgccttagtggggaaataataattggggataattaaatccttctacttatacatgaagacatagttttaaaagtggtttcacactgatgtggagtaaaggctatctactgaaaatgcagacattatatgaaaatctatatatagaaattatttggcttcccaccaagtaatattataataatttctcaattaaattctaaattaaatttaaaaatatctaaatatataaagtttagatttaattttaattgtcaaaggtagctatttgtttaataaatcaaatggtctttgctagttgtccttagccataatgtagtgattagcgtccctatgcttaaaataagaaaacaatgggaaattagaaacatgtttaattttagaaactgtatgcttagggcaaggtgttagtattttctgaagcaagccaataaatattccaatatttcctattataccattgtaaccctgaaagatacttatttaggcccctccaccaaattctgactcttcattccttttcttttcaaataaggtagaatgttcaataatctcacatttttctccaaaattaaataaagaacttcttacattaaaatatataaagtttttttaaggcgtaggtaaattaaccgaccaatgttctaatgttgtaacagtctataattaaaaaagtaattttctttttttttttgagactgagtcttgctctgtcgccagctggagtgcagtggtgtgatctcggctcactgcaacctccacctcccaggttcaagtgattctcctgcctcagcctcccaagtggctgggactacaggtgcccgccactgcgcccagctaatttttgtatttttagtagggaagaggtttcaccatgttggccaggatcgtctcaatctcttgacctcttgatccgccctcctcggcctcccaaagtgctgagattacaggtgtgagccaccacacccggcccaaaagtaattttctaacttgtcagatagagatagaaccttgattgctgcatgagatgtttattgtttttaacagatttgcaaggcaatatcggcatttatctagccctcatgaaaatagaacaaaattctgatggcctgtaagttcaagtaaattgaaataaaaaccaacaaaattttaatgtttccccagataatgttttctgctatgtcattttttggacaattatttaaatagtttgaatccatatatttctagataaaatacattttatggcctattagaaaaaaatttcttgatgtagttttagaaagcatctcagatatgtccatatcacagctccaaaagtatctaattcactacagcattggtaatgtgatagagtgcaaggtccagaatttttgaaattgtgttttatggcatttgagttagatctaagtaggtattccatgaaaaaagtttctctggtcaaatggattttagagacacaaagttgaaataaaaatagctctttattgcaagactttctagagtatttaaaattacaaagtacattatgaaacttcaagaaggtgtattatgcaatgattccaaacttctcttaccacagaatacttttattatgaaactttacaaagatattcctattgttcaacaattaaatttaaaatctacttttacataatatacagcaagaaggcttggaagggtttcaaagttaaaaatatctaaagagtgttaaattttattttactgtgagttttacatttgatattttgaagataaccctttctttaaggttgccaggtaaaatataggacctgtttttgttattgctttatctggcaactctgcttgtgctactcatcttttatcttcagaatctagtcaagtatctggtgcttagcaggctctcaatgaatgttatccaaaaaagcaaaagaatatcttaatgcaaacagaagcacttagatttcattaactttgccaccaaatgtactatgcaaagtgtgtgtgttatgaaaaacaacacttttgtattcattatattattaggcaacctcctgtcaagcaggttgttaaaaaaaaaagaaatacacaattacataaactgaaaaagtcaactgtcattaagatttgtgtttttgtgttaatattaatacttatttgatttaaatatctttgtaccataaaaagaatcatactaaaaagatcactgtcacatatttttattgtttttaaaaagcgatataacatgatgtcataaaatgttcttcaaacataattaaaactgcacatatacaaaaaggtagcaatctatttttaataatggacctaaagcacttataatgatataatgggagtagttttcttttaaaaatatgtcaaatgcatttacaactaagtagccatgcttaccttctgcttgttgaatggggtcttgcataatcttttggtaacattcatattgagctgtcatgattttatttctagtaactcccaactgaattgagtcctcaggactctcttctaattctgctgtaacaagaatctaagggattaaaaaaacaacaacatcaacttcatgaaaaggattatgaaaatgtgtttgtcaaaggcagtctgtcacagtagaaaacagcaagtgcggtgatgtactggaagataaactggcgctctagggaaaaaaccccaatttgtagtgtttgctatttccatggtataaatatccccaccatgtccaatttcaaaacaccaacaagatgtcaccattggcagagtgggaaaccacagttggttctcagaagcctgtggtagccagctccaggacattccttaatatgtgttttggaatgtagacagagatgtcttccaatctgacccgaatgtttttcctggctctatgaatgaaggcaagatattgtctgtcccctcccccaaagcctctgcttccttattgtaaaatagtataaaatagcatcaagataacagaggagacgtatctggcacatggaaatacttacaatgtattgccattgtcatgatattttgataatcaaaataatggcaacatcatttatgatgttggtaaatagaaatttttcttgtatgcacatcaataatgtttttggacaagttatatacttattttcttccaatatagtagcactattttaagcttcaattctactttagtttccacgtgactttttttctgatttataatatgaagcccgaatagacctcttttttaacacttttagcagtaattgttgcataatttctattaactatatcccataagctgttatcttcctatccttcctttgcctcctcattgtagtatttcttttttctagcaggaagttgaatttagtaaaatcaaaatgacattccctcactgggtagcacctctcaagcttaagttttaccattgtgtgaccaccatttaacaataactctttcattcctttgttgttttaatttccaaataaagatttatgcagtggtagtgctacacaagtaatacatggaaatgtagaacataaagaaaattaatatatttgaaaagcacgtaactcctgttcttcccaaaaagtccataaaattgcaaaaatccatatgatttttatccctacttggaacacagactctgatttgtacacgatcttacatgagttcaagaggaagagtcacaatttcttaattacaataatcagttgctaatctgttacagaattacctgcaggaaagtaatgttctatgcagctcgctcagtggagggtgtgagcttaagtcaacttaaagataccgtctaagaagtgcaggatttggactgctcctagacttggaaatatttgctcctagacttgaaaatgttttcaaatacaaatgcggacaggaatgtagtcttgtttttttgttttttgtttttttctggtttaggttttctgtattctcccaagtttctttgtttccatctttgtggtgtttgcttggaaacacctcaagaaaattcttagctgccacaggattagatgagagtatgtctcttggtttttcatgtttataatgagataagagcacagtcactgttttattttgaggtagagaaaaacatgggtgattcattactataattaaacataaaattaagtgtatgaagtatgtgactcctccagcagagcaattgagtttttgtcttatttgcctaccttccaccttgggccccatatccccattgtatacatgtagaggggcagatgagtgtgcagacttatgcacacacttgcctcaaatttaacatcaatgtctgctaatttgaatgaatgattgaggaaattaatttaaaacaaagtgtatggttctaaattgccttgcaatcaagatatgtcaatcaactggcagaacgggagaaacatcaatgagagaatcattttttaacagatctaactctgaatctacaattctggttgaaaatattttctctactatgtacaacatgtaccatagagtcattccatttttttttcaatctctgattactttcctctggtgtcttatgcatgtgtgtattcatctttcccattctgatcccctccaattccttctcattctatacctgttataggactaaaagcatacaccgaatgaaaacacattattgctgtatcaattggatataaaaatgtaactaatttctgtatctagtaacttcattaatattctttatcaattataggtatactggaagcaataacagacataatcatatatatttttatgcttaccataaaaaaaggcaagagaaccagaaaattcagggtacactttttctccatcattaagccaaaatgaaatatgctgtataacataaactgcaacagaaaataaaagaaatataattcatcaatatttatgaaataaatgcagatgattctcaacagaaaatttattttaaaactacacaataattcaataattttactttaaagatttgataaatcattttttttaagacaaggtctcactctgtcaccaaggcctagtgcagtgccacaatcttggctcactgcagcctggacttcccgagttcaagcgatcctccctcctcagcctcccaagtagatggattacaggtgagcgccaccacacccagctaatttttgtatttatagtagagatggggtttcaccatgttggccaggattacaagtgtgagccaccctgcccagcagattaaaatatattaaaactgcaaatgtttaagagcattatggtgtcaaatgtttaagaacattatggtgtcaaatgttaaggagcttataaatacattttaatttaatttaattagacttacaaacagaaaaacttcttatagatagatagatagataagtaattagaaaacaacttgcattttttgcctttaccaaaattgggatcaaattataaaggtattacaatagagagtttttcatggacataaaaaattttgatagcatattttattataaagcttacctttatttcctgtaagtattaatctcattttcaattttctgactcttcagtaatttaaggaaggaaattgttctcaatttcttgagaatcaacatctatacatcattaaaatgtctttataatttaatagaaattattcttcactactgaaaatcaattttttaaaattaggaaataaaagattccctaagtcatctacattattcaaataaggtttcagggagtgaagagtatcgaataaaatatttgtttgaatatttttaatactaagtacaattctgagctaatgaaaaatggcctctaaaatgctacccactagcttcctaattctaagagacaagaaatgctggagtgtttttccaaatgcttacaccctgtgaagtccaggagcaacctactccaacatattttcaggatgtagccataactaaatgatatggtttggctcagtgtccccacctaaatctcatcttgtagctcacataattcccatgtgttgtgggagggacccagtgggagataaatgaatcatggaggtgggtctttccactgctgttctcctgagagtaaataaggctcacaagatccgatggatttaaaaatgggagcttccctgcacaagctctcttctcttatctgctgccatgatgtgatgtgcttttcaccttctgccatgattgtgaggccttcccagccacgtgaaactgtaagtgcattaaacctctttcttttgtaaattgcccagtcttgggtatgtgtttatcagcagcatgaaaacggactaatacactgaacacgcaaacaatatttttaaaggagagaaaaaatttccgatcaacagatatttgccactgacctgtaagcttagatttaattttgttaggaaactagtaatgattttatgacagggctaatttgggaaaaataattataaaaacctttttacgtgttcacaggttttgcttattattcttcttatgacattcaatgacagcacactattaattgtcacacacaatttgtgccattgctagccctcgccaatgactcacctagaagttgtagcaatcttgttttatagcaaccttgtcaagttgtggttgacaaattgaagtttgcagcagtcttgtcaagttgtagtagttttctttttagtggtagcaatctttcaaatattgttttctataggctagtatgggtttttattattagacgatcttgagaaaaatataaccaaaataccatgaatcattgtattaattttaataaaagtagtgttgttatagacagaaaacaatgagtcagtttatttaattcagtaattaataagttaatattttagtttttattaaattttaccatgagaaaatttaatttcccaatacttacatgcacaattgtctccagtctcaaatcacattttctcttggatcatatttgacattgtctttaagaatttcttaaattcaggggtcaagacctgaaatattgatgaatgtaataatttaatattatgctaatgaccaaaattatttccatgataaattaaaaacttcaaagaaaatactgctactaagatcatatttttattgaacaattccaactttgaaaagcctcttttgcttacaatatatttgggttattatatagcattatattcacagcatgggatgtttcaatatgaattatagatctatattatgagaacacacttggtctagaaatgtacatattttctatgagtaaataatttttaaagagtaattatgtcattttcacttgaaaaattgttgattttagatatttacatttttttcatagaattactaaaatgttttccttaggcatttataagttagataaatatttctttatttattgtatctatagtcatataattccacaaatcattctaaattatactgcctttaaaaataaattttgtgttttaatcttctcagtggagctttaattattatcaagtattaatagcaaggtgaaagaaagaagagttgttttgtttttggtttttatttttttgtacacattttttgtggaagagttgaaaatagttaacagatacagtaactcctaaaactctccttatcatattaatgataatttactaggatttctgttaacaaaaaattaaagcaatttacagttcattattagacaatactcttacatgcacatttcacctggaaatgtgatagggaatgatactggacactacagatttgttgtgaccattaaatgattttgactatattgtggagccctgaaagttcccaactcatggcatactcttggctaagttctatttcccatgcaatttaatctaacctaatgaaatgccaacctattcagctttatttgttagattaatataaaaatttactttatagattctatatacaaaatcacttctatatttattaacagatatattttattttaaattgattattttaaacaatatcacattctttataattatgcattttgcaaaactctatcatttaatccatccctaaatataaaaaagtaattgatttttgtattcatggttttatataggcaaaattgcttttgcaaatcactgtttggtgtttaacatagtacctgacacaacctgagtgctcaagaaatttttgctaaagaaataagagattcaatactaaataaatgattgattaatagagatttaaggattctttctgatgggctaatttctttctcattgtctgcactttataaatatatcatacttttctctattacttcttcttctttttttttttttttgagaaagagtcatgctctcgctctgtaccccaagctggagtgcagtggtacgatcttggctcactgcaatctccgtcttgcaggttcaagagatttgcctgcctcagtctctcgaataactggtgttacaggcgcccaccactgcgcctggctaatttttgtatttttagtagagacagggtttcaccatgttggccaggctggtcgcaaactcctgagctcaggtgatccacccgcctccgcctcccaaagtgctgggattacaagtgtgagccaccgtgccttgcctctattacttctttaataatcactagtatgtttcttagtatgaatgaagatagatagtaacaagttaatgtggcaaactcaaccattttatccctaaatatatagaaaccaatgaagcagagctcacatttctgaagttatcacatttttccatctagaacttaaagtataatttatattagaaaagttacaacaatatcccaaaccagctaagcatagcaacttttttttcagatatattttattttaatatttggtcataatttttttacaaatgtttgttgttttttattagatggagaaacttacatcaattttcattttttcaggatggtggggacactgggtaatctaactgaatattttatttaagtaaattttaaagaactaaagtatggcaaaaagccttttgaattaaactatagtttgatcttcctttgattaactttatctacgaatttattggaatgtatgattattattagtaacgtatctatttcccttgcagatatggtttcatatctgatttatctttgcatcctttgtgactgacagttaacaaatgtttaccatatacatgaatgagtaaatgaattaaaacatgaaccagtaaagtactttaggatcctaaagtcacaatcaagaacactgatcataactactaattgtaatttattttattagaaagttttagacagtgtttgaatatgtactgacaatgaaaattgttgggatgtttcctatatctacaagtctactttcttacaaaataaaatcctgaaaactattcagttttgaatttgtgattacttagatgttaaataaacagtagttttctgtactgcatttggaagacataaaggttaaaccacatttagggcactgtagtacatatttaagatattagtagttcatatttttctgaataaaagtatatatatttaaatatgctagtaacaatgtaaataaatattattctatgtaaaaatcacgtatgttttacaaaataattttttaatgatttacgcatgagtcaggattaaattacctttaatatgcacatgaactccaaatattgaggggcaaagtgcttcaaaagtcatgtctgaaggttttccaaaccccacatatttgaaacacatttcatccaacattaccattatttttgttgcttatctaataggcttcaaaatcagagttccaaaaagtatcttagtgaaatatctcttagtggtaactaaatcatcctgacatcaataattaaaaagtattcaactcacaaaatatttattaatgcaaataattccacttttatagctttccttctttaccctattccctaatgatctgaaaattgtgctactaggaataaggtggtatttttcactgtgtaaacttgtgtattcctaatcaagggggcaggtgtatggcccctgggtttgtcaaagatagagcagcaagtttaggttagcagccattcaaacacataatgggcacctgtacactccatgagatctagcaatgaccaaatcatttggtagtgcaattcacttgagtcatctactttgcaaaggacctatcaaagtttccttgccagcagacacgtggtgagaggtagttatggaggaatcatccctttcaccaagaggtctcaaattccataatagatgaatcatggcaaggcatgtgcataatgccattgcaaatatagctgaaagtcaacttagatagactctcatactgggagatgaaatgatgacattgttctcaggagaagtatgtttaactgtaatccttggtttcagctcactggttctctgcatactgcctctaattggctgattcagcaagtacttctctctatatatttagctttttctaaatatatcttcactaaaatacaattgatgctagttaaccaaagctgttaagcaaatcatttttaatctctttcagatcttgttaaattatttactgataattgaactgcatgttacatcatgaaatataatagtttccttttaattttgaggacagaccaagcaaataatgaaaagaggtcaagttaagtgattaagccagccagagaatttttccatatgttccaaggtttgtttagtaggaaaagaacttcagagttgtgaaagctctaatttatactgttaagtaaatttgtaatcatattggcactgctagttgttactggcattttctcttcaagagctgctagtctcatagtttctataagtactattttattttcctttttaaaaattaaactaagtggtttattactggaaatgagataattttctttactatgcaaaaagaattttaaaagccctttatttcaaaatgttttccatgctttggcccccaatatcttcaatattaaaataaaaatgatatatttcatcacaaaaagaactgtgaaaaataaaaatgtcttaaaatctgaaataccttttgaaatattactgcctagtcactcaaaaatttatgtaacttacaattctggtttaatttcttaatatattatacatctaccaagacaattttcccaaatacttaaattttaagagggcaatcttcttgacatgcaatagtgtaaaagcatgttttattgtacataagcattagaaaccaatgtgacttaatcaatatttataagaacacaaaaaaacataaatcctgaacatgcaccagtgccttgcaagcctatttcttattttctaaaatgtgtattattcctatacatactttccattaatttatgtttctttataataattcttatttttcattgagtcacctagccctaatattgaaagtgtatgttcactccaacattaagaaaaataataacctaatcttttgtttctgtacttttgaaataacttcgatttttacaggctctaaaccatactctgtttttcatttatgtatccattcactaaaagttggctaacagaagtactttctacacatacttaatttgccataaggttcacccacctgaacctttgtgtgagcaaagttgagctatgtcctatatattatattacatgctttcccttacttatggcatattaaacaagctacatatctcttgaatcaaaacaaggaataaacactctactccaatcgcagagttccacacctgcatggcaaatggaaacttatttcaatcattctacacaatctaaaaaatgtcaaagttcaagagcctggttaacttatttttctcactgcttatttttggaaaacctaagtctttgtgctagaattgttgttgcaagttaatatctttacttccaatagagtctttttattatttattattatttttttagagacaggatgtcactctgccccagctgaagtgcagtggtacaatcatagctcactggtgccttgaactcctagtctcaagtaatcctctcactttggttccccgaattgttgggattacaggcttgagctcctgcacctggcctccaataaagtatgaaaaagaaattccagtgtaaggttttagtgcccacttcaacctagcttggaatgtcactcacacttttaatatataaagcagttagtgaaacaaaacataaagaagctttactttcctgaagacatgttacggatataagattataactcaagctgtatgtcctctttaggatgtcatttgagtcatgcattattttttaagctattgagtgagcaggtgccaaatcactgatgtagtaaacaccatgtcctcaaagtgtgaggttgtgggccacctgcatcagaatcacccccaaaacttggtgaaaatgttaaaatggccaggccccacaaaggacgctctggaacagaaccttttggagaagaatttaggaacctgcatgtttagtaagcacccaagtaaattcttggcctgttatacttggggaagcacaatataaatacttcatcctcactgggacatgccgaaacctgaacacatttgtatttcactgtttctagttactagccagactattttaaaagcaactataaagtataaatcaagcaaaatattctgcagtgttcccaggcattattaatgtcacagaactcccaaagcaagttattcaaatatctattttaaaacataccatgtaatcttataattatttctttatgtgtctctgccatgagattgtgagcacagtaagaatagggcaggcagcatattcatctccggggctacacaccctaacaaagtgatcacataaagagggtatacagaaagtgtttttaaagtagattgcttatgaaataaatttaatcaagttgaagaaacctgatgtttttagttattcctaaccctttcaagcctattataattttctgagtcataaaaaaagatcattgcctcgattctactccaaaaatttctgattcaggtcatcttgcttggggaccaggaacaagcattttttcaagtttcccaggtgattttaatatatagctagggttgaggatacctggaatagatagaagattcatgtggtaggcagaatgataggcatacaaaactttccatgccctattcaccagaatctttgattacagctatgatttaggttatggatcttaaaatagaatgattgacctaggttatcttgagttatccaggttagttgcaaataataaattgagctcttaaaagaagaaaagaaagggtgaagggtcaaagagatgcagcacaaggggaagcagaaaagatgaaagcctgagaaagagttgattccttgttgctgactctgctgtggagcccacatgcaaggactagaaagtggcctcaagccagcaaggaaatggggacttcagtcctacaaccacaaggaattgaattctgccaacaacctgaatgagtatggaggcaggttctcccccagagtctacaaaagggaatgcagccctgccattacttttattttgaccatgtaacacttgaaacaaagaaacaagccaaggcaacagaactgaccaatagaactgtgagatagatagtaaataaatgttgttttaagttactaaatttatggtcatttggtacagctaggatagaaaactaataaaaatccttacctgacaaaaattacatttttttccatcaaaccaaagtagtaactctgcttcccaactagccagtcattcctcttaaccttaacaatacattcatcctcctgcaagacaatcccattagctagaagtgtttcttctaagctgcttctaaattgctgtgtaattttaagaaaatcaactcaactattttctgcttggtttactcaactagataatgagtataaaacttgatcgttaattgagcttcctgttttctgttgcatacttattagaagacacacactaaagtcaaagaaacatatctttaatgccagttcttatacacttaaactctctcaaccgattttctaacctgaaaatttgcataaaagtagtggctgtttttagaaggttaatgtgaccagtaaatgagataatgctaatcaatgcctggctaaatcaatgttgcctataacttttatcatagctcaccttgtcggattattttaagtgttaaattacatgctagatataaaaaacttgcttaataataaatacacaataagcattagctattgctattttctgtatccctctataattctgttagtcatggcagtaatcatgttgactgaacaaaccaggcaaatccagcatgcaaattgtgacttggccaaagtcacaaagatgcttaggtctgactccaagctcagaactcaggttttctgaccttaaatttctaccctttgccctgtatcatactgactcggacaatggagttgtttatttgcataaagtgaaggacacatttctattttgcttattcagttattttgcttaaccaccagttttctcattacatgtcacttgtactcatcaaacacatttatactttttcccaacaatttcttcttttcattcctcttcttagcaatgtcatattcgattcttttacaaagcttacattaataaatggcttgacaactcatacttgccattctggcaaggtcccaaaataaaaacacatgtactgtctcgttttctagcactttaaaaaatgcgttttaaatgaagaaaacttcttctagaaattaaatttgttaccttaccctatttattgagcatctacttttacctagtttggtagggtgaaggtggtgagatatgttaagatttctgccctcaataaaagtatttatcaagttgaagaacagtattctactgcttttgaggcttacttcattgatttcaaacactctccatggaactcattcatgaggttctagcgagggatgattttatcaacatttaaaacaggaagttagtgtcttcctcagtcccatctctgtcattcattgaacctgggcaaattccatgccttcccaggtgtttcctactcatcaaacaaagcattagggtaaaaggattaagccttgggtaagagttcaaaatttatatgaaaagaaaaaaatgattgttatacagaaacagtttttactcctagtaacctaaagccaaaatagccttaaaaccaaatctctcctgacactgtttgttgttgttgttgttgttgttgttgttgtttttcctgtggctcaggaagactttgtgtatgtctcctactacctaatagctcacgggaaaaagtggaccatttggctaatttttctctcattacatgagaattcagggaaaacatatctaggccaaaaaaaataaataaataaagaaaaaaatcacttatcttgctctcacctcttcatatactgcctcttttgagctattcttacttttgaaaggccattcaagaaacgtctagttctctcttctccactgcagaaagtccaaattagaaaagcaagcacacttcttcattagccccctttccagatgtctcagaatggaatctggtaagttcatgtaccctaagctaaacttattaccatcatcattggaacaggcttaatgcttataggactagaaattaacattttctgaattttggctacattgagtttttatcttctttgcatttaagagaaaatcactaagccaagacttttaaatatgcagagtaacagaaattataagacacattaaaaaatgattcaacaatgtctaaactcaacaaagtaatttaaaaaaagaaaattattacatttaagccattaaattcctatggatgacctggtatagaaattgccaatttttaaaagtcatcaaaaactctcatgaaaacttctagaaagtattttatttttgaagagatgcctaaatttaattgtaactattaaaatccacattaaaattcatatataaggaagtatatattgttaatatcgtctcactggttaatgatacagtttttctttttccaaagagatactgaaatttttaaagtagtatccaactgatatttaataattcacataatgaagggatgatgtctaataccagttacaagtagaaacagtagttgtactggttataaatatgagttagacttcttgtttttaaaatccaactcagtcacacactagcaaattaaacaacttctttaagaatagttttcttttctgcaaaacaactcctacaccagaaagctattgtaaaataaaattagataatacaaacttcttagaatgcactaaatatgacttattataccacattaaaatttttgtaaatataagtaagcttattatacatattttcatttatttgccgtaatttcaataacactgtatgtggaaaactgactgtatttcaaggcggtggtcacatgcatcttgagtttttttttatcttctgcagaaataatgtggttgttttttattctgtcatttaagtagttatgaaaatatcaaataaagtgaattgtaagtatattcccagataggatatcaatctagttaatatgactgcacaattactaatactgagcctatatataacccaaagctctagcaaattttttataacattgtaatcaaatatggacttcttaaagaatataatgctaagccaattaaaaataagacataaaacctcccaaattttactttatttttttgttttttatttgtataaatttaagggttataagtgcacttgtattgcatgaatatagtgcatagttgtgaagtctgggcttttagtgtaaccatcacctgaatagtatacattgtacccattaaataatttcttatccctcaccccagctacaaccctcccacccttctaaaccaccaaagtttattattccacactctatgtctttgtgtgtacattgtttagctcccgcttataagtcagaacatacagtatttgacttttttagttgtttcacttattttaaattggttataatagcctttcctaacactgtactggaacaacaaaagaaaacattgaccctatgcttacttgcttatttaatgaacattccagattgaacagttgaataactattaaagagagataattttgtgattaagtttgggacttcactttacactgtaatgtacttactcacgggactgattttcccattgtgggcataattagccattttccggtgattttagtcaccctctttttatttgaaagaggcaagcggccaaatctcagcccaattagtaaaaggtggaagggagcctgaaaaaaatgctttgtacttgatggaacactctccctccaggagatctaatatggaaagaattaattgctcaaagagcactgaaacaaaacacatctttccagctctttggaatgagagccttatacttattttccttccacaaagtcaggagtcaaatgctatgtgaaaacatgtcttgttttgtttttcccaccaacaataaaatcagaaaatatataattctgatataattttaagttgcataccagtccataagcaaaattatgatattcttgttacattgagctttccaatcattctcaaaataaaatttatatggcacctactagcacattccaacttttaggaggtagaggaactctgttgatactgtctgattagcacatcttctttattgcccttaataaaatgaacctttttccctatagagaatccattctctctggttcaagtaagacctccctcttgatcactgaagtaggaactgattgaaatctggtcagactagcacaatcctctgattaaatttagcttggtcatggacatgtgtggtccaaccaacaccactggaattctccctgggacatttgtattgttgttattagggaagctttttctttctgctggggttgcaaagcaagtagggcatgaatatcagacgattctcatgcatccttcctatcatacagagaaaatgttaaaaaatgtggtcaagtgaaggcaattagctgagattgaggattggtggagaatccaataacattagagccctttaatttggccgtatttgaaggcagatacaattctagaaatcctcacaaattagccattaaattacgttttatgcctaactgatttatttggagcagtgtagtggaataatcactatgtgtggaataagaaggctccattttgcattctgattgtgattgaatgccctgaatattcttaggttagtcactttgctgggtcttcgtttcctgacctgtaaaatgagatggcttcaagcaccttttcatcttgtaatgtagatatttacagattgttttctttttcacaaaagaagaacatcatcttttacacccaaagcacattccatgcccagcaaataggagttcaaaactgacttttttatccaaatacatctacggagtaatttttttctaaagatgaaatagtcttagcagtatatgctcttggataatccacaactaatatgtacctatggcgagatattcatacccagctcaaaaagtaaatgcaactcttagatgaaaacataagggtaaaatgtttgtcacctcgggttaggcaatggctttatagataggacattgaaagcaaaagtgacaaaaaacaagtaaattagatgacatataaattataaactttgtgttcaaagtatactatcaagaaaatgaagagacagcacacagaatgggagaaaaaaattgcaaatcacatatttgaaagcgacttatagctagaatatacaaataaagcttactgctcaataataaaaagaaaaacaacccaattaaaaaatgggcagagaagatatggagtcaatctgagtgtccatcagcagatgaatggataaagaaaatatggtatagacacaaaacagaatactattcagccataaaaaagaatgaaatcttgtggcatcatggatgagctggaaggacattatgtcatgtgaaataagcccagaaaagaaagatgaatactgtatgttctcactcatatgaagaagataaaaagttgatctcatagaagtagggtagaatggtaactactggagtctggggtgggtagcagggagagagtgatatggagagaatggtaaaagaatacaaaattacagctagataggaggagtaagttctggtgttgtatagactatggagtaaatacagttaaaaataatttatattttcaaatagctagaagagaagattttgaatgctttgaacacaaagaaacaatataagttcgaggtgattgatatgctagttactctaacttgatcactacacattgtatgtattgaaatatcaccccataaataggtaaaattattatgtgtcatttttttaaaaaaattgatgggcaaaggatctaacaaatactcaataagctcatgaaaagatgttcaatattcttagtcattaggaaaatgcaattccaaaccataataaaataccacttcatacccactaggatagatataataaaaaagagagacaataacaagtgtaagaaagaatacgggaaattataaccaccatatattgcttataggaatgtaaaatagtgtaatcattgataaacaccttagtagtttttctaaatgttaaacatagagttactatatgacccagcaattccacttttagttataaactcgagaaataaagacagatatccaaacaaacgcttgcacacgaatattcttagcatcatttataataattaaaaaatggaaacagctcaaatattcatcaatttgtgaatggataaacaaaatatgatatattccctataatgaaatattatttggcaataaagaggaaggagtacttaatgcatgctacctacagcatgaataaaccttgtaaacattatgcaaagtgaaaaaagacagtaaaaaaaaagaaacatattatatgattcccatttatacgaaatatccaaaataggcaaatctataaaggtgaaggagctattgggggttacctaggactcaaggagtgtggcaatagagagtgattgctaatgggtacagggattttattcagagtaatgaatgtgttcgaaaatgatagttgtactaccttgagaatatatacaaaccattgaattgtattcttttttcctttatattttaggctcagagggtatatgtgcaggcttgttacatgggtgtattgtgcaatgctgaagattgggcttttaatgattctattgcccaagtagggaacatattgaattgtacactttaagtgagtgttctcatgaagtgtacgggtatagcttagtaaagctgtttttaaaaaagtaaatgccaaaaggccatgtgtatctaaggaaagacttaatgctgatcatttagtcttctctctcacctctcctgccttctttagttaagagacagatgatattcacattgtaaaacaaaacacatcgaccaaagaacctgcctagctaacacagcatatcatgcatgtaaactctgaattactccttcagttggatacattatttcatattcaacaacaaattaattctattttatatatatagaactgctttgatttgaaaaacatacatttttcttgaaatttattttcaacaactaatttttaattcatgcacaaaatattgtctttcctttgataaataaatttaagtttataaaaataaccattgtacatagttgagggaaaagatctatatacatacttagaaaatttcccttaattttagataggatctataattgtttatctttttctcctgtcagtgatttcactttacagattttaatttcttataggagtggagcactgacaatttacaaacaaaaatgtagatattttattatatttgtgatttctgatattttaattgtgttattacaaatagaaacatcaaaaatacaagagaaatattagcaagaaaaaatgttgaactttggtttattcttggaacttgacctaggttagaaattttacatcctaactatactccttctatggagctattacatggtgaaagaaaactaaagatggaaaaaagaaatcaaggaaagaaggaaggaagaaaggaagaagggaaggaaggaagaaaggaagaagggaaagaaggaaggaaggcaggaaggaaggagagaaatcaatatgtgtatctcaggtaaatgcacactttaaaaattgttatttttattaaaagtaaataaaatgttgatatactaaaatttgtttctctggtgtgtctcaatttcttacaaatactagatataactccatcttagtaccttttactatattaatacattcattcattcaaacatttatttaaaacctcatatgttccaaaagttatattaagttctagggatccagaaatgctaaaaatttctgttttcagagatacttaaaactttgtaggagtagaatgatatgtacaaatatgagtaataaagtattataggtactcaattaaattttatgtgtctaattgatcagctggaatgatgcattttacatggaggaagtatgtttgtgagtgtgtgtgtgtgtgtatgtgagagagagagagagagacatctacgtagagaatatgatacttttctggagtgtggacataccaggtgcttgagagatgcaggatacatgagatgagagatgaggctttccagtaagacagaaaagcagattaatggtactttctgttgtactgaggagttttgatttaatgctctaggatagatattttcattttgaatatctactctgatttgctggtagtggcagccagaactgctacactgagcaatgttaaagttaatctagtccagtgaatcagaaagagtctcctgagtcattaacgatgtctgccatggcagcatcctgagaaggaatggcatgtattccatatatttgctaatgctgttgcataaaatgaataataattgtaggaaaattatgcagtagagccatatgacaaaattttcattttagaaacatgaaatatgatggtatttggaggtggggcttttgggagataattgggtttagacgaagtgatgggattaacatccttatgaaaagagaaagaaagagataggcaatctctctctgcatgcaccaaggagagaccatgtgaagatacaacccggaagagggccctcaccaagaatccaaccatgctggcaccctaatttcagacttccatgctccagaaatgtaaaaaataaatgtttgttgttttacccaccaagtctatggcaatttgttacagaagccttaaactggtatgatgcagaaaaatatttaaaagagttattttaaaaggtttcgtgtataaggatgtgagagcttggcaagtgcaagtaaagtaaatggattcctgaaattcaatcatgggtatctgagtgggttccaatcactactatagagaataccatagaataaaatgggtggtggggaaatacctgagtgcagttctcacatcttgaagaaaaaattgtccaggagggtttttctgcacagttctgtagatcagcaaaggagggccttgaaatagaagtttcacgcccatcgtcataggacacatttgcagttaaagaaaggtgacattttgtttggaaaggcagtatgtgctaaaacatgtattggaattgaattataacatatttcaaaacattcgtgtttaaggaattcaaagttagtaacaaggtgaactggataaagggcagagtttgctaggtacaaggaactaaaagtacaaaggcatgggtacagaagtgagtgcagctgtgtaactagaggtaaaaggacaggcctgtgagaagcttgaggtctctggggaaattaataagtggaaacctggaaatgtgacttcagtcatttactagacaaagtaccatgaactgctgtaattttacacataccaaacgcagcttatttttaatcatttactcctctgactaagtctgggttataatttaaaaatagatcttccagtgtaaaagaagttgcacaggaaggagatccttgctgaattaagctgtgcttaagtgagaactgccgcttaagaacaacacgttccctgtgaaaaaagatggcaaatccatttcagtgagcctaacctttaccaagtgctattatcaactcaattgtatgttttttcctgtttcacaaacatgttcccaaaagacttttaaaatagctttctttcctgctaaattgttgtgccaagcactttttctgatttgcacccttaactggaccaggatgtgttaaaaaaaaatgccccgtcatgcttgacagagtttaatagaccttaacaacaacagcgaaacattttcctaatgtgactgtccctccctcaccgaatcttaagatggtgcatttttatcaaaatataaaataccctgaagaaactaaagaagcaatagtgtcttaaaaagttactctattaaataaaaacatctagtgaaaaatctgtccaccaaagtaagattttgttttcctaacaaagagaaaaatgtcactacagaaaataaagttttttataaaagttcaaatcatctaaaaaattaatgatatgaaatggttccctaggtatcttataaacacttttatttattttttttttttgtagaaaacacaaccataacatcctggggtctatcttggtcatttcaaaatgaatcccatgcactgctggagtatttttctcaaactgcagcttggctcgtagtttaccgtgtgtgtctgtctttccagtgaggagtttccttactaaattctttctgagctgcaataacaatggcaatctcaaaagaaaaaaaaaagacgacgaaagtaagtaaaaaagaaacagcatctgatggacactggtggaggctatggctagaaaactcacatgaatgaggctttctggagcaggagtcagtatgggtatctgaatagtatgctgctttagacagcagataacaacaatgaaaaataatagcagtagggacttgtaccagaggaaaaaaaagatagagcagtaggaagcgagacacagggcagagagcacaggtttcacacggagcgactctgagtttggatactagggtttggataccagctgtggaactgcagtatttcctaactggaatgcaggcagaaacctaacctgtaagctttaccttctgtagctctaagatggggaaatacatgtctcataagtatattgtgggggttaaatgtaataacccacacaattccatatcacaaggactaggaagtgataactgctaagtaagtggtggtctctcccctgcagcagaaatggaatgtcttggtttggtttaattggcctcagttagaagacttataattttgagtaaaattatatgtgaacatttaacaatgccaactttcccagctttctgtaaaggaggctttgtgagctcatgaacacatggtaggattttaacatattttagcgtgaataaggatgggcactgtctccaaaatcacttgttttctcaccaatactaattgtctctgtatgcataacactctgctttgttacggagtaccttttaaatatatattaaccttcccttctaagagtggtaataaacaccagtgttaaagtctcatcttttctcatcatcccgaggacagtattgttaaggaggtgaagacatttatgtcttgtcacaaacacagactctaaaatgacttgtgtatttgcattattactcttgatttgtatttgtttcatcaattcctagaggaagagcaaaaccagtgaaactgaaggtgtgggattcattacctggaattagcactcggttattagttggagataaatttgtgcaaggagataaaatgcagacggctgaaacagtaagaaagaaaagcttgcagccagcaattaagcttagcagaaagtttgttagtttggaggaatggctgctgtgttcctgagatacttagtatgcaataactagggaaatcacttaagaagttttgtccttatgaagtacttccattggactatttaagtcctgtgtgtgtatacctgtgttgtctgtatgtaggggtgtgtgtgtgtgtgtgtgtgtgtgtgtgtgtgcattcacatgtgcatatgttttaaccatttgggacaaaccaatgttgtgtctgttaatataaaatagtaccagtgtggggctctgaagcagttgggctttatcacctcactcagaatgacttgtcaaaacttgacaccagaccaccaaaccaccattcccaaccaacacaaaacaaaccaaaccaaacacaaccaaaaaaaaaaacacaaatctgatatgttgtatgtgaaaaacatcagttcatcatctaaaattattgtttaagctcaagagcaactcaaataatttcttggctgtaatattgcatatattttgttttaactctattttataaaaattatttgtaagcaaacgtgttccttgaaaaaatggaagtaaatgtactagtgtaaatgtacagaatattcaatacacatgtcaaatttaaatttctactaaaatcgtcatcataaaacatatcttaggtgaattctgtctctgcaaatgtagaacaccagttgctaagaaaaagggaaaggcaaataaataaagaaaataaaagaaaaggaagcattgagaagtctaactgtatatttttatttttatctatttttatctatgtatatgttatttttatctatggtctttgtaactaaccattcctggtaatgctgtggttggtactcaaaataaagatccaataattgttagaaaaaagatgtggtttggtcactttttgctgtgtacatatgagaaagagacagagacagagaaagaaaaagaagacagaaggacagtcttacttggtttatttcctactagaataggagtgatggaatcaacattattaagtacacacaaattaaaaactgaaaaatcttttagatgtatgcagaacagaattttggaaaaaatggagctattttgtacaataacgctagtagtgtttgtgaagtctaccatctatctttttaggacttaactatcattcccaaaaaaccttatttgaactcataacttctttagtttcgctccaccttatgcctacagcacaaataggctgaatgtgccttttgtatgtgccttctaacagcacactatcacactagataaagttacgtctgtttttgttttgttttcttttttatcttccccactaaaggtaaaagctatttgagggcattgcctttttaatcattgggattccccaaggtattgtctggtattcattaatcttcataaagttttttaatgaataaatacatgaaataattatccattacaaatatgcatccatagtgatgataattaacattgttttatactttacgaagtctgatcacagtaaaacccacatatatttagggagaataaagactggttaagataatttgttttgtctgtttgtaaagtaaataaggaaaagcacttgaactactcaaaggaagtgttttctcacatttttgaagaaaacaagcaaaaaaatagtaggcaataataatattgtggcagttaaaatgggaacattgtaaacaatttcaaatgaattatttcttttaattcagaaataatgcatattcaaaattttagtagtgcattttcgcctattaatcttagaaatttgtgctgacattgacttttatattacgagagaaaaacttcaattttaataatacaagaatgaaaagtctttgggcataaggtaaggactgctgtgcagtgaaagataaatatacaaagcattgacactaaatctttccttagcaacaagtacatatttaggtaacatattgcatttaaaaaattcaaatagcactacattgaatatgaataaatccaggttctaattttaactaaacctggggattacagaggagactgaagtgaggctggttccagcagcaacaggtgtgattctaagacttgttttgcatggtgcattaagctttgctaatgttcccacctctatatgttaactttgtttctgacactaagcaaactctacatagtttgagcaaaatcacaccatttatcttttggtggcctcagattatttttatttaatttgtaaaataagatactagactagattctcaaggtcctttttgttctttaattctatcattctgagggaaaaaatgtcattactattacatccaagacatatatattaatataaatacattaagtattgaaagccaaagttaaaaaaatagaaaaccttttctggttaatttacttcagatatacgtgaaacaaaatattacagtttgcaacacagtgctattttcatgtttatttatatatttatgaaacatttttggattttgttttcagctagggtgaggtttttctttctccttccaatcccttattaataaatgaatagggcaacattctcagaagcatgacagtatatattaaagtttatttaaaacattattgagaaatagagaatctagaaataaaacccaatgatgtttaatatgatgttcataaaattatattatgtactacatatctttcctttaaaacattacgatgatacagaagcctaaatgcctattgcagaaataaataaatgtatttactctaaccttgtgctagagtcctctgttctgtacagaaattaatagtaaataataaaacccccttctatggctggttttgtttttgctcttgggataactaaggattttaattttattgtaatttatgtacaaattctcacatctcagaaaacctaccaggaaaattttaatgaaataaattaagtaatttaataactgtacagtggagataattatattccagccagagttaaaaaatagctacaccaagaaaaataatatttataaatgcagttttttaatcatttttattccattctccttttctctgtgctttctatagtcacattgtgctgtataatattttatagaaatatagaacttgctttttcctaaaaataagtagcaattacattttaaagggagcatgaataaattaattcagagcacataaaatgttcacaactactcttggttagaagtctgaagtctttccttcttcttccctttctttcttccaacactgtaacagtccttgtgagctttttgtaaagaaatcttttacatgtgaatgcagttaattgactccctttaccaaataatgatggataatagccttggtctccctgggaaagtgtttacaacatcaagtcattttttttctccttccactgggtcagcctttcaaatatatttgctttgattcggggaataaccttagtagggtgtcaggatttctctctggatcaataaaggaaacgttattaagatctaaacatctgtcagaagatatttatgaaatacttattttctgatattttctttctaaaatactaggctcaaataactgtaggcaaaagaaatttggtacaaaatatttgagtttatagaaatgtaagtttagtgccatgactgcatacaccattgaagacagcaactgtccaaagcataacctgcagtgaaattattaaatgtcatgctgtaccttggaaaagtttaactttattcacacattcaacaaatgcttattgagccactggtatgtgcctaacacttggctgggtgttgggaaaataatggtgaataaaagattagatgcaggcccttgtgaaactataataggggagacaggtattaatcaaatattcatacaaattcaaaatgacaagatagtcctatgaaggaagaagatgacctaatctggagcattaaggatggttccccagaggaaatggtattttactcacttgatatctgaaatttgagtcctcatcgactagggaaagactggaggtgggacaaggagagtgatttggagggatgagaaaaacataagcaaatgccttctatggaaaggaatggagggcagaaggcaagggagagagctgtgtcaggtgaggctgtggaagatgcagggaccacactaagcagggagtttgatgacttgttaaagactctggcctttgtcttattacactggcaaacctgtgttttcagtagctgaccagaaaataggtggtttagcactgagcaacaaaaatcagagagaaatgggttaagaagtgagggtgaaaacaagaataaggagttcctttgagattttggttttgtaaagtcagaaaatggggtatagtggtggatgtgggagaatctgtagggtagaaagaagagttttgtttttgaatgagagtgacatgaacattttaaaatattaatgggggatccatttgagtggaagagtttcaatgtattaaaagacatcacagatattcaattttttaccaaattggaggaaatgaggtacaaggcagcaatggcaatctgttttacagaagagaagagatatctgccctacttcacaagttgagaaagaaagaaaaaaaaaaggacactgattctgataggcttataggtgtggaaatatgcaggtgagggagctgtattctgtaaacctcttgttttgaagcactggctgttgagagagaagggaaatatgaagtgggtgttagggttttgtagaaagaacagaaggtttgaaagcctgttttagacagtggaggaaagtattgactaaaccaagtaggatttctttgcagggaataaactggtttgagctaagtttaaagtttgctggtgggtgggtgtaacatcagttccacagcccacaggggaagaatgttaaggatgaagaagagctgaaggtgggatcaggggatcatgaggtactatggctcaagacagaggtgcatgtgggccttgataatctgtgcctttgtactttgggatgagagcatggttgaggtagtctcaagaggctcaaagtgtgtgtgtgtgttggtgtcggggcagggggcggggagaggtaggtggggccacaggatttaatgggatttaaatattttatctagtgcattatccttccgacttttatataaaagaataaataaaagactcattattttgtctggtgggtgacagaagaaggaattgcatgaaataaaaatcaacttcaattactcatgaaagctttaatagttggaaaccttgctaaacaaattttctcttttaaatggtaccctttttacttcttgaattcagatctccctagaaatactgaaagaaatgtactgaaagcacatggagaaaaaagacagttgaggtaatcttaaaaaaattaatataaactctatcaaaagttgtaataacttaacattatgtaatatctctatataactataaataagactactgtaaatactactaaattgattcttgttcatgagtgtatgtactaaccatgctgataacattatctgctacacctaaagagtttttaggtgaaacagcctcacacattgctatagttgtttagtcaagcagatcccgtatccaacagcagcaatatataaggtagcaaatgacccatggtatgatttagtgttacaaggatgaatttgagccagtttaaatctctttcaaaattttaactgagaaaaaaaaattatttagtgatggatcatgaaatgggatacctagataaatgctaagatgtagaatcggtgtcaaaacataggataaaggatacagaatcagggccattaaatattatgaggtattgtgacagagacaggagaagcagatagaaggataagccagggaagtagggggtgtagtaaaaagaattacatcctgcctgtaatcccagaactttgggaggctgaggcgggcggatcacgaggtcaggagatcgagaccagcctggccaatatggtgaaaccccatctccactaaaaatacaaaaaattagccaggcgtggtggcgggtgcctgtagtcacagctactcgggaggctgaggcaggagaatggcgtgaacctgggaggcggagcttgcagactgcactccagcctgggcgacagagcgagactctgtctcaaaaaaaaaaaaaaaaaaaaaaagaattacatcctgtgtgcagagaaagaattagcacctttctaacgagaggcattaaggacagagatgcagaggaggaacagggatctgggacagtaatggcacaggtttaatgggagtgaagttactgagaaggtctgcctgcatccttccagttttagaattgagtttcagtctgcgtgagatactgctctaaatctttcctgattttcagaaacattcttacatttcctatttccactagtcaggatagcttgaacgggtgtcatttcttaaaatccatagtctgtgtggaatgttcattatttttctcttgaagtggcccaaagacaagagaaatgatccacagggtagacttggaactgagtactgaaaagggggctcaagagcatgggctccagtctcattatggcatctgacttgggcaacctttgcaaattcgcttatctctctgactcttttctttcctcatctatgaagttaaatatttaagcgaaatgatttctgtctccctctaattctaactctttctggtttcacacggaaaatctgtttattgtattaagcagatcttcataaaatatatgcctgtatctggaatttaaatcatagactattatctgaattattcaagctaagggcagcctctgcttgacatactattttaaaactttttaaaaaaatagcaggtggaagatacaagtgtgaagagtgagagttgaatcaagcctcaaggccttaaggcttaatctaatacaaaatggaatatttaaatactgtaaatggctttcaggttttaaagcctaggacatctcaaaatatttgtcctttggtgactaattccacatatatcaataactaattagtttttattgattgttttctctcaactggtcctattatagttactatggatcataaatatgctttgttgattgttttctctcaactagtactattagagttgctatggatcataaatatgctttgttctctgcaaactttcaatttgtgaggaagacaacataagcatagtaagcattcaatttattggtatataaggatttatctctgtacgttttcagggaaggaattatcaaagaaggctggaatgcttagggttatggaaatagaagctccagggagaggggaaatctaagcttgcccttaaagaaaatgtaggagaaaaagagacagagggagagaaagagaattctagatagaagaggtaacatgagcgaagacaaaagacagggaaaaaaagagtgaacatcacatgggcatagcacttacatctgaggatttcaacaagactgaaacattcattgttttctttgatatcatatataattatatgtgataattatcagctgttatattttaaaccttgtaagtgaatcactatttttatctgactgttgctctatctataactgttatatattttaccagttaatgtaattatatcttccctcccatatgagaaaagcaagagaatgcgataagactataatagaagacattgtaatttacgtgtcaaaaagacaaacctaggggaagactaagtccccagcaaacgatagaaatgattctttcatttggcaattcttatagaaaaactctgcaaagtaattgttaatggcgtgaccttgaaataatcctctttatttaaactataacttgtatgttgacagtacaagggctggcacacaaaaaactgtgatttatatttcagtagatgtaaaataccagagagggaaatccagagttgctttggtcacatttacatcttaagggaagtgagagttatttggcatttgcaaagactggaaatttgcttctaattatggagctggacattgattgaggctgtattgtgttaagctatgaatgtaaactgaggctttctctgtgtctatgtaacttgggcaaattattttactcctctagactcaatatctacataaataaaatgtggataataatattatatttcattttatatcctatatgtgactattacttgacatattggaatgaggagaactcagaacattttctggcacacaacactcaataaatgttaggcattactataatgaaaatttcatattggatatcattacctgtcatctaacaggaggaaaggaaagcatcatatctaaattgggacagcaacataataaatattttatttatgtacatattttatttgtaggccggaagcttctgtctatcatgttttattaggatgtgagtatgggaaaggcatgtaattagagttgcctaagaaagttaatttgcaaatttttatctaagaaagtttctgaatttctcaatagtagtcaaccctactccattcttaattataaaaataactttaaatttaaaaagtataaatgcatggccacattttaaacccatcactcacacgtcttaatgtaggcagcagcatgtcatcctgaatttatttaaaattcactttgcattaagaggagttgtaattattagctgccaagcctggaagagattgaaaacataacctttctttttccataatataataatgcctaaactcaaagtatatatgtgaatcttggctaaaaaatgacatctgactggcatcctattcatgatatgccatcttctatctttatgccaaatatacagtgatacacagaagttgaagaaaaacttatggaaatactgacattgaagacaaattttcctaggactgtagaggcattcttattaatgtgaaactggactaagaaacaaccagtgtctacccaccagacaaacattggcacacacatcatcccaaatttactattttctttgaatctcagagaactgagctgtgccaccagaaaattatttttttttttttaaaaaaaaaaaggtagtctctttttttttcaaatgtttttcccccatccatccagaaaatgaatttcccagaaaacaagaaatacattttctttgttgattgatttagttggttaggtgtggtcactggtgctgtcacaataatctctgtggttaaatgttaatcccacaagtcaaagccagataggcaaggaataaagtagcaatatgttaaggttcctgcaggaagagttttctatgcatcctactggtaaaagtgtgagagctccagatgataagataaaagggatatagaatatatgaaaagtccacactaagtaaatgcttagacaaatgcttcctaaatgttaggacttttgctaaaagctgtgcttatatgcctgcttttgaacttctcacatgaaaacgggttttgaaagaacattagcgaatagtgagcacagccaaggcaattcacaaaatgtgtctgtgggcaagcagatttgtcttcaggccatgattagcaaacaaaataaaacaaacagatttaaaaggtggcatgcttgaaaaatatcaagacacaaaggaatcagaggaaaaatatacatctgaagtgtacttaataatattgaaatgttatataaacttttgtggtatctaacaatgtttgggacaggaaactctgccaatgtgtcagtggtggacctgacctgccgtctggaaaaacctgccaattatgatgacgtcaagaaggtggtgaaccaggcatcggagggccccctcaaggacattctgggctacactgagcaccaggttgtctcctccgacttcaacagtgacacccactcttccaccttcagtgagggggctggcattgctctcaacgaccactttgtcaagctcatttccttgtatgacaatgaatttggctacaccaacagggtggtggatcatggtccacatggcctccagaaagtaagacccctgcaccaccagccccagcaagagcacgagaggaagagagaggacctcattgctggggagtccctgccacactcagtcccccaccacactaagaatctcccctcttcacagtttccatgcagaccccctgaagacggaggggcctagggagcctgacctcgtcatgtaccatcaacaaagtcccttgtgctcagccaataataataatacaggtataaagtattattgaaaaatgctaagagagtggatgttgtttgtagcacaaaatgcaactctactaggtaacgcatatattaattggatagacttagtcatttcacaatctatagataaatcaaaaccttatgttgtacatgataaatgtgtataattttatctgtcaattaaaaataaacaaatttactaatggtaatctaataaagtaatgtttaagcaggacattcagcacttataatttctgtgtgtaaatatctaaaatttttcatcttgaatgatacagagttaccacgtcatactgaatgacatagaatatcttctgtactcctaatttccctgttatcctagtaatagatccaaatagatacaagagtggccctgtttcttacacctaaataaaacttattaaacacagataatattacatacatgaaaaaggagaaaaaataaaaatattgggaaatgtaaagaagagctagaaataagacattaaaaggccttgtattttattaaaaactcttgtgaatgcgggatggtctaaaattttgagtctgatccttctagtagatcaagttaccaagtgtatggtctgtggtatgaaattaatcaatttctaggaagaaatgctattatactctgaactaaatgcaaacagaaaatgtaggattctctcaaagagaacattctgtaattcaatgtatatgtttctcacgtgaattacaataataaaaaatgtggcaagttgcaaagggctgtttcttatgttcatcaataaagacctataatcaggcataaaaaagtattctatagcaattaaatataatgtggtccttcaatctgttgatttgacttcacctaggaatagactttgaattatctgaaaaaataaatgcactaaatatcctttgagtaaccctgactatatattctttctcttgaaagggatttttagtaaatatatatttgataaatacaattcttgacgaataatgagggtgaagctctcttactggaataagattgaaagctttttgtgtctgaaaataaaggccatttactttctatactcaagtgaattttaaaatgtattcccaagacaacgtttttcaaaactaatatatagatgaaaaaactaattgatgtttcaaagatatactcagagtagcatagttaacaactacaactatgacaaaaaaacaaaaaacaagcaaacaaacaaaaaacaaacccataaacacaccaaaggaaagaaaagaaatactaaaagcatcaatggaacccagaaaagctacttttggaatagcttccagaataaacatcttgtgacatttatgctggtgaggtttattattgtatagacttcaattgatttcaatccaaatcaaatatagatttaaaatatttgatgaaatatatgcctgtgttacagataatatatgcttatttattttccaatttaagcataactcttaataatttttaaaacaattttaacatgcctttgacctgtaatgaacaactacagaacctgaaagttgattaaagattcagtagtaacataagtaatatttgtggtaaaatattgatttaaaaataatgtaaactacattattaaagctatttaaataggccatgggagtcagggaagacaaaaggtctaaatacttttctcttcaatattttgttttatggaaatatttttatattgaaataattgtatttaaatttagattttgtgataaaagttaatttaaaggtatgaactataaaaccaccacaggaaagaggataatgtttcaacagttacttgttaatgtaacagtttatacaataaaaagtaacccacagtataggatttttcacatttacaaagtgtcaagtgtttacttcttcatcaatatcgcctacattttcattatttaacatctttgcccaattcccactgtaaccaagtgtatttccatgcagtcaagttactacccagcttagtttgaggttaaatgtaaaaagctttgacgttttctgttctcagagtcctcctgcagaagcctttgttctgacctttcacccacacccccaggacttctattcactaaaaatgtggaattatccatgctaatcctggaattctggtcattaaaagaaaaaaaattgtgtatatcattctctgcatcaatttcaaaagttattcttcacacctatatttagagatgcagctgaagcttaaaaatattcaattgggcatataattttataaaaatagagcgttctaaaaagaattgagaatcatgtaaaatttaacctgtttttactggatctataagtcaatataaaatatttatttttctgtgtacattcccatatctacttaatgacactgtatcatgttgattttgtcttttttctttcattagcctatatattcttcatgagagtaaataaaactaatcgtgtcttaaatatcgacttctattgttattttgaatcttcctaagggtataggtcaaggtttattcattcttaccttaccttctgttttagcatttaagacagctcatagtagacattggaagattggttaaattgctatttaaatgacctagaatacaattgtttaagtaatttaccaacctttgcaaagctgaattatatttgtgtattctgtcaatattacataatattaaggttctgagatgtgttctttatctttattcagcttttcctatattctagaaaatttcaccttcttcataataatttcttagaaacttgtgtttttttttctttttttcttttttttttttttttagatggagtcttgctctgtcaccaggctggggtgcagtggcgtgatctcggctcactgcaacctccgcctcccaggttcgagctatttcccctgcctcagcctcccaagtaggtgggattacaggcacgcaccaccacgtctggctaattttttttttttttttttttttttggtattttagtagagacgggtttcaccatgttggccaggatggtctcaatctcctgacctcatgatccacccgcctcggacttccaaagtgctgggattacaggcatgagccaccaggccctgctgatactatggactaaattgtgtctgcccccaaattatatatttaagttctaaccctcaatctggttatatttgggcatgacacctttaaaaagtgattacggttaatgaagtaataaatgcgtatccctaatctaatatgactgatgtcttcccaagaagaggaagagatgtcagggatatgcaaacacccctgtgaggatgcaataagaaggtgaccctctgcaaacagagaagagaggcctgaggagaatccacacctgccaacaccttgatcttggacttccagtttccagaactgttacaaaataaatttcagttgtctaaccttctagtctatggctttcattatggcagcccttgcaaattaatacagttagcttgggccagctcacagaacttaacaccaaagtgaaagctggcaaaaatttcgaaaattttataagtggaattttttaaattatctaattttaaacacttccttattattgagtaggccatttcatttttttcaaagataaaaacaaagaaatatattttaatttgcagaagagcaacttatgttaactgaagaaaatgcttactgaatatgaagttaaagtaaaatgtgttaaaagagcctcccttaaattattttagctagaagcataaatctgtctctaaacattctgtgatagcaaaatgaatataaatagcatattatgccattataaatagcagttttaagtgatatgattaataactgttagttctggagtcatatgctaatctttgtggaagcagaagctggctcatatactgacaacctctgtttgccctactaataattcaacccctagttgctattgtcacattgaactacaaattcctaacagaaattactccaaaacctaggaaatgaaacagatgctaacatttcaagaaagccttcaggacaagaacattaaaaaatcattttcatgtagtgcttgaagtaaatcaaatctgctggtatttcatgtgcttaagcgatcacagctttcccagccagtgagtatctttaaaagagaggtttctgtctttcatatcaagtattattttgattaaaataatcatttaatgaactagatctggaagaagtcaaaggtcttttataagattatgacataataatatcttagaaaaatctcttatttactgaaccactatttattttcaaagaataggaaaaacattatgataaagctcatcgaaggtataacttatataggctaatagttatacttagatttcttcttctttgatttttttttcaaaagaaaaaaattttttttaagttttttaaaagaatgcattaaaaccagttataaattcttgtccactactgccaggaaaaacaataaatcagtagggcctcatgcaacttatttggaagtccaaaattgatggtaaatattataatatgaatttacatttcagaaaaatatatgttcaagtgcattgtgagtgaaaaaataataattttgaaatatgcatgtaagagatgtactcttctgagagtagaggtgtagggaacactaggttcagaacagaggaagaaagagtaaatttttaatatctagtcttggtttattgatacacaaatacagtaataatccatatctagagttttactttcaaatagatttaacatatctgaatattggatactttgcatgagttttgtgaaaagattgagttaaaggtttcaaagccatttgagaatttcctttgaacacactaaagggtatctgtgaatactggcttattatatcatggctgatttacaataatttacgtgttgcctttcttagctggaactgtatgtgccaggaatagattaatccttatggttacatagatcagcagcaagacctcccacgtggaagtacctatattcatctttgtcatctgaaaataactttattagaaaatatcacatatcttcttattgccagccaggtgactcataggaaagtacaagataactgaaatcagctacataatcctatagttcatgcactattttcaaacactttgaaacttactgttggtaagtaaatgtttatcttaattatatctaaataatctcttccataattactcttgtgattgaaaccttgttaggcctcagaagcctctcgatatcaaaataactcataaattcctacttttatttgcacctcagaacatgagacttccagcatcctggaaagttcaaggtgtttcttaaactctctaaagggatggtttgcaagccagtctctttcataggaccaccataggccattctttctctaacagtccgatttaatttgtccatgacttctgcctttatagtcaactggaatgcctttactcttgctactatgtactattttatgctgacactatctcctgatgctctcaaagtcatcaactcttgggctgccagagtcctgctacattctgtgcacaactggtgaaaaatggccttcaattttaccctctgctgtgttgccatctgggccctacggcagcacaattcctgtcaagtgttttattaattccctcataaaaacaccattttcatcttcagctgtctagaagctccaaaccagttcagtgtccagtaagcatagacaccatgccaccctttgagcctttacattctcatcgtcgcaagttggatctcccaaacaaaagaaaaccatccaactttcttttccctcttcaacaaaattcaaagcttcttggcacattatttcaagcatacagatgctggtgggagtgtaataggaagtggacaaaaggaaagatatttggaccaagtattttatcctggctccaccttatgaataaaaggaaagtagacattgtcaggaattcactgatgtagcattaaaaaatctattaccaagagatcaaaggtagctagcaggaaataagataaaggactgacacccaattgtatccacagggcaagtgtttttattactaaaattccaataaaaaattagtgtttctagaaaatagatatttatatctgtgttcaggcagattaaaaaatcaatgagttttaaaaattacatttaatgaacagagtgatttatggtttgtttttgctttactaatgtgccagctcgatgtctctaataacaagtctggcttgatagccctgctaacaaatccagcttcatctagtacaatagaatatattttttctgaattcatttccatttactatctgctcagtttcttaaattagaaaataacttgactaattcaatggacaatggattggatatgaatctaaaatgaggcagtttcctgaagcccagacttaactgtatgtggcaatttgctttggggcattgtgcaagagaaggtttctcaaatttgtctaataatagtgaggctcttatagtaaatatcacagaatgctttgttaaatttgaagttcaacacataagaaaatgtccagaagaacacattaatgtccagaagacattacctaatcttgtcttttagaaattatcagcaacattgtgttgctgataacttctaagagacaagattaggttgtttgtggacatttatggaatagtcagtacaaatgtattgaagagaaatggtataattctgattgtgacactagattactattctgtttcttttaactttcttgcttctcaatttttagtgtaaaatatgaggggggtatattaaaaagataaaaggatctttgtaatcctaaggagctaggaagatagtctactagaagatataaatatagggattttgaaagctctgtgttcagaaatggcatcaaagtaataaagttccaatagagaaaaggaattacaattcacattacagtatttagataggactgtaagagaaataaatagctcttccttatttctcgtttaaaatttcagacaaatttgaccttcaaagatatgtctgaacaataacaatagaacataatagaaaaattgttctgactgcaaagaaatagacctttcccaacagtcacttcaaaatgcaaaccagaatgtatggtctatattgtttttaatttaatatatctatgtgaacaagcatacttcttcctcattttcattgcataaatttttacttggaatgcctttgaagttaaaccaatgtgcttcaaagttacatgtatgtatggtttttttttttttaccaactgtacatatgtctacaatttcccaccaaatatggtatcaaatatgtagaatctgagatgttataaaagcattcaaaatcatattttcctcataaaggaaacacaaaattgaccttaataggatattattgaggaatattttaattatctggttataaattctaaggtttcccaagatttagaaaacttactcttggatggcaaaatttactctaaagtattttgcaattgtgtgtgtgatagtgtttgaagtgacagggaaacctatgtatcctggaaacctatgtgtcaaggcattgttttctggatcatttattggcatatccaaaggcttgggaaaaaacttaggataaatagagaataatgaactttttcagaaataaataactaagattactccatgcaatagaatcccaaatgatttgaagttagactttattattagttatacagtaaatgtgataaacaagtttaccctgtgtgatacaaaaaataaaaaactgcagcatgaccataattttttctttatagataaggggctctcatgcttaaagtctgattaacatagccacatctgatttcaaaatatagatatgcccaatgaggtagttcttcacaatgggaatcgctggttaggtgttggttacccaatttcttttatttaaagtttaatggatatttgatgccatatagacaaaacatttggaaggagtttcaaattcccatctggagataggtgtcatataaaacagcctaaaaaaaataagaatggtttaaaaggcttgcttgagttaactaatggttggcaggtccatttgccaggcttattgaatcaagctttaccctcctttaaatgaggggtctgtttttccttggcaggaatgttttagattcagcatattaaaagctgcaaatatttgtgttgggttttcctttgtgagctatctacagcaatgtgagagagcgagtacatttagccacagcaggaacttcccataaaatcacagtaaatgactgtgcttttcttataagccacacccttcctaggcatttctcaaatactttacatagaaatgtgttcactttaacaaaaatcaataaatgcaaatattatttcatttgttttcattaactagtagaaatagcagtaatatattgttaattatattagcaggaccctatagcttaatgcaacaagtcaaaaggcatctggccattcctaagtattgtgactgatggagtaatatagacaaaaaaattggataaccttggaaaagtatgaagatgtgcagtttacaaagagctggctgaaaattaaggagaaatggcagatttgaaaccgtgataggtataaatgaattgtggtatggcctgattaaaaattttacttcatcatattcatactggagtctacataatttgggaagaagaaatattttgtcaaaactgatatatcccataaaatataactaacatactttgcagggaagcttaaggaaggcctgggagacaaaatggacaacaaatgtaacaataataatatttaagtgcaataaggttttttataatgtcattttttaaaaaataaagttttttataatgtctacataagggaaatcaacactgcattgactattagaattagtttgggggtctaatggactattcctgaaatttggactgaggggtcagattattaatggtagacctgaatttgtctcaaagaacaatgttttggaatctaataaaatctcttcagatactctctatttaactgattgcttgtttcaaaggtcaattcattttggaaaaagattatagatttttctcacattttatgacaacataaatgttgacaacttatgtttttgttaatgtatagtgttattcattatcaaaaacaaaaacaaaagcaagctatttgctaatagtcatgtcacaaatataattattatacatagaattatacagacccagttgcaatggacctttcttaacttccttataatttattatccttttaaaacacaagagaaacccatttggtatcttccacccatagcttgaaagtcttatatttatttgcttattagtagtacatttccatctgatacatgtaatattaggttgcattattctagatccaatttttccttctgtaagtgaagtttatgaaataaggttagttgttctagtcacaaatgcattgtacaatgaaaagcatggcattataactcactatattttcatgataagaaaaaagtatgcatatttattgataaacgtattttaagtgtattccttatagtgcgggaagtgcaaagatgaatgaaacactctagtaaagagcagtgtgcttcaagtttttctgttgacaccttgtgtaaaataattttgaaagaacttcagccatttcaactgacagatcagttgtaaagcatgtaacttttggcacattttaaatgttgacattctaaactataactgttatatcatttttaaaaattcacaatgaaacataaatataaaagcaattcaatatctaccacattcatttaaaataaatgagttcttcacagcggttggaaatggtacttcatttctttctctccttgaaatcatatcccagtccactacccacccttcctgttatagaattttattctattaaaatttatttttatactttaaattatttttagtgataccctgaaagagagccaggaaaactcattatatagaaaaaaaaaggaataaaggtagcacggagcaagaaagaagataaagtgacagggaaatagatcattagatgagcacgtaacactttaaaatctgtgaagttatggtgtctgtcatttattattttttttttttgcagacgtgtgcattgctgtgatgtaaatctcttctaatcttttctcgtgaaaatctttaccctgctctaaaatgttttgcaacaaaatttgtacacagattaacattttattttgaaagaatcctgtccaaatggcggcaaatgaatgtttttaaaaagttcttccagattgcattatcactacaacttttataaaaaataatggcaataattatcatgttgataataatagtggctaacacgtctggaaggcttactaagcttcaagcacgaatctatacattacctatttatacctctacttgtagctatctatttatatagagtgtccaccaggtctggaaacacaaacgatatataataaatgattcactgatatatattagattgtaatactttcaaaaagtaatatttgattttctagagttatgatcaccttacaacaatcatgtaaggtaggtactatgcttaacccagcttacctatgagggacctgaagctcagtcagtttattaactttaacatgtgattaaaaattgattaattcaagagttgaatcaggcaggctggttttaaagtttacactcaagatcaaaatgcattattatagactttgatatatattttgattcataattcatcttaaacaaaagtaaaattttatttaccctatattatttaatgagatgaagaaaggggaagctcacatgtccttttgaaaggaggcttggcaaacatcaatgtatccaccatccctgtccccttgtttgtggcctaagagattgttacaccttccaaaaatgctctctagtaagattcagaatgggtgatacaacacttgtgttttttgtgtggggagggagacgtaggtaaaagaggaaaaggaagattgtgaaaagagaagtggaaaaggataactagctggaagcttgtagcttcgaagttttctctggcagatcagttttaggaaggagatcaaatcgagtttgagaatcaggaaattgatttctgtaaaagaagctgtttctgcctatgtggtaagggtatggataactcacttcataggtccttggtctagggaaaagtgtaacacaaagtaaatgatgaaactcagttctatcaaaaatgaaaatgttgttgcatttgagaaccattatggtgggcaatgtagtaaaaaggataagacattcatcctactttaatgtaaaacaaatttgaaaagaaaaaatgataagtaaagaatttcatgaaggtattatcgtcactgcatataatatgctttctactaaatttcaatggcagtttatgtttacctaccatattaaataattgctattacattggtatcataattcctcttatgagaggaactgttctttctgataaaagaaattaaaaatccacttagagtagagcagactcttggtcataaatgttatcaggtgctcaaatatcaggggaagaattctcctctccatgaatcaaattagaaaatgcattacttttactcatgcaacagaagctggaaaatgagtgacaaaaagaaagaatggggtaaagacacaatgaagtcaaaaagagagaggccaaaatagattattgggagaaataagtgacatctaaaaatggtcatttctactatttgatttgaagttgtttgcattggtagtatgtgaacctctcccatatctgctatcatgtaaatctttaatgaagtctactgtctgtgtgagtgaaattttttacagagatcaacaccagggctgtttcagggatcaatgcaaagcagaacaactatatacactaaagaagagtctgattaagggcaaattaacaaggacattgcagggaagcatattcatgagggattccaccattttacagaaataataataatatgaaaatcttttagtgatgaagaagtactggtagactttcatggcacttaagatgagaccctcaaggcacatgatcaaggatgattaccagtacttacttatttaagccagtgtcatatttaagtcccagctttattttgctgtggaacatgtaagttaacataaatgacaagtcacactgacctcatttggttgaattttaattactttaattggagacactgctcattatacagcaaaatgagaataagtatttgtaaacattctattaacaaaaatgaatcttttgaatctttaattatgacctacaagtcattaattgtgtctctcatacacatgggagtatacctaatttgaactctgagaaataggacagtgtgctataaaattttaaagagatgataagatgatcattcataaaattgattcattaagcaacacttcaaaatactataagcagccaggtacagtggctcacgcctgtaatcccagcattttgggaggccaaggcgggtggatcacgaggtcgggagattgagaccatcctggctaacacggagaaaccccatctctactaaaaatacaaacaattagctgggcgtggtggtgggtgcctgtagtcccagctactcgggaggctgaggcaggagaatggcgtgaacacgggaggtggagcttgcagtgagccaaggtcgcgccactgcactccagcctgggcgacagagcaagactccgcctcaaaaaaaaaaaaaaaaattactgtaagcataacttttctggagtattttcatataatttacaaatatatttttagtttatataatataaatattgcttcaattttagctggattaaaatttaaatgcaaaaattgatctattaaatgattagaaatttataagttaatatctttactattttggagtctgaaagaactttccacaagattactaaactttactgataactagaaatagatgcttctgttgccaaaattcaaactagccagagacatttccctttatattttttttatttcccacttcttacccatctgtcaagttttggtcagctgtatgattacataaataaaaccatacaaaaaaaaaacccttgtagttagaggaattgaactattataaatcacatagttggttacaaagaacttcagatggtattttatttctagctattatctttaggtcagagagttacaggcagctatttcagaacttcagagctgggatggacctgagaaatctcacagaaaaatcttctcagtttagagacagaaattaggagttcaggagggttttgtgatgtgctttatattccacggcagtggtagatgagctaagactgggagccccctctcctaagtgtctgttctgtactccttttattatgttaaaatggaaacatacataattcaaactaatatgatggcaaactgcaatcatagttctcatttacatttttaatctccataaagataattttttctacctctttcttgctagaattgaagtgaatttacaccttaaactgcactattagaacaaaaacaactcaaaaggcagccattaacttctcacagaaaatctttgcaatgctctacaagttctgtgagaccaggctaatgaagagaatgcacctttaaacttggacctttcattatcagctacttccaatttatcttcttcaaactctcaaacatgttataagttgaaaaacacacttggaaaaaatatagtgtattcctctcagtgttcacatgaagacatgactgatacacacagatagtggaggccaaatccagttcttccctagtaagtgaattttctcccattgtgctctctttcctatatacctttattaagcaaactttgggccttttgaaagttgatctgatattacttcacataaaaaccatcaggaagaaaaatccatctgtcagatataagtaggcattttgagcattcaaaccttgctctaaggaacagtgagtcatgtgaaatgaaatgtgcaaaggaagctgacacatgaaaggacagaacaacaatgatgagttcccaaagacatgctgtgggagaaagaacaattatagaggatctatttttgggtccagcagtatgaactgggaatttaaaaatcacagcttaagtacagaaggaggaatgatgtcacccagctttaaatttaggagaaaataatttagtagcctttagttttaatttaggttattgccatttattacgatgatacattattgaattgtcaaacgtttgcagtctaaaaacaagttaatgcaggacatttaattttgtaggaaaggcagctatgaggtgtaacattaattgcataattaatattttatttgccatggtactataatgccaaacataaataacaagacaaacacatctggaacagcagtctttctggaagcaccaatgccccaaaagcctgtagttaatgcccaggattgaaaatgagactctcagagtggccagggagttctaaaaataatatttagagtcatttaaagttttttcttcgcttataaataaggttatcatcttatgttccaattatgaaaaagttttacatccattcataggaatataacagtgacaatgtgaatagaaaataaggaactctatagagaaaaggaacttagttcaaatgagcaaattagccctattttataatgttaaacataattttttgtatatatccatataattatggttatatgttttatacagtatatatacatataatatatgatgtctgtggctaattttacaaaataactaatattaataaatctaataggacacattcaaattaatttaacactcccggtagtctggccaagagaacagcaatatggagactaagtccactgccaaggtgccaaggaaataattttgtaagtttgacagatgtccataattccatctttattaatattttgttagattgcctttcaaggttctcttttattctaaagttaactatatgcctttccgtgaaatatttcttactattgttaacatggtcttatcctcagctttactggaaatgcaacatgttacttttattaggtcatgaatgttgttttgtaatatatgcaatacctgaaagtagggccatccaaagttttgacagatggtagcacaagtggttggtgtatcatcgtaggaccctagatgacaagagaacattcctgtgaatttggtaatattatgagtggatggtgggatttctcagaatttaacctcaagttaaatactagtgtgtttctttgttaaaaccataaacatatatatttcaaatgatacttttcaatggaaagttgggaggagacataccaggtatattgaggttgtcaccatgctaacctgaaagtaatcagtaactttgttcttggcatcatatgtcctaagaataggaactccaacaggcacaaacatggaggcagatagtgcctgttctttaaggtcttggccctaggaagatgtgtaatctatgtatgaatggctctggtctacaggctggggatatggtagtccctgctctcatggagcttatattataaggagaaaaaaaaagaaacaaataaatattaaaatggccagttttgataagtggtatgaaggatagtaaagcaagctaagggagaatagggagaaatgagaaatgtatgatggtggtacactagatagaatagtcacaaaaagcatctctgaagaggtggtatatgagcagtggacctgaagtaagagagcataccaaggaatgttcaggagaatggtcatttttagaagaaaggatgactgagtcaatggttctaaggcaggaatgacttggctagttcaaagtacagaaagagagtcaatatggtcatagtggagtgaatgagggcaaagagcattcaagaactgggtcaaagagggaaccagaggccaaatcttgtcagtaatgagttttaaatctccataaacaggatgttactaacaagttaaattcattccctgtcaaacaaatatggaagttacataaatgtagtttacatacatcctttcaggctcaaactaatgttgaaagcaagacatagctagtttaccttgctttgcatttacacactgtttgaattttaagaacttgaaaaatgtcagaattgcattttgtgaattatttatcttaattaagtcataatgacatttgaaaggcttttaatgaccttttgcttatggagcatcaattttctactatacccaacaataatcagatctattgccaataatttctttaaagtcaacagagatgttgaccctcaaaatgtaaaccctcaaaaatattcagaaagcttattattaaaagtaatctctgcaactgaatcttttgtaaatcaaaaatcacttccaattattttgaaaaattaccttgtaaatgtttactccttcatgtgtttttaaaacatattatatatcactaaaaattaactaacacattttataattagaatcatgtggtcatattaattagatgtgtatttgtacattggcaaaaagtctgcatatacagtcaacacactgcattaggatgttgcagtcaaagatggtccacatatataactgtggtaccataagattttcatactgtatttttactgtactttctatgttttggtgtgtttaaatacacaaagacttacgagtgtgttacagttgcctaaaatatttagtacagtgatacagattcgcattctaggagcaataagcttcaccatacagcctagatgtgtagtaggctatcctatctaggtttctgtaagtaccctctgtaatgttcgcacaatgacaaacttgcctaatgacacatttctcaggacatatcccaatccttaagtgacacctgactgtatttagaatctggatttctaaaagctatttcagaaaaaataaaagttcctattagtctcagcctttattggcatacatatgaaatttaccaggttcaaagttgaagtttattttgagtattttcccaacttgctagaaaataccactagaagtagaaatactcagaagcattattttttttctgcatggttcttttttcatcccagccaaaaatgctatgaaagaatctttccagctttttggtgtttgggacatgtaaatggtcacttctggctatcagaaaatgtattgatgagttaattttggttaataaacatgttgcatatattaataaaattacaatgtatgtgtgaacatgtatttactacctcttctgaaaaatatcggttatctgtggtattaaattatgtactaaaatggattaataggcaagaagaaaggacaaaaagaaaacattattaagccccaatgtgaaagataaaaatacctagagaaaactcaaaagaaagagctaattttgttcaagtagcaaaactggctgaaatggttggacaataaaatcctaatcaactaaatctggaaaacacagaaaagaaatacagcaaatagggataacacctatactttcttgatataatgttgccatggtgaaatataacaacttatctgaagaaaaaatatataaacctaagtatatttatgaagagaaaatcagaaccttgaagaaatatactggttaaattcagctgatgcctataaaggcaatcaagtgaattaaaaaatgaggaattatgtgaaaaacacaaacttcaatgctttctatgatgttttgacgcctaagaaataattttttacaataggtagagagacacaatcactctcaggagatatgtaagcttcataaattattgtaaatgtgcaaccaatttttaaaaaagaagacatacacaccctgaatagaattattcattttcttcctctctttatttttcaaaggagattttgatagatattagataaagtttttgaataaagagaaatagaaagttagagctaagattcaagacattttctatctgtgttcttgttcatgagaaatgttattcatacatatccaattttaaaagcaataaaacatatttttgctttccctggaccacctaaccaaagagagatacttaatccttctcttaaatagttacaagcaaaaagtgacttaattataaccctgcaacattaagtcactgccattcaattagaaacaaatgtttcagaggaaaattttaattcatttagcttacaaattcattgtgactcataataaggaaaatgcagattaaaaccacaatgagatgctatgttacactcagcagactagcaacaattaaaaagtttgacaataatacacagcattagaaaagatatgacgcaatggaaacctcatacactgttggtgggagtataaattggcataagcattttgaactgctaggatcctgaaatctcactgaaaaatatatcctcaaaaaatcatggacatatgtgtaccaggagatatgttaacaaaatgttcatagcctcattgtttgtaatatcaaaactgtggaagcaatccagatgttcctcagcaggaaaaaggataaatacattgtgttacattcatacaatggaacactgtaatagtgaaaggaaagaaccacagctatacccattaacaatgatttatctcaagaacataatgctgaatggaagaagcaagtcttcaaagaatgtattcaagataactccactttcattaaagtaaaaataaaagcagaaaaataaagtaatagtttgcccagaaaccatatgtggtaaagtcataaagtaaaacaaggaaatgattagtacaagcttaggataaaggtttacttctgagaatgtccatgtgagtcaatcagggaagaacatgatggacaatcttgggtctaggcatacaggagtttatttatttaaacagtatatgtgtatgtgttaatgtccttgttttgctataaagaaatacctgaggctgggtaatttataaagaaaataggttgaattggctcacggttctgcaggctgtataagcatggctccagcatctgtttctggcagagcctcaggaagtctacaatcatgacaaaaggggagctgacatatcctcatatctcctatctcgtggcaacagagggagcaagagagggagcagaaaggtcctatactctttcaaacaaccagactttgtgtgaactaactaagcgagaactcacttatcaccaaggggatggtgctaggtcattcatgagggagccatccccatgattcagtctcctttccaccaggtcccacctccaacactggggaatcacatttcaatattcaaccttcatatgagatttggagaggacaaacatccaaactatatcagtatggtatacataatattctacatacaagaaatgttcttaattataaaggtttttgtagaaaagtatgcagagtataattccctcctaaggaatgatgtatttgttatgaatctatgtatcaaaatatatgaaatgcaatttattagggaaaggtcaagggatctggatcggagatggagctgccttatacagtactgatcctatttgaaagtttattatgtgatttaaatgtataaattatatatgatttcaagtttattattatatacacaaaggaattttggaacagcaataatgactaatccttgaatcaaggtgtgtgtgtttgtgcgtgcgtgtgtgtgtgtgtgtgtgtgtgtgtatttacccctgaatctgatggtgaaaagcgtctacaaatttgtaatttggattattaccaagttcctaagatttttaagttagaatgattcagacaggaaaaatgtgccaccaactcacagaactaatcattctcagcccagaattaaaatgggaagtattacatacttcttgttatttattggtagttcaatatatatttatagttattatttagttatttgtaaagacaatcacttgatttaaacatgcgtcctacttactgacttattttgttattgttagtttgactctattgtgttattatgccctattcatacaacatccaaaatacagaaaagagaacactatgtcagggcacacatgcatcatttaagcatcatctccatctgtccattgagccatcccagactcatttggtaggttcagaataagtagagagattttcactttaccaaacagcactgctgctttaaatgtggtatgatcagtgtagcccaacctgtagaggtcctgagagactgagacagattttatgacccctccacttaaaagcagagtaattatctcgaccaattgggttcaatcctgaaacacaagtcagttattaccacccaggaggtggtatttacttttcacaattttttaaataaatacttttcagctctgatcagaagtaataaccctgagacttaacacttaccattgtcccagtcgaaaaggcagataaggctttaccatccaaaagtttacaccaagcacctggaagatatttgcatgtcaactgaaaatggtacccactgacatgcccattgtccatggccatgtaggccaaagcatctcaatttatgtgattcagcactggatttttataatctaacaaattatataaatctagcaaatcaaatgtcttattggactaatttgtcttcttttacagcctctccttttatcttctctttcttttcttgtctttattctatgtgctccccttttcttttaaggtttctcttactttcaaatttcaagcctccctctgatcttttaacttggtgagcaataattactaagttaattttgttcttaaagtcatatctttctattctttagttgagaattttgtttggatatactttgttctggttggcttttcactctttaatcttgttccttccatttcaaatttcattaatttttgggtcaatctcccaagccttcacattgcatttgtaaaagccactgtcaccagacctgaaacaaaatgcattgctctggatttactcaaaaagagcaaagtttaggatgtgcaacattttaaaatgttaaattcaattttaaaaacatatttaaaactcagatacatataggccgggcactgtggctcacgcctgtaatcgcagcactttgggaggccgaggcaggctgatcacgagatcaggaaatcaagaccatcctggctaatacagtgaaacccagtctctattaaaaatacaaaaaattagccgggcgtgatggcggcatatagtagagacggggtttctttcaaggcttttatttatgtaaagtttatcttaagtgccttttacattatttcatcaagcctattcagattagaaatttccactctcttgtctttgtaaagacagccctatttttttttctattttaagctccttagaataaagaaaatgtgttgtagaatactgagttatcttgccatatataaacttatcagaacaaattgactaattttaaaaacaaaatatagtttatgttttgtaataataactttatcaaaaatatgttgtttgataatgactgtatcaaataaagtcagaaagtttagggataagagttaagaaacaggaaaggatagtggtaggaagaagccatttgacaatttttaaaaatgttttgagtaatagttcatctaagacagagagttatttaatccaaaccagtgtgctgcttatgatttaaaatccagtcagtagtgtgataagagaatatgtagaaaaacagtaaaattacaactttgacacattttatatacatattttatctgaatactatggatgtatgttgacaatcagtatttttctcaaagtaaagttattgttttactgaatgacatacatatttgaactcagaagaaagaaaaccttaatagtgacatttctggtaaatgaataattagaattctgttttaaaagaaaacaataaagttaacactgaatctcaaacaaatggggaatctaaatgggaaaataaaagatgtattattataatatgagttgggtccattcataatataacttgtgtaaagatccataatgaggctttcaaacaaattatgatttatttaatcacaaatatgtatttcaatttataaaagagtcctttggctgtaagtttagaaaacttccataacaatacaatgaggtaaggtcattgacagttggcattgtttttagagttatctgtatttatacatcaacactgaaaagcttaataaattacagactgacaaacatgtctgtttaccaaacagacgtaaaactttttggcaattaaacagaatttgtattctgctatagatgtttttagaaaagattaattttctttccctcaatttcattgctaagttgttttttttttcctccttgtataggctctttagtgctattgtccagaaaggcaataagtaacggaataaggcttttgttgggaggcaagagttggcaagtcagccagtttcaacaagaattctgccagttttagccattgtgtggccacttggggaaaggcttcaacattttatgttaaaatactgagcaatcttctcatttaccctaatgtgaaaggtcattccttggaatttagtaaaatctgaacactaagtatattacaggaagcatctttactaacttttttcctttcaaagtcagtgaagaaatacatattaggttgaagtaagaataaaaaaatgaaaactaatttttgaatattttctttttggaaatatacagtgattctaacaccttcagtaattttactctggcatctcttgaataatatataaactcacatgaagccaatatccagttttctgtgatttagactctagtataaagaaacattcattcatttattcatttaaatatttagtaaacagttttggggcacctaatatacaggcacttatctaggtgcttcatatatattagtgaaatgaaaatcaggcagaaatccttgcactggagcttacgtgttagtgggtggctggaaaataaaaaataatagcaaggttgggtgcagtggctcacacctgtaatcccagcattttgggaggccagactgggcggatcacttgaggccaggagtttgagaccagcctggccaacatggcgaaatcccatctctactaaaaatacaaaaattagctgggtgtggtcacgctgaggtaggagaattgctcacacccaggagacagagattgcagtgagccaagatcatgcccctgcactccagcctgggcaacagagcaagactgtgtttcaaataactaactaactaaatactaaacaaaacaaaacaaacaaacaaacaaaaaaccaacaaaaaaacagtaaatatgtaaattatagtagattggtgcaagatgattagtattacaggaaaaaaggacaaactaaaatagataaaaaagaaaagaggtctgtggtagtatagacgtaggttgattttaaataatcatcgatgtaagctctttagaagagttcacattggagcaagatggcagggtggtgagggacttaggtatatggatatctggaataagaacattttatgctagttgaaagaaacccacaggtaattcttaattctcctttagaaaatgtgcgtctctttctttaaattggtggcaaatgaaatcagaagtactggcagtaagtaaacttgtctagaggtgaaggacttgataaatggaagaagagacatttaaagctggaatacaagatctataggtccataagtaaggaagattagcattcttttcatactcagatgataatgtgatgcttatgtaatgtagagaaaaagacaaataataaacttagaaattattcaaataaatactccctcatactattattatattactattataatcttatatcaataaaattatatgatgcacaatgatctttgttccttacccaaaatttaatttcattgcaaatagtttttaaactggaatggatatactgtagtaactgatgtccatatgcatattaggttgaactaaaatgtccagacgaaaaaaaaaagcatgtctgttataaagactgtttcccttccatgttgataacatcacgcaactatttctgtaaggaaaaatgtagaccagaatgtaggacaagccttgaagtctaaactattttgagtaattaggggtagaatgttgtcagagtgtaaacatctaacatcttttatttcttttaaaaaagcacatgccatttcaagacctacatcatagttagatttaatgaaacattgagatggagtctcccttttctaagttaggaatccattaactaaatttatttaacttattcagacctctagcttaggaagccacaagttatatttaaggttttgaacatatgcagtcttttatggtactggagtcaggaaagttgagaacttgctcaacgaacttagctttcaggattagtatggaaaattacacatttaatggatgtttttgaagaatgcttgtgttatatctaaactcaaatataaagtctttgttaattttggtgtgtatttactttgaaggaagtagactggaatttggttcattaaatataaacatatattaattttatgatcaaaacgactttcacactgataacatggaacatagaacaggaaatccttttggaaagtgcataattaaggaagttagctattgttagaaattcaattaattaaaaaattaaacaatatttaggaaaatcattatatgaatttcactcctgccaggttgttccagaccttaatatttgctcatatctcatttgaaggccttcctatccaaattaatgaagacaaatattcatcaaagctttattcttaggaatatcactttctttaaccttggtatttgcaatggaattagacacaaaaaaatattttttgtcaaagtaagaaaggtaaaaaattatattagaagcaattgaaagggagatatttcagaatatcttaaccaaggaaaacataaaattgcgaacacagtgaatctggttgttgtttatttcaggttttttgatgtttcatcaataactgaaggtttgctacgataataaatatatacatatttattatatgtatttgatttatctaatttttcagacattaagagatctgatttaccaggttttgtcattttagaaaacactctagttaagatattgagtcttgatcttgtgacaagatgaaaaatagagtggcagccagtatggattaagactatacactttgattggaattgtctttacataacatggaagtggtggtgttgttgtccagagcaggagacctgtcttgttggccttcgacacctagcatagggccaggcacctcataagtacctcttatgaggtacttctatggaccatattgtttaatcctagtatcccctaaaggaaataaatgtatagtcatatgagttaaaatataaatattctttgacagaaataaactctgggatgaaaaatcagtctgcttccttcccccaaatgaaatatactgcaatattaccagattttaatttgtttagaaaaagagcaattttagcatacaggaaaatatgctactcttgaccacttgaggccagaatgcagctattgggcctatggtttggaaaaaagtgaacgttagacaggctaagtgagaaaacttagtggaaggagagggataccaaaagacagatggaaaattaccaactgcagattgtacttactgtatagtttttcctaacgccctgcaactcatgctgtctgtctgctgggaaaactcttggccatttgtttctgatgtccatgtctgtcttttgaattctgttccttactccttgatctataaaagtatctgaggtggcttaaaaacattatatatatatatatatatatatatatatatatatacatacacacacatatacatatacatacatacacacacacatacatacacacacatatatacgcacacatatatgtgtgtatatatgtatacatatacgtatatatatattttaccttattttataagagtaactgtcacgtgaattacctgcaacatgggtgtttaaactgagagttgaagaactcttaacatagctaacaaaaaggagatcctatgaaactcatgcaactgtaagcaaaatgagaatccctttgaatgtatttttttttaatttatggaaaaaaaggttttggtttcattacattctcaatgtgggtcttaatttataaaatattcaatgataaattcttaaaatgaattatgttaagccaaaacctaaattttttttgccatcctattgcacaggcactctttctttgtatttttgaaatataataaataagaaaatataagtgtcttccattaggtggcagtaataagttcctataataagaactttaaaaaaaatggtcaaaaacaacttggaatcctaaaagctgaatttattggatccttcttaatgttctcattttgagattgtggagctgctatagtaatcaaaactaaaattttccgacagatgtctacatttatctctactgtagtatagtcacacaagtagcaaacaaatttgtgtaaataaatttacttttattatcttgtgttagaagagattcagtttggatttggtgaatcatatcactattcaactttgcacaacttcagtaatgagaggtctaataatagataatacacaatagtataatgaaatatttaggatgtagattcataatatatgtaggataaaaccagagttttgtcaacgaggattgtgcaactttgggtttcactgagtttcacatgtaaagaaacgcaataatttttgtttaatatacctttttaaattgttaatatgcaggtattttaaagtgctcaagttctatggagatagtaattatcaatatcaattttattaggttctggcatgtattgtataatggcaaaaggatggtcactgtaacaactgtaattataaatcacacttgttcactcttcctgtcttacagatagattgcattctgtttatccgtatgggtgttgattgtttggaataaaattttgcatagaaacaaattatgtcctcagtctcattcacaacagacttaaggtgaacatgaaaatttattgaatatgtactaaatgccaagtgctaaaaaatttccacgtgttaattcatggattacttacaaaaccttataaagcaatatgattatcacttccactttatggatgagaaaggggaactaataagtggtaaattttgggttcttatgtggatgatctaaatccaaagcgcatcacagtgtacttctataaataccatatacctaaatttctaaaataaatgcatattttttcttaatttataaagtacattggtatatttgtagaaaagacagaaacaaatacatcattaaaagtaaaattttaaagacatatgcacattgactaataaaacaataaacatgttactctaatattgtttccattactaagtacaaaataaaaatcacagttttgtattgatgacattcttttcccatggttttaactctctttgtctattataatgttatttattgctctctgatacttaccaaagtttctatttttccttcaaattatccttggaagaaaggcaaaattgaggtgcatatgcaaaatatctgtgtaatcattggtctcagtttaattagtgaatgcgggttcaaattaacactcatttgtaaaatttatgaatttggtagttggatacaagaaaaatttatcttcattttggttaataaaaccaaacctgtgtgctcacgaatatgctattgatcctccatgtgactgcactgtaaggagatgggcacttataaaccatctagttgctatgtaagtaaatcattgcaatttaacataccaaatgatatgctcaaaattcaccataatttcatgagaaacataaatgagcttaggttagcctaagcctgaatagagaaataactacagttttatacaaaagtttatgtcatattaacactttttaattcaaaaagatatgttccatgttaagggaaataagatttgtctgaaaattgggctccatccagcagtgttaataaaatataaaactatagccccaataccataggggttatttatgtattcattttggcttatgctagattgaactgggttgggatttttgtctttttaatttttagtaatggaaaaggtgtataacacatttaatttaaaccatgaaaacattaaaaaataaaacttgcttaacatttcaaaagtaaatacactatttgggccatttttgcaaacaataatattttggtgtattagttttgaataatactgtctcttaagtaaacaaactaattgaagaaaaaaatggaagaaatgtgttttaggaaaatatttgcaacttattacctgataataattctagtaacctaggaaacatagaccctaactcagttcacaggcagtgatactattttatatttttgtaagaagaagtaagaccttattatgtccttaaaaattgaatacatttcttctcttttttgtaatatagcttattataattaaattaatttgattttaagattattcaaataaggaaaaatgcagagattaattgacctaatctaatttacatggtccatgtgaatatatgggaaaaggatagatccatctggttagaatgtagacttgtatttctggtaagtttttattttccacctatttgcatcataatatttttgtatattaaacgagaagatgtcttgaaataatttgtaatccagtatggtacatgtactttgtcagaaaaatagaacatacctgagaaattatgaatgtttatagtttacccatggatttgaaaaccagatacagataaatgttttaaatagctgtgtaccatttgtctatcttaagcgtattctccaatattctgattaagtcaaaactaagatacgttacacacttgactctcataagagcgtctttcattaacacccttgcaatgatagcgcttgtgtttatggtttaatagcttctctgaatgccaagcataagatacgcaataaagcaaaagattttaaatactatttcttgaacatatttgtattgtgaaaagtcgatactgtaatcattatatctccaaaaccagaattatttgataaagctgtattaaaagtcatatatagagtatgaaataaattttgtttagtgaataagtttttgatcctttaaagattattatattttttctataaagatctagaacaatcttttaaaattaagttactatcaaacttttgccatgtagataaaattggtagcaaaatatttttacaatgtttccaaatatgatctagttagaaatatataatgatgctattaactgaaattcagttagtgtttatgtgtttatcaaatactttgtccacattaatctgtaaagcaaacaaggtaatcattttacctttatattattttcaattttttatgaaattttatttctgttatgcatgaaaaaatagtataatatgtgcaggtgaacataaatattcttacaaatatgctaagtattgtcttcatttaaaattcattacatgttcggagtcaccagtgagaaaaccatatgaatcttgcccattcatttaaaataatttttaaaattacagacccagtattattttaaacaatgtttttgttattccaatttttcaaagtgaatgaacagtttcatatattataaaaatctacatattttaacttttagtataatgctttggtatgtaagatagaaaaaaaatcttgtaacaataatcaaaaacattatctctttaagaaatagaatatttcaggtaaaacatatttcagctcacattattcacatactatttcaattctatgtttcattttacatatttagcattgactgtaggctcaatgcattgattttatgatgctacaaggaaacatcttctagcaaagtaaattcatttctttatggctaaaagcatgcattgatattctgatattttcttatcattaaagaaagcacattttgaatacaataatatgaatttttatttcaaacttccagttatgtcctcaaatatttcctttggctaatgaccttcaatgttcatcgcctagtgtttttcaaaagtatttttggaaaacaaagattataaaccatactgttagtaaactcataaaaatttaatcaaattatacaagaaaattatgggtttgggactagcaattaaacaaaaattaaggaagtttggagagtttctcattataaaatatgatcataatataatacctcctaagaaaataatctgaattaaaaataatgttgttttaatttttgttactaacccacgtcattgggttagtaaatgtgttgtttccactttctcccccatttatataatggctaaagtcacattctaaaaacacttttcccatttctacacatgtgtcagggaactcagtacaactgaagattgaaaagagagagaaatcagccatgatactcttaaagaatcacaaatctaagaattaatttaaattttcattatattgaggaatttgtggaaaaattgagttgtaaattactgaggagttactcaggatgtttgtagtctattattaatgtgccagatataagtgattaagtacaggatgcttccaatgcaggacatcttggaaagtataattgcatttaggtaagaaaatatataacttaaaaatcatatctatcaacatcatttaaaatttgacatcaaactttctccagcaacaaatttgtgatatatctacacaaacaatttattaagcagacattagtttcttaaattgttcaggacagtctgtactatcggaatgagcattaacagatgttttatccaacatttcagtaagttccatcctggaaattcttttttaataaatactttaatttctttgtttaatcgtctaatatacttctttgggaaagctgtcacgtttctttatccacagatatcgtggtatcacacccccctccaaaagcttgcagaggggaaccagtcaagttgaagtattctcttaaagatttcaaaattaagaattgttttaaaaatctacatttcctaaactctaggtttttttttttctttgtagccgacaccatgatccaaataaagagcaaacagttcagggttagcagaagagagatttaaacacatctggcaacaatgaacacaaaaattagttcagtagttacagatatatgtgtaaataaaggtgaaaggcaaataaaagcaaatgtaataaatacaaagtgattacttttcaaaactctgcattatgatcaaccacagagtaagtgagactccgagacccattaagtagttattctttcacctctttcttacagctgataacatggaaagtttaaagacccttccggggggagaaatgttttccagttgtcaagattcaagcttagctaatattagagctaattttaaaagacattgttctgtgattaaggtatttgttcagaaatatgtcttttaatccatttagatttttaatacttgctaaatttattttctagaataccatggtaaacaatattatctagtagtattagattttgtattcatgttggggtagtaggctgtattttctctagcatgtgaaataagtgagactatgtttcaacattatttcagtgctatctactaaattctataatagaaacattgccaaactatatgagaatactacttagaataaatatatttattttgaatgtgcacttacccagtccagctcttaaggaaattctttgtgaaatattctcaggatggaactttactttctgagattccgcagaagagatttacccacaagcaaggtgggaaagagtgaaagctttgcaatgtgatcctgcaattaggatgagattcagttagcagagcttgatggtcctaaagcaggaggtgacactctctgctggagagagagaggttgttctgagtagattgtaagtgttgtcagattgtaagtgatcagcagc
